(12) United States Patent
Krieg et al.

(10) Patent No.: US 10,655,128 B2
(45) Date of Patent: May 19, 2020

(54) COMPOSITIONS AND METHODS FOR MODULATING MECP2 EXPRESSION

(71) Applicants: Translate Bio MA, Inc., Lexington, MA (US); The General Hospital Corporation, Boston, MA (US)

(72) Inventors: Arthur M. Krieg, Cambridge, MA (US); Romesh Subramanian, Framingham, MA (US); James McSwiggen, Arlington, MA (US); Jeannie T. Lee, Boston, MA (US)

(73) Assignees: Translate Bio MA, Inc., Lexington, MA (US); The General Hospital Corporation, Boston, MA (US)

( * ) Notice: Subject to any disclaimer, the term of this patent is extended or adjusted under 35 U.S.C. 154(b) by 0 days.

(21) Appl. No.: 15/787,876

(22) Filed: Oct. 19, 2017

(65) Prior Publication Data

US 2018/0223282 A1 Aug. 9, 2018

Related U.S. Application Data

(63) Continuation of application No. 14/401,237, filed as application No. PCT/US2013/041394 on May 16, 2013, now abandoned.

(60) Provisional application No. 61/648,051, filed on May 16, 2012.

(51) Int. Cl.

| | |
|---|---|
| C12N 15/113 | (2010.01) |
| A61K 31/713 | (2006.01) |
| A61K 31/7125 | (2006.01) |
| C07H 21/00 | (2006.01) |
| A61K 47/61 | (2017.01) |
| A61K 47/64 | (2017.01) |
| A61K 31/7115 | (2006.01) |
| A61K 31/712 | (2006.01) |
| C07H 21/02 | (2006.01) |
| C07H 21/04 | (2006.01) |
| A61K 47/54 | (2017.01) |

(52) U.S. Cl.
CPC .......... *C12N 15/113* (2013.01); *A61K 31/712* (2013.01); *A61K 31/7115* (2013.01); *A61K 31/7125* (2013.01); *A61K 47/555* (2017.08); *A61K 47/61* (2017.08); *A61K 47/64* (2017.08); *A61K 47/6455* (2017.08); *C07H 21/00* (2013.01); *C07H 21/02* (2013.01); *C07H 21/04* (2013.01); *C12N 2310/11* (2013.01); *C12N 2310/315* (2013.01); *C12N 2310/321* (2013.01); *C12N 2310/3231* (2013.01)

(58) Field of Classification Search
None
See application file for complete search history.

(56) References Cited

U.S. PATENT DOCUMENTS

| | | | |
|---|---|---|---|
| 4,725,677 A | 2/1988 | Köster et al. | |
| 5,491,133 A | 2/1996 | Walder et al. | |
| 5,576,208 A | 11/1996 | Monia et al. | |
| 5,623,065 A | 4/1997 | Cook et al. | |
| 5,652,355 A | 7/1997 | Metelev et al. | |
| 5,661,134 A | 8/1997 | Cook et al. | |
| 5,734,039 A | 3/1998 | Calabretta et al. | |
| 5,766,903 A | 6/1998 | Sarnow et al. | |
| 5,912,332 A | 6/1999 | Agrawal et al. | |
| 5,914,396 A | 6/1999 | Cook et al. | |
| 5,919,619 A | 7/1999 | Tullis | |
| 5,965,722 A | 10/1999 | Ecker et al. | |
| 5,976,879 A | 11/1999 | Kole et al. | |
| 6,015,710 A | 1/2000 | Shay et al. | |
| 6,040,142 A | 3/2000 | Melki et al. | |
| 6,046,307 A | 4/2000 | Shay et al. | |
| 6,063,400 A | 5/2000 | Geho et al. | |
| 6,080,577 A | 6/2000 | Melki et al. | |
| 6,107,094 A | 8/2000 | Crooke | |
| 6,143,881 A | 11/2000 | Metelev et al. | |
| 6,146,829 A | 11/2000 | Cook et al. | |
| 6,187,545 B1 | 2/2001 | McKay et al. | |
| 6,197,944 B1 | 3/2001 | Walder et al. | |
| 6,210,892 B1 | 4/2001 | Bennett et al. | |
| 6,284,458 B1 | 9/2001 | Anderson et al. | |
| 6,294,650 B1 | 9/2001 | Shay et al. | |
| 6,326,199 B1 | 12/2001 | Cook et al. | |
| 6,346,614 B1 | 2/2002 | Metelev et al. | |
| 6,359,124 B1 | 3/2002 | Ecker et al. | |

(Continued)

FOREIGN PATENT DOCUMENTS

| | | |
|---|---|---|
| CA | 2805791 A1 | 1/2012 |
| EP | 0 999 270 A1 | 5/2000 |

(Continued)

OTHER PUBLICATIONS

Taylor et al. Drug Discovery Today 1999, vol. 4, pp. 562-567.*

(Continued)

*Primary Examiner* — Tracy Vivlemore

(74) *Attorney, Agent, or Firm* — Wolf, Greenfield & Sacks, P.C.

(57) ABSTRACT

Aspects of the invention provide single stranded oligonucleotides for activating or enhancing expression of MECP2. Further aspects provide compositions and kits comprising single stranded oligonucleotides for activating or enhancing expression of MECP2. Methods for modulating expression of MECP2 using the single stranded oligonucleotides are also provided. Further aspects of the invention provide methods for selecting a candidate oligonucleotide for activating or enhancing expression of MECP2.

16 Claims, No Drawings

Specification includes a Sequence Listing.

(56) References Cited

U.S. PATENT DOCUMENTS

| | | |
|---|---|---|
| 6,395,492 B1 | 5/2002 | Manoharan et al. |
| 6,451,991 B1 | 9/2002 | Martin et al. |
| 6,503,754 B1 | 1/2003 | Zhang et al. |
| 6,531,584 B1 | 3/2003 | Cook et al. |
| 6,602,857 B1 | 8/2003 | Cowsert et al. |
| 6,608,035 B1 | 8/2003 | Agrawal et al. |
| 6,677,445 B1 | 1/2004 | Innis et al. |
| 6,727,355 B2 | 4/2004 | Matsuo et al. |
| 6,753,423 B1 | 6/2004 | Cook et al. |
| 6,794,499 B2 | 9/2004 | Wengel et al. |
| 6,831,166 B2 | 12/2004 | Manoharan et al. |
| 6,919,439 B2 | 7/2005 | Manoharan et al. |
| 7,015,315 B1 | 3/2006 | Cook et al. |
| 7,033,752 B1 | 4/2006 | Melki et al. |
| 7,041,816 B2 | 5/2006 | Ravikumar et al. |
| 7,045,609 B2 | 5/2006 | Metelev et al. |
| 7,226,785 B2 | 6/2007 | Kmiec et al. |
| 7,374,927 B2 | 5/2008 | Palma et al. |
| 7,449,297 B2 | 11/2008 | Freije et al. |
| 7,655,785 B1 | 2/2010 | Bentwich |
| 7,683,036 B2 | 3/2010 | Esau et al. |
| 7,687,616 B1 | 3/2010 | Bentwich et al. |
| 7,687,617 B2 | 3/2010 | Thrue et al. |
| 7,709,456 B2 | 5/2010 | Corey et al. |
| 7,838,657 B2 | 11/2010 | Singh et al. |
| 7,858,592 B2 | 12/2010 | Shames et al. |
| 7,879,992 B2 | 2/2011 | Vickers et al. |
| 7,888,012 B2 | 2/2011 | Iversen et al. |
| 7,960,541 B2 | 6/2011 | Wilton et al. |
| 8,067,569 B2 | 11/2011 | Iversen et al. |
| 8,092,992 B2 | 1/2012 | Kuwabara et al. |
| 8,110,560 B2 | 2/2012 | Singh et al. |
| 8,129,515 B2 | 3/2012 | Esau et al. |
| 8,153,365 B2 | 4/2012 | Wengel et al. |
| 8,153,602 B1 | 4/2012 | Bennett et al. |
| 8,153,606 B2 | 4/2012 | Collard et al. |
| 8,222,221 B2 | 7/2012 | Corey et al. |
| 8,232,384 B2 | 7/2012 | Wilton et al. |
| 8,288,354 B2 | 10/2012 | Wahlestedt |
| 8,288,356 B2 | 10/2012 | Obad et al. |
| 8,318,690 B2 | 11/2012 | Collard et al. |
| 8,361,977 B2 | 1/2013 | Baker et al. |
| 8,361,980 B2 | 1/2013 | Kauppinen et al. |
| 8,404,659 B2 | 3/2013 | Kauppinen et al. |
| 8,415,313 B2 | 4/2013 | Mourich et al. |
| 8,846,639 B2 | 9/2014 | Swayze et al. |
| 9,328,346 B2 | 5/2016 | Lee et al. |
| 9,567,581 B2 | 2/2017 | Lee et al. |
| 9,580,708 B2 | 2/2017 | Uhlmann et al. |
| 9,593,330 B2 | 3/2017 | Collard et al. |
| 2002/0160379 A1 | 10/2002 | Cook et al. |
| 2003/0198983 A1 | 10/2003 | Zhou |
| 2003/0208061 A1 | 11/2003 | Manoharan et al. |
| 2003/0219770 A1 | 11/2003 | Eshleman et al. |
| 2003/0228690 A1 | 12/2003 | Baker et al. |
| 2003/0235822 A1 | 12/2003 | Lokhov et al. |
| 2004/0002153 A1 | 1/2004 | Monia et al. |
| 2004/0038274 A1 | 2/2004 | Cook et al. |
| 2004/0096848 A1 | 5/2004 | Thrue et al. |
| 2004/0241651 A1 | 12/2004 | Olek et al. |
| 2004/0248840 A1 | 12/2004 | Hansen et al. |
| 2005/0003369 A1 | 1/2005 | Christians et al. |
| 2005/0026160 A1* | 2/2005 | Allerson ........... C07H 21/00 435/6.11 |
| 2005/0054836 A1 | 3/2005 | Krainer et al. |
| 2005/0100923 A1 | 5/2005 | Dreyfuss et al. |
| 2005/0108783 A1 | 5/2005 | Koike |
| 2005/0130924 A1 | 6/2005 | Monia et al. |
| 2005/0164209 A1 | 7/2005 | Bennett et al. |
| 2005/0176025 A1 | 8/2005 | McSwiggen et al. |
| 2005/0203042 A1 | 9/2005 | Frieden et al. |
| 2005/0226848 A1 | 10/2005 | Kuwabara et al. |
| 2005/0233455 A1 | 10/2005 | Damha et al. |
| 2005/0244851 A1 | 11/2005 | Blume et al. |
| 2005/0246794 A1 | 11/2005 | Khvorova et al. |
| 2005/0261218 A1 | 11/2005 | Esau et al. |
| 2005/0272080 A1 | 12/2005 | Palma et al. |
| 2006/0003322 A1 | 1/2006 | Bentwich |
| 2006/0046260 A1 | 3/2006 | Kriksunov et al. |
| 2006/0089490 A1 | 4/2006 | Melki et al. |
| 2006/0128646 A1 | 6/2006 | Christensen et al. |
| 2006/0135458 A1 | 6/2006 | Vaillant et al. |
| 2006/0270624 A1 | 11/2006 | Cook et al. |
| 2007/0032446 A1 | 2/2007 | Cook et al. |
| 2007/0042380 A1 | 2/2007 | Bentwich et al. |
| 2007/0111963 A1 | 5/2007 | Corey et al. |
| 2007/0123484 A1 | 5/2007 | Bhat et al. |
| 2007/0166737 A1 | 7/2007 | Melki et al. |
| 2007/0191294 A1 | 8/2007 | Elmen et al. |
| 2007/0219244 A1 | 9/2007 | Jenssen et al. |
| 2007/0269815 A1 | 11/2007 | Rivory et al. |
| 2007/0292408 A1 | 12/2007 | Singh et al. |
| 2008/0015162 A1 | 1/2008 | Bhanot et al. |
| 2008/0139472 A1 | 6/2008 | Lauterborn et al. |
| 2008/0176793 A1 | 7/2008 | Simons et al. |
| 2008/0194463 A1 | 8/2008 | Weller et al. |
| 2008/0242629 A1 | 10/2008 | Crooke et al. |
| 2008/0249039 A1 | 10/2008 | Elmen et al. |
| 2008/0293655 A1 | 11/2008 | Aygun et al. |
| 2008/0311039 A1 | 12/2008 | Bonavida et al. |
| 2008/0318895 A1 | 12/2008 | Lee et al. |
| 2009/0082297 A1 | 3/2009 | Lioy et al. |
| 2009/0092988 A1 | 4/2009 | Schwartz et al. |
| 2009/0099066 A1 | 4/2009 | Moulton et al. |
| 2009/0099109 A1 | 4/2009 | Shames et al. |
| 2009/0123467 A1 | 5/2009 | Bedi et al. |
| 2009/0143326 A1 | 6/2009 | Obad et al. |
| 2009/0155910 A1 | 6/2009 | McGonigle |
| 2009/0156538 A1 | 6/2009 | Dobie |
| 2009/0221685 A1 | 9/2009 | Esau et al. |
| 2009/0258925 A1 | 10/2009 | Wahlestedt |
| 2009/0324549 A1 | 12/2009 | Battaglia et al. |
| 2009/0325868 A1 | 12/2009 | Liu et al. |
| 2009/0326051 A1 | 12/2009 | Corey et al. |
| 2010/0004314 A1 | 1/2010 | Dondero et al. |
| 2010/0021914 A1 | 1/2010 | Moeller et al. |
| 2010/0087511 A1 | 4/2010 | Singh et al. |
| 2010/0105760 A1 | 4/2010 | Collard et al. |
| 2010/0111982 A1 | 5/2010 | Zang et al. |
| 2010/0112042 A1 | 5/2010 | Polisky et al. |
| 2010/0124547 A1 | 5/2010 | Bramlage et al. |
| 2010/0143359 A1 | 6/2010 | Ebert et al. |
| 2010/0197762 A1 | 8/2010 | Swayze et al. |
| 2010/0210707 A1 | 8/2010 | Li et al. |
| 2010/0210712 A1 | 8/2010 | Hansen et al. |
| 2010/0216238 A1 | 8/2010 | Baker et al. |
| 2010/0247543 A1* | 9/2010 | Maes ............ A61K 31/165 424/139.1 |
| 2010/0256223 A1 | 10/2010 | Moeller et al. |
| 2010/0280100 A1 | 11/2010 | Collard et al. |
| 2010/0286141 A1 | 11/2010 | Durden et al. |
| 2010/0286234 A1 | 11/2010 | Elmen et al. |
| 2010/0298410 A1* | 11/2010 | Obad ............ C12N 15/111 514/44 A |
| 2010/0317606 A1 | 12/2010 | Chan et al. |
| 2011/0039910 A1 | 2/2011 | Crooke et al. |
| 2011/0077286 A1 | 3/2011 | Damha et al. |
| 2011/0086833 A1 | 4/2011 | Paushkin et al. |
| 2011/0150868 A1 | 6/2011 | Yu et al. |
| 2011/0159587 A1 | 6/2011 | Krainer et al. |
| 2011/0172292 A1 | 7/2011 | Hansen et al. |
| 2011/0191912 A1 | 8/2011 | Alexandrov |
| 2011/0207217 A1 | 8/2011 | Corey et al. |
| 2011/0224277 A1 | 9/2011 | Esau et al. |
| 2011/0237606 A1 | 9/2011 | Chai et al. |
| 2011/0237649 A1 | 9/2011 | Collard et al. |
| 2011/0237650 A1 | 9/2011 | Collard et al. |
| 2011/0237651 A1 | 9/2011 | Collard et al. |
| 2011/0251261 A1 | 10/2011 | Burnett et al. |
| 2011/0263687 A1 | 10/2011 | Mattick et al. |
| 2011/0294870 A1 | 12/2011 | Collard et al. |
| 2011/0319283 A1 | 12/2011 | Thompson |
| 2011/0319317 A1 | 12/2011 | Collard et al. |
| 2011/0319475 A1 | 12/2011 | Collard et al. |

(56) References Cited

U.S. PATENT DOCUMENTS

| | | |
|---|---|---|
| 2011/0319476 A1 | 12/2011 | Collard et al. |
| 2012/0004184 A1 | 1/2012 | Collard et al. |
| 2012/0004278 A1 | 1/2012 | Chang et al. |
| 2012/0010156 A1 | 1/2012 | Collard et al. |
| 2012/0046236 A1 | 2/2012 | Collard et al. |
| 2012/0046344 A1 | 2/2012 | Collard et al. |
| 2012/0046345 A1 | 2/2012 | Collard et al. |
| 2012/0064048 A1 | 3/2012 | Collard et al. |
| 2012/0071418 A1 | 3/2012 | Copeland et al. |
| 2012/0083596 A1 | 4/2012 | Elmen et al. |
| 2012/0088817 A1 | 4/2012 | Collard et al. |
| 2012/0094934 A1 | 4/2012 | Collard et al. |
| 2012/0095079 A1 | 4/2012 | Collard et al. |
| 2012/0095081 A1 | 4/2012 | Collard et al. |
| 2012/0129917 A1 | 5/2012 | Collard et al. |
| 2012/0135941 A1 | 5/2012 | Collard et al. |
| 2012/0142610 A1 | 6/2012 | Collard et al. |
| 2012/0142758 A1 | 6/2012 | Collard et al. |
| 2012/0149756 A1 | 6/2012 | Schumperli et al. |
| 2012/0149759 A1 | 6/2012 | Collard et al. |
| 2012/0157333 A1 | 6/2012 | Kauppinen et al. |
| 2012/0171170 A1 | 7/2012 | Collard et al. |
| 2012/0252869 A1 | 10/2012 | Collard et al. |
| 2012/0264812 A1 | 10/2012 | Collard et al. |
| 2012/0277290 A1 | 11/2012 | Collard et al. |
| 2012/0288869 A1 | 11/2012 | Schwartz et al. |
| 2012/0289581 A1 | 11/2012 | Chang et al. |
| 2012/0289583 A1 | 11/2012 | Collard et al. |
| 2012/0295952 A1 | 11/2012 | Collard et al. |
| 2012/0295953 A1 | 11/2012 | Colalrd et al. |
| 2012/0295954 A1 | 11/2012 | Collard et al. |
| 2012/0295959 A1 | 11/2012 | Collard et al. |
| 2012/0309814 A1 | 12/2012 | Collard et al. |
| 2012/0322851 A1 | 12/2012 | Hardee et al. |
| 2012/0322853 A1 | 12/2012 | Collard et al. |
| 2012/0329727 A1 | 12/2012 | Collard et al. |
| 2012/0329855 A1 | 12/2012 | Collar et al. |
| 2013/0035372 A1 | 2/2013 | Collard et al. |
| 2013/0035373 A1 | 2/2013 | Collard et al. |
| 2013/0053428 A1 | 2/2013 | Wahlestedt |
| 2013/0065947 A1 | 3/2013 | Collard et al. |
| 2013/0072421 A1 | 3/2013 | Collard et al. |
| 2013/0072546 A1 | 3/2013 | Collard et al. |
| 2013/0079505 A1 | 3/2013 | Moeller et al. |
| 2013/0085112 A1 | 4/2013 | Collard et al. |
| 2013/0096183 A1 | 4/2013 | Collard et al. |
| 2013/0116300 A1 | 5/2013 | Collard et al. |
| 2013/0137751 A1 | 5/2013 | Collard et al. |
| 2013/0143946 A1 | 6/2013 | Collard et al. |
| 2013/0164846 A1 | 6/2013 | Saestrom |
| 2013/0184325 A9 | 7/2013 | Collard et al. |
| 2013/0210893 A1 | 8/2013 | Collard et al. |
| 2013/0245095 A1 | 9/2013 | Collard et al. |
| 2013/0245099 A1 | 9/2013 | Collard et al. |
| 2013/0253036 A1 | 9/2013 | Collard et al. |
| 2013/0261065 A1 | 10/2013 | Collard et al. |
| 2013/0289092 A1 | 10/2013 | Rigo et al. |
| 2014/0142160 A1 | 5/2014 | Lee et al. |
| 2014/0187606 A1 | 7/2014 | Collard et al. |
| 2014/0356459 A1 | 12/2014 | Oncostamen |
| 2015/0099791 A1 | 4/2015 | Krieg et al. |
| 2015/0133362 A1 | 5/2015 | Krieg et al. |
| 2015/0133528 A1 | 5/2015 | Krieg et al. |
| 2015/0133529 A1 | 5/2015 | Krieg et al. |
| 2015/0141320 A1 | 5/2015 | Krieg et al. |
| 2015/0159160 A1 | 6/2015 | Krieg et al. |
| 2015/0159161 A1 | 6/2015 | Krieg et al. |
| 2015/0191722 A1 | 7/2015 | Krieg et al. |
| 2015/0218560 A1 | 8/2015 | Krieg et al. |
| 2015/0225717 A1 | 8/2015 | Lee et al. |
| 2015/0252364 A1 | 9/2015 | Krieg et al. |
| 2016/0122760 A1 | 5/2016 | Barsoum et al. |
| 2016/0201063 A1 | 7/2016 | Ozsolak |
| 2016/0201064 A1 | 7/2016 | Ozsolak |
| 2016/0222391 A1 | 8/2016 | Krieg et al. |
| 2017/0037396 A1 | 2/2017 | Lee et al. |
| 2018/0298384 A1 | 10/2018 | Krieg et al. |

FOREIGN PATENT DOCUMENTS

| | | |
|---|---|---|
| EP | 1 044 987 A2 | 10/2000 |
| EP | 1 752 536 A1 | 5/2005 |
| EP | 1 695 979 A2 | 8/2006 |
| EP | 1 957 648 B1 | 11/2006 |
| EP | 1 967 525 A2 | 9/2008 |
| EP | 2 021 472 B1 | 6/2011 |
| EP | 2 023 940 B1 | 6/2011 |
| EP | 2 431 467 A2 | 3/2012 |
| EP | 2 431 467 A3 | 5/2012 |
| EP | 2 591 797 A1 | 5/2013 |
| JP | 04-320700 | 11/1992 |
| JP | 3420984 B2 | 6/2003 |
| JP | 2006-522597 | 10/2006 |
| JP | 2008-044958 A | 2/2008 |
| JP | 2009-536037 | 10/2009 |
| JP | 2010-507579 A | 3/2010 |
| JP | 2010-516256 | 5/2010 |
| JP | 11-033863 A | 2/2011 |
| JP | 2015-518714 | 7/2015 |
| KR | 10-2011-0050134 A | 5/2011 |
| WO | WO 89/05358 | 6/1989 |
| WO | WO 1992/00386 A1 | 1/1992 |
| WO | WO 93/13121 A1 | 7/1993 |
| WO | WO 94/02499 A1 | 2/1994 |
| WO | WO 94/17093 A1 | 8/1994 |
| WO | WO 1995/33852 A1 | 12/1995 |
| WO | WO 2000/020645 A2 | 4/2000 |
| WO | WO 2001/07662 A1 | 2/2001 |
| WO | WO 01/36627 A2 | 5/2001 |
| WO | WO 2001/066129 A1 | 9/2001 |
| WO | WO 2001/072765 A1 | 10/2001 |
| WO | WO 2001/090341 A1 | 11/2001 |
| WO | WO 2002/022635 A1 | 3/2002 |
| WO | WO 2002/038738 A1 | 5/2002 |
| WO | WO 02/103015 A2 | 12/2002 |
| WO | WO 2004/011613 A2 | 2/2004 |
| WO | WO 2004/092356 A2 | 10/2004 |
| WO | WO 2004/099382 A2 | 11/2004 |
| WO | WO 2004/113867 A2 | 12/2004 |
| WO | WO 2005/013901 A2 | 2/2005 |
| WO | WO 2005/042018 A2 | 5/2005 |
| WO | WO 2005/044981 A2 | 5/2005 |
| WO | WO 2005/061710 A2 | 7/2005 |
| WO | WO 2005/089169 A2 | 9/2005 |
| WO | WO 2005/094370 A2 | 10/2005 |
| WO | WO 2006/063356 A1 | 6/2006 |
| WO | WO 2006/069584 A2 | 7/2006 |
| WO | WO 2006/130201 A1 | 12/2006 |
| WO | WO 2007/002390 A2 | 1/2007 |
| WO | WO 2007/004977 A1 | 1/2007 |
| WO | WO 2007/031091 A2 | 3/2007 |
| WO | WO 2007/076328 A2 | 7/2007 |
| WO | WO 2007/086990 A2 | 8/2007 |
| WO | WO 2007/086990 A3 | 8/2007 |
| WO | WO 2007/112753 A2 | 10/2007 |
| WO | WO 2007/112754 A2 | 10/2007 |
| WO | WO 2007/115578 A1 | 10/2007 |
| WO | WO 2007/131237 A2 | 11/2007 |
| WO | WO 2007/133812 A2 | 11/2007 |
| WO | WO 2008/024499 A2 | 2/2008 |
| WO | WO 2008/025069 A1 | 3/2008 |
| WO | WO 2008/029619 A1 | 3/2008 |
| WO | WO 2008/061537 A2 | 5/2008 |
| WO | WO 2008/103761 A2 | 8/2008 |
| WO | WO 2008/103763 A2 | 8/2008 |
| WO | WO 2008/113832 A2 | 9/2008 |
| WO | WO 2008/132234 A2 | 11/2008 |
| WO | WO 2008/138904 A2 | 11/2008 |
| WO | WO 2008/141282 A2 | 11/2008 |
| WO | WO 2009/043353 A2 | 4/2009 |
| WO | WO 2009/044383 A1 | 4/2009 |
| WO | WO 2009/046397 A2 | 4/2009 |
| WO | WO 2009/061851 A2 | 5/2009 |

(56) References Cited

FOREIGN PATENT DOCUMENTS

| WO | WO 2009/064920 A2 | 5/2009 |
|---|---|---|
| WO | WO 2009/090182 A1 | 7/2009 |
| WO | WO 2009/124341 A1 | 10/2009 |
| WO | WO 2009/127680 A1 | 10/2009 |
| WO | WO 2009/134710 A2 | 11/2009 |
| WO | WO 2009/149182 A1 | 12/2009 |
| WO | WO 2009/151546 A2 | 12/2009 |
| WO | WO 2010/000665 A1 | 1/2010 |
| WO | WO 2010/007522 A1 | 1/2010 |
| WO | WO 2010/014592 A1 | 2/2010 |
| WO | WO 2010/040112 A2 | 4/2010 |
| WO | WO 2010/065671 A2 | 6/2010 |
| WO | WO 2010/065787 A2 | 6/2010 |
| WO | WO 2010/076248 A1 | 7/2010 |
| WO | WO 2010/083615 A1 | 7/2010 |
| WO | WO 2010/093860 A2 | 8/2010 |
| WO | WO 2010/093904 A2 | 8/2010 |
| WO | WO 2010/102058 A2 | 9/2010 |
| WO | WO 2010/107733 A2 | 9/2010 |
| WO | WO 2010/122538 A1 | 10/2010 |
| WO | WO 2010/124231 A2 | 10/2010 |
| WO | WO 2010/129746 A2 | 11/2010 |
| WO | WO 2010/129799 A2 | 11/2010 |
| WO | WO 2010/129861 A2 | 11/2010 |
| WO | WO 2010/135329 A2 | 11/2010 |
| WO | WO 2010/135695 A2 | 11/2010 |
| WO | WO 2010/138806 A2 | 12/2010 |
| WO | WO 2010/148050 A2 | 12/2010 |
| WO | WO 2010/148065 A2 | 12/2010 |
| WO | WO 2010/151671 A2 | 12/2010 |
| WO | WO 2010/151674 A2 | 12/2010 |
| WO | WO 2011/005786 A2 | 1/2011 |
| WO | WO 2011/009624 A1 | 1/2011 |
| WO | WO 2011/010706 A1 | 1/2011 |
| WO | WO 2011/017516 A2 | 2/2011 |
| WO | WO 2011/019815 A2 | 2/2011 |
| WO | WO 2011/022606 A2 | 2/2011 |
| WO | WO 2011/025862 A2 | 3/2011 |
| WO | WO 2011/031482 A2 | 3/2011 |
| WO | WO 2011/032109 A1 | 3/2011 |
| WO | WO 2011/038205 A2 | 3/2011 |
| WO | WO 2011/038210 A2 | 3/2011 |
| WO | WO 2011/048125 A1 | 4/2011 |
| WO | WO 2011/079261 A2 | 6/2011 |
| WO | WO 2011/079263 A2 | 6/2011 |
| WO | WO 2011/082409 A2 | 7/2011 |
| WO | WO 2011/084455 A2 | 7/2011 |
| WO | WO 2011/085066 A2 | 7/2011 |
| WO | WO 2011/097388 A1 | 8/2011 |
| WO | WO 2011/097582 A2 | 8/2011 |
| WO | WO 2011/097641 A1 | 8/2011 |
| WO | WO 2011/123745 A2 | 10/2011 |
| WO | WO 2011/139387 A1 | 11/2011 |
| WO | WO 2011/139917 A1 | 11/2011 |
| WO | WO 2011/146674 A2 | 11/2011 |
| WO | WO 2011/146675 A2 | 11/2011 |
| WO | WO 2011/150005 A2 | 12/2011 |
| WO | WO 2011/159836 A2 | 12/2011 |
| WO | WO 2011/161460 A2 | 12/2011 |
| WO | WO 2011/163499 A2 | 12/2011 |
| WO | WO 2012/009347 A2 | 1/2012 |
| WO | WO 2012/009402 A2 | 1/2012 |
| WO | WO 2012/012467 A2 | 1/2012 |
| WO | WO 2012/018881 A2 | 2/2012 |
| WO | WO 2012/024478 A2 | 2/2012 |
| WO | WO 2012/027033 A1 | 3/2012 |
| WO | WO 2012/036433 A2 | 3/2012 |
| WO | WO 2012/047956 A2 | 4/2012 |
| WO | WO 2012/054723 A2 | 4/2012 |
| WO | WO 2012/058268 A2 | 5/2012 |
| WO | WO 2012/064806 A2 | 5/2012 |
| WO | WO 2012/065143 A1 | 5/2012 |
| WO | WO 2012/068340 A2 | 5/2012 |
| WO | WO 2012/071238 A2 | 5/2012 |
| WO | WO 2012/087983 A1 | 6/2012 |
| WO | WO 2012/109476 A2 | 8/2012 |
| WO | WO 2012/144220 A1 | 10/2012 |
| WO | WO 2012/170771 A1 | 12/2012 |
| WO | WO 2013/006619 A1 | 1/2013 |
| WO | WO 2013/036403 A1 | 3/2013 |
| WO | WO 2013/040429 A1 | 3/2013 |
| WO | WO 2013/124807 A2 | 8/2013 |
| WO | WO 2013/138374 A2 | 9/2013 |
| WO | WO 2013/173598 A1 | 11/2013 |
| WO | WO 2013/173599 A1 | 11/2013 |
| WO | WO 2013/173601 A1 | 11/2013 |
| WO | WO 2013/173605 A1 | 11/2013 |
| WO | WO 2013/173608 A1 | 11/2013 |
| WO | WO 2013/173635 A1 | 11/2013 |
| WO | WO 2013/173637 A1 | 11/2013 |
| WO | WO 2013/173638 A1 | 11/2013 |
| WO | WO 2013/173645 A1 | 11/2013 |
| WO | WO 2013/173647 A1 | 11/2013 |
| WO | WO 2013/173652 A1 | 11/2013 |
| WO | WO 2014/043544 A1 | 3/2014 |
| WO | WO 2014/076195 A1 | 5/2014 |
| WO | WO 2014/172698 A1 | 10/2014 |
| WO | WO 2014/197826 A1 | 12/2014 |
| WO | WO 2014/203518 A1 | 12/2014 |
| WO | WO 2014/205551 A1 | 12/2014 |
| WO | WO 2015/035476 A1 | 3/2015 |
| WO | WO 2016/077837 A1 | 5/2016 |

OTHER PUBLICATIONS

[No Author Listed] Designing Antisense Oligonucleotides. Integrated DNA Technologies. Jan. 16, 2011.

[No Author Listed] Locked Nucleic Acid. Exiqon. 2009. Retrieved from http://www.exiqon.com/ls/documents/scientific/lna_folder.pdf on Jun. 6, 2016.

[No Author Listed] ncRNA. 2011;29(11):1716-1721.

[No Author Listed] UCSC Genome Browser on Human Feb. 2009 (GRCh37/hg19) Assembly. Retrieved from http://genome.ucsc.edu/cgi-bin/hgTracks?db=hgl 9&position=chr5%3A 702 11 956-7027 1 955&hgsid=452570083_sxavccF IdzrwhzM3tcNOyMcxbye 7 on Nov. 9, 2015.

[No Author Listed], Geneimprint. 2012. http://www.geneimprint.com/site/about-this-site [last accessed May 22, 2015]. 1 page.

[No Author Listed], Imprinted gene. Mosby's Dictionary of Medicine, Nursing and Health Professions. 8th ed. 2009;949.

[No Author Listed], New England BioLabs 1998/99 Catalog. 121, 284.

Aartsma-Rus et al., Antisense-induced multiexon skipping for Duchenne muscular dystrophy makes more sense. Am J Hum Genet. Jan. 2004;74(1):83-92.

Ahn et al., Retinoic acid accelerates downregulation of the Xist repressor, Oct. 4, and increases the likelihood of Xist activation when Tsix is deficient. BMC Develop Biol. 2010;10:90. 14 pages.

Alvarez-Salas, Nucleic acids as therapeutic agents. Curr Top Med Chem. 2008;8(15):1379-404.

Arvey et al., Inflammation-induced repression of chromatin bound by the transcription factor Foxp3 in regulatory T cells. Nat Immunol. Jun. 2014;15(6):580-587. doi: 10.1038/ni.2868. Epub Apr. 13, 2014.

Astuti et al., Epigenetic alteration at the DLK1-GTL2 imprinted domain in human neoplasia: analysis of neuroblastoma, phaeochromocytoma and Wilms' tumour. Br J Cancer. Apr. 25, 2005;92(8):1574-80.

Bauer et al., The quest for mammalian Polycomb response elements: are we there yet? Chromosoma. Jun. 2016;125(3):471-96. doi:10.1007/s00412-015-0539-4.

Behlke et al., Designing antisense oligonucleotides. Integrated DNA Technologies. 2005. 1-17.

Beletskii et al., PNA interference mapping demonstrates functional domains in the noncoding RNA Xist. Proc Natl Acad Sci U S A. Jul. 31, 2001;98(16):9215-20.

Beltran et al., The interaction of PRC2 with RNA or chromatin is mutually antagonistic. Genome Res. Jul. 2016;26(7):896-907. doi:10.1101/gr.197632.115. Epub May 9, 2016.

(56) References Cited

OTHER PUBLICATIONS

Bernardi et al., Structure, dynamics and functions of promyelocytic leukaemia nuclear bodies. Nat Rev Mol Cell Biol. Dec. 2007;8(12):1006-16. Review.
Bernstein et al., Mouse polycomb proteins bind differentially to methylated histone H3 and RNA and are enriched in facultative heterochromatin. Mol Cell Biol. Apr. 2006;26(7):2560-9.
Bernstein et al., RNA meets chromatin. Genes Dev. Jul. 15, 2005;19(14):1635-55. Review.
Boyer et al., Polycomb complexes repress developmental regulators in murine embryonic stem cells. Nature. May 18, 2006;441(7091):349-53. Epub Apr. 19, 2006.
Braasch et al., Locked nucleic acid (LNA): fine-tuning the recognition of DNA and RNA. Chem Biol. Jan. 2001;8(1):1-7.
Brockdorff et al., The product of the mouse Xist gene is a 15 kb inactive X-specific transcript containing no conserved ORF and located in the nucleus. Cell. Oct. 30, 1992;71(3):515-26.
Broderick et al., MicroRNA therapeutics. Gene Ther. Dec. 2011;18(12):1104-10. doi: 10.1038/gt.2011.50. Epub Apr. 28, 2011.
Brown et al., A gene from the region of the human X inactivation centre is expressed exclusively from the inactive X chromosome. Nature. Jan. 3, 1991;349:38-44.
Brown et al., The Human *XIST* Gene: Analysis of a 17 kb Inactive X-Specific RNA That Contains Conserved Repeats and Is Highly Localized within the Nucleus. Cell. Oct. 30, 1992;71:527-42.
Buck et al., Design strategies and performance of custom DNA sequencing primers. Biotechniques. Sep. 1999;27(3):528-36.
Cantàfora et al., Evaluation of RNA messengers involved in lipid trafficking of human intestinal cells by reverse-transcription polymerase chain reaction with competimer technology and microchip electrophoresis. Electrophoresis. Nov. 2003;24(21):3748-54.
Carninci et al., The transcriptional landscape of the mammalian genome. Science. Sep. 2, 2005;309(5740):1559-63.
Chahrour et al., MeCP2, a key contributor to neurological disease, activates and represses transcription. Science. May 30, 2008;320(5880):1224-9.
Chen et al., Decoding the function of nuclear long non-coding RNAs. Curr Opin Cell Biol. Jun. 2010;22(3):357-64. doi: 10.1016/j.ceb.2010.03.003. Epub Mar. 29, 2010. Review.
Chow et al., Inducible XIST-dependent X-chromosome inactivation in human somatic cells is reversible. Proc Natl Acad Sci U S A. Jun. 12, 2007;104(24):10104-9. Epub May 30, 2007.
Clark et al., The Reality of Pervasive Transcription. PLOS Bio. Jul. 2011;9(7):e1000625. 6 pages.
Clemson et al., XIST RNA paints the inactive X chromosome at interphase: evidence for a novel RNA involved in nuclear/chromosome structure. J Cell Biol. Feb. 1996;132(3):259-75.
Cohen et al., X-chromosome inactivation and the search for chromosome-wide silencers. Curr Opin Genet Dev. 2002;12:219-24.
Coombes et al., Epigenetic properties and identification of an imprint mark in the Nesp-Gnasxl domain of the mouse Gnas imprinted locus. Mol Cell Biol. Aug. 2003;23(16):5475-88.
Core et al., Nascent RNA sequencing reveals widespread pausing and divergent initiation at human promoters. Science. Dec. 19, 2008;322(5909):1845-8. doi: 10.1126/science.1162228. Epub Dec. 4, 2008.
Costa, Non-coding RNAs: new players in eukaryotic biology. Gene. Sep. 12, 2005;357(2):83-94. Review.
Crea et al., Pharmacologic disruption of Polycomb Repressive Complex 2 inhibits tumorigenicity and tumor progression in prostate cancer. Mol Cancer. Apr. 18, 2011;10:40. doi: 10.1186/14764598-10-40.
Crooke et al., Kinetic characteristics of *Escherichia coli* RNase H1: cleavage of various antisense oligonucleotide-RNA duplexes. Biochem J. Dec. 1, 1995;312 ( Pt 2):599-608.
Cuddapah et al., A novel human polycomb binding site acts as a functional polycomb response element in Drosophila. PLoS One. 2012;7(5):e36365. doi: 10.1371/journal.pone.0036365. Epub May 3, 2012.
Cushman et al., Synthesis of the covalent hydrate of the incorrectly assumed structure of aurintricarboxylic acid (ATA). Tetrahedron. 1990;46(5):1491-1498.
Davidovich et al., The recruitment of chromatin modifiers by long noncoding RNAs: lessons from PRC2. RNA. Dec. 2015;21(12):2007-22. doi:10.1261/rna.053918.115.
Davidovich et al., Toward a consensus on the binding specificity and promiscuity of PRC2 for RN. Mol Cell. Feb. 5, 2015;57(3):552-8. doi: 10.1016/j.molcel.2014.12.017. Epub Jan. 15, 2015.
Davidson et al., Singles engage the RNA interference pathway. Cell. Aug. 31, 2012;150(5):8735. doi: 10.1016/j.cell.2012.08.008.
Denisenko et al., Point mutations in the WD40 domain of Eed block its interaction with Ezh2. Mol Cell Biol. Oct. 1998;18(10):5634-42.
Dheda et al., Validation of housekeeping genes for normalizing RNA expression in real-time PCR. Biotechniques. Jul. 2004;37(1):112-4, 116, 118-9.
Di Certo et al., The artificial gene Jazz, a transcriptional regulator of utrophin, corrects the dystrophic pathology in mdx mice. Hum Mol Genet. Mar. 1, 2010;19(5):752-60. doi: 10.1093/hmg/ddp539. Epub Dec. 4, 2009.
Dias et al., Antisense oligonucleotides: basic concepts and mechanisms. Mol Cancer Ther. Mar. 2002;1 (5): 347-55.
Dinger et al., NRED: a database of long noncoding RNA expression. Nucleic Acids Res. Jan. 2009;37(Database issue):D122-6. doi: 10.1093/nar/gkn617. Epub Oct. 1, 2008.
Duthie et al., Xist RNA exhibits a banded localization on the inactive X chromosome and is excluded from autosomal material in cis. Hum Mol Genet. Feb. 1999;8(2):195-204.
Ebralidze et al., PU.1 expression is modulated by the balance of functional sense and antisense RNAs regulated by a shared cis-regulatory element. Genes Dev. Aug. 1, 2008;22(15):2085-92. doi:10.1101/gad.1654808. Supplemental Data.
Eddy, Non-coding RNA genes and the modern RNA world. Nat Rev Genet. Dec. 2001;2(12):919-29.
Edwards et al., Mechanisms regulating imprinted genes in clusters. Curr Opin Cell Biol. Jun. 2007;19(3):281-9. Review.
Efthymiou, T. et al., Chemical architecture and applications of nucleic acid derivatives containing 1, 2, 3-triazole functionalities synthesized via click chemistry, Molecules, 2012, vol. 17, No. 11, pp. 12665-12703.
Engström et al., Complex Loci in human and mouse genomes. PLoS Genet. Apr. 2006;2(4):e47. Epub Apr. 28, 2006.
Faghihi et al., Expression of a noncoding RNA is elevated in Alzheimer's disease and drives rapid feed-forward regulation of [beta]-secretase. Nat Med. Jul. 2008;14(7):723-30. doi:10.1038/nm1784. Epub Feb. 23, 2010. 19 pages.
Fish et al., Hypoxia-inducible expression of a natural cis-antisense transcript inhibits endothelial nitric-oxide synthase. J Biol Chem. May 25, 2007;282(21):15652-66. Epub Apr. 2, 2007.
Francis et al., Reconstitution of a functional core polycomb repressive complex. Mol Cell. Sep. 2001;8(3):545-56.
Frieden et al., Expanding the design horizon of antisense oligonucleotides with alpha-L-LNA. Nucleic Acids Res. Nov. 1, 2003;31(21):6365-72.
Froberg et al., Guided by RNAs: X-inactivation as a model for lncRNA function. J Mol Biol. Oct. 9, 2013;425(19):3698-706. doi: 10.1016/j.jmb.2013.06.031. Epub Jun. 28, 2013. Review. 15 pages.
Fu et al., Mir-144 selectively regulates embryonic alpha-hemoglobin synthesis during primitive erythropoiesis. Blood. Feb. 5, 2009;113(6):1340-9.
Gajera et al., Molecular and biochemical characterization of Trichoderma isolates inhibiting a phytopathogenic fungi Aspergillus niger Van Tieghem. Phys Mol Plant Path. 2010;74:274-282.
Ganguli et al., Antagomirbase—a putative antagomir database. Bioinformation. 2011;7(1):41-3.
Genbank Submission; Accession No. AM750048. Gupta et al. Jul. 12, 2007.
Genbank Submission; NCBI, Accession No. AM911724.1; Talwar et al. Nov. 26, 2007.
Genbank Submission; NCBI, Accession No. NM_022876.2. Apr. 2010. 5 pages.
Genbank Submission; NIH/NCBI, Accession No. AL137002. Holt, Dec. 13, 2012. 29 pages.

(56) References Cited

OTHER PUBLICATIONS

Genbank Submission; NIH/NCBI, Accession No. BX383579. Li et al., Dec. 23, 2010. 1 page.
Genbank Submission; NIH/NCBI, Accession No. NM_001079668. Young et al., Jan. 18, 2014. 4 pages.
Genbank Submission; NIH/NCBI, Accession No. NM_003317. Young et al., Jan. 18, 2014. 4 pages.
Genbank Submission; NIH/NCBI, Accession No. NM_028475. Diez-Roux et al., Feb. 3, 2014. 6 pages.
Golding et al., Depletion of *Kcnq1ot1* non-coding RNA does not affect imprinting maintenance in stem cells. Development. 2011;138:3667-8. doi:10.1242/dev.057778.
Gontan et al., Long Noncoding RNAs and X Chromosome Inactivation. Prog Mol Subcell Biol. 2011;51:43-64. doi: 10.1007/978-3-642-16502-3_3.
Gooding, M. et al., Oligonucleotide conjugates-Candidates for gene silencing therapeutics. European Journal of Pharmaceutics andBiopharmaceutics, 2016, vol. 107, pp. 321-340, [Epub.]Aug. 10, 2016.
Guo et al., High resolution genome wide binding event finding and motif discovery reveals transcription factor spatial binding constraints. PLoS Comput Biol. 2012;8(8):e1002638. doi: 10.1371/journal.pcbi.1002638. Epub Aug. 9, 2012.
Gupta et al., Long non-coding RNA HOTAIR reprograms chromatin state to promote cancer metastasis. Nature. Apr. 15, 2010;464(7291):1071-6. doi: 10.1038/nature08975. E-pub version.
Guttman et al., Chromatin signature reveals over a thousand highly conserved large non-coding RNAs in mammals. Nature. Mar. 12, 2009;458(7235):223-7. doi: 10.1038/nature07672. Epub Sep. 30, 2009. 13 pages.
Guttman et al., Modular regulatory principles of large non-coding RNAs. Nature. Feb. 15, 2012;482(7385):339-46. Review.
Halley et al., Natural antisense transcripts as therapeutic targets. Drug Discov Today Ther Strateg. 2013 Fall;10(3):e119-e125.
He et al., Polycomb repressive complex 2 regulates normal development of the mouse heart. Circ Res. Feb. 3, 2012;110(3):406-15. doi: 10.1161/CIRCRESAHA.111.252205. Epub Dec. 8, 2011.
He, K. et al., Conjugation and Evaluation of Triazole-Linked Single Guide RNA for CRISPR-Cas9 Gene Editing, ChemBioChem, 2016, vol. 17, pp. 1809-1812.
Hendrich et al., Evolutionary conservation of possible functional domains of the human and murine XIST genes. Human Molec Gen. 1993;2(6):663-72.
Hernandez et al., Degradation of nuclease-stabilized RNA oligonucleotides in Mycoplasma-contaminated cell culture media. Nucleic Acid Ther. Feb. 2012;22(1):58-68. doi: 10.1089/nat.2011.0316. Epub Jan. 9, 2012.
Horike et al., Targeted disruption of the human LIT1 locus defines a putative imprinting control element playing an essential role in Beckwith-Wiedemann syndrome. Hum Mol Genet. Sep. 1, 2000;9(14):2075-83.
Inesi et al., Studies of Ca2+ ATPase (SERCA) inhibition. J Bioenerg Biomembr. Dec. 2005;37(6):365-8. Review.
Inoue et al., Synthesis and hybridization studies on two complementary nona(2'-O-methyl)ribonucleotides. Nucleic Acids Res. Aug. 11, 1987;15(15):6131-48.
Inouye, Antisense RNA: its functions and applications in gene regulation—A review. Gene. Dec. 10, 1988;72(1-2):25-34.
Jackson et al., Expression profiling reveals off-target gene regulation by RNAi. Nat Biotechnol. Jun. 2003;21(6):635-7. Epub May 18, 2003.
Jayaprakash, K. N. et al., Non-nucleoside building blocks for copper-assisted and copper-free click chemistry for the efficient synthesis of RNA conjugates. Organic Letters, 2010, vol. 12, No. 23,pp. 5410-5413.
Jeon et al., YY1 tethers Xist RNA to the inactive X nucleation center. Cell. Jul. 8, 2011;146(1):119-33. doi: 10.1016/j.cell.2011.06.026.
Jepsen et al., Locked nucleic acid: a potent nucleic acid analog in therapeutics and biotechnology. Oligonucleotides. 2004;14(2):130-46. Review.
Jia et al., Genome-wide computational identification and manual annotation of human long noncoding RNA genes. RNA. Aug. 2010;16(8):1478-87. doi: 10.1261/rna.1951310. Epub Jun. 29, 2010.
Johansson et al., Target-specific arrest of mRNAtranslation by antisense 2'-O-alkyloligoribonucleotides. Nucleic Acids Res. Nov. 11, 1994;22(22):4591-8.
Johnson, Long non-coding RNAs in Huntington's disease neurodegeneration. Neurobiol Dis. 2012;46:245-54.
Kanduri et al., The length of the transcript encoded from the *Kcnq1ot1* antisense promoter determines the degree of silencing. EMBO J. 2006;25:2096-106.
Kanhere et al., Short RNAs are transcribed from repressed polycomb target genes and interact with polycomb repressive complex-2. Mol Cell. Jun. 11, 2010;38(5):675-88. doi: 10.1016/j.molcel.2010.03.019.
Kao et al., Tumor necrosis factor-alpha decreases sarcoplasmic reticulum Ca2+-ATPase expressions via the promoter methylation in cardiomyocytes. Crit Care Med. Jan. 2010;38(1):217-22. doi: 10.1097/CCM.0b013e3181b4a854.
Kapranov et al., Genome-wide transcription and the implications for genomic organization. Nat Rev Genet. Jun. 2007;8(6):413-23.
Kapranov et al., RNA maps reveal new RNA classes and a possible function for pervasive transcription. Science. Jun. 8, 2007;316(5830):1484-8.
Khalil et al., Many human large intergenic noncoding RNAs associate with chromatin-modifying complexes and affect gene expression. Proc Natl Acad Sci U S A. Jul. 14, 2009;106(28):11667-72.
Kierzek et al., The influence of locked nucleic acid residues on the thermodynamic properties of 2'-O-methyl RNA/RNA heteroduplexes. Nucleic Acids Res. Sep. 9, 2005;33(16):5082-93. Print 2005.
Kim et al., Identification of clustered YY1 binding sites in imprinting control regions. Genome Res. Jul. 2006;16(7):901-11. Epub Jun. 7, 2006.
Kiss, Small nucleolar RNA-guided post-transcriptional modification of cellular RNAs. EMBO J. Jul. 16, 2001;20(14):3617-22.
Klein et al., Homeostatic regulation of MeCP2 expression by a CREB-induced microRNA. Nat Neurosci. Dec. 2007;10(12):1513-4.
Krützfeldt et al., Silencing of microRNAs in vivo with 'antagomirs'. Nature. Dec. 1, 2005;438(7068):685-9. Epub Oct. 30, 2005.
Ku et al., Genomewide analysis of PRC1 and PRC2 occupancy identifies two classes of bivalent domains. PLoS Genet. Oct. 2008;4(10):e1000242. doi: 10.1371/journal.pgen.1000242. Epub Oct. 31, 2008. 14 pages.
Kutyavin et al., Reduced aggregation and improved specificity of G-rich oligodeoxyribonucleotides containing pyrazolo[3,4-d]pyrimidine guanine bases. Nucleic Acids Res. Nov. 15, 2002;30(22):4952-9.
Lapointe et al., Gene expression profiling identifies clinically relevant subtypes of prostate cancer. Proc Natl Acad Sci U S A. Jan. 20, 2004;101(3):811-6. Epub Jan. 7, 2004.
Lee et al., A 450 kb Transgene Displays Properties of the Mammalian X-Inactivation Center. Cell. Jul. 12, 1996;86:83-94.
Lee et al., Control of developmental regulators by Polycomb in human embryonic stem cells. Cell. Apr. 21, 2006;125(2):301-13.
Lee et al., Genetic analysis of the mouse X inactivation center defines an 80-kb multifunction domain. Proc Natl Acad Sci U S A. Mar. 30, 1999;96(7):3836-41.
Lee et al., Targeted Mutagenesis of Tsix Leads to Nonrandom X Inactivation. Cell. Oct. 1, 1999;99:47-57.
Lee et al., *Tsix*, a gene antisense to *Xist* at the X-inactivation centre. Nat Genet. Apr. 1999;21:400-4.
Lee, Disruption of Imprinted X Inactivation by Parent-of-Origin Effects at *Tsix*. Cell. Sep. 29, 2000;103:17-27.
Lee, Epigenetic regulation by long noncoding RNAs. Science. Dec. 14, 2012;338(6113):1435-9. Review.
Lee, Homozygous *Tsix* mutant mice reveal a sex-ratio distortion and revert to random X-inactivation. Nat Genet. Sep. 2002;32:195-200.

(56) References Cited

OTHER PUBLICATIONS

Lee, Lessons from X-chromosome inactivation: long ncRNA as guides and tethers to the epigenome. Genes Dev. Aug. 15, 2009;23(16):1831-42. doi: 10.1101/gad.1811209.
Lee, The X as a Model for Rna's Niche in Epigenomic Regulation. Cold Spring Harb Perspect Biol. 2010;2:A003749. 12 pages.
Lennox et al., Improved Performance of Anti-miRNA Oligonucleotides Using a Novel Non-Nucleotide Modifier. Mol Ther Nucleic Acids. Aug. 27, 2013;2:e117. doi: 10.1038/mtna.2013.46.
Li et al., CTCF regulates allelic expression of Igf2 by orchestrating a promoter-polycomb repressive complex 2 intrachromosomal loop. Mol Cell Biol. Oct. 2008;28(20):6473-82. doi: 10.1128/MCB.00204-08. Epub Jul. 28, 2008.
Li et al., Jarid2 and PRC2, partners in regulating gene expression. Genes Dev. Feb. 15, 2010;24(4):368-80. doi: 10.1101/gad.1886410. Epub Feb. 1, 2010.
Lima et al., Single-stranded siRNAs activate RNAi in animals. Cell. Aug. 31, 2012;150(5):883-94. doi: 10.1016/j.cell.2012.08.014.
Lin et al., An in-depth map of polyadenylation sites in cancer. Nucleic Acids Res. Sep. 1, 2012;40(17):8460-71. Epub Jun. 29, 2012.
Lin et al., Asymmetric regulation of imprinting on the maternal and paternal chromosomes at the Dlk1-Gtl2 imprinted cluster on mouse chromosome 12. Nat Genet. Sep. 2003;35(1):97-102. Epub Aug. 24, 2003.
Lipovich et al., MacroRNA underdogs in a microRNA world: evolutionary, regulatory, and biomedical significance of mammalian long non-protein-coding RNA. Biochim Biophys Acta. Sep. 2010;1799(9):597-615. Review.
Margueron et al., The Polycomb complex PRC2 and its mark in life. Nature. Jan. 20, 2011;469(7330):343-9. Review.
Matsuda, S. et al., siRNA conjugates carrying sequentially assembled trivalent N-acetylgalactosamine linked through nucleosides elicit robust gene silencing in vivo in hepatocytes., ACS Chemical Biology, 2015, vol. 10, pp. 1181-1187.
Mencía et al., Mutations in the seed region of human miR-96 are responsible for nonsyndromic progressive hearing loss. Nat Genet. May 2009;41(5):609-13. doi: 10.1038/ng.355. Epub Apr. 12, 2009.
Mendenhall et al., GC-rich sequence elements recruit PRC2 in mammalian ES cells. PLoS Genet. Dec. 9, 2010;6(12):e1001244. doi: 10.1371/journal.pgen.1001244.
Mercer et al., Long non-coding RNAs: insights into functions. Nat Rev Genet. Mar. 2009;10(3):155-9. Review.
Merienne et al., SCA8 CAG/CTG expansions, a tale of two TOXICities: a unique or common case? PLoS Genet. Aug. 2009;5(8):e1000593. doi: 10.1371/journal.pgen.1000593. Epub Aug. 14, 2009.
Miremadi et al., Cancer genetics of epigenetic genes. Hum Mol Genet. Apr. 15, 2007;16 Spec No. 1:R28-49. Review.
Mirguet et al., From ApoA1 upregulation to BET family bromodomain inhibition:discovery of I-BET151. Bioorg Med Chem Lett. Apr. 15, 2012;22(8):2963-7. doi:10.1016/j.bmcl.2012.01.125. Epub Feb. 8, 2012.
Miura et al., Utrophin upregulation for treating Duchenne or Becker muscular dystrophy: how close are we? Trends Mol Med. Mar. 2006;12(3):122-9. Epub Jan. 27, 2006.
Modarresi et al., Natural Antisense Inhibition Results in Transcriptional De-Repression and Gene Upregulation. Nat Biotechnol. Mar. 25, 2012;30(5):453-9. doi: 10.1038/nbt.2158. 21 pages.
Montgomery et al., The murine polycomb group protein Eed is required for global histone H3 lysine-27 methylation. Curr Biol. May 24, 2005;15(10):942-7.
Morris et al., Small interfering RNA-induced transcriptional gene silencing in human cells. Science. Aug. 27, 2004;305(5688):1289-92. Epub Aug. 5, 2004.
Morris, RNA-mediated transcriptional gene silencing in human cells. Curr Top Microbiol Immunol. 2008;320:211-24. Review.
Morse et al., Depleting regulatory T cells with arginine-rich, cell-penetrating, peptide-conjugated morpholino oligomer targeting FOXP3 inhibits regulatory T-cell function. Cancer Gene Ther. Jan. 2012;19(1):30-7. doi: 10.1038/cgt.2011.63.
Munroe, Antisense RNA inhibits splicing of pre-mRNA in vitro. EMBO J. Aug. 1998; 7(8): 2523-32.
Nagano et al., The Air noncoding RNA epigenetically silences transcription by targeting G9a to chromatin. Science. Dec. 12, 2008;322(5908):1717-20.
Nair, J. K. et al., Multivalent N-acetylgalactosamine-conjugated siRNA localizes in hepatocytes and elicits robust RNAi-mediated gene silencing, Journal of the American Chemical Society, 2014, vol. 136, pp. 16958-16961.
Nakao, Gene Cluster control through epigenetic mechanisms and cytopathology. Uehara memorial life science foundation research report collection. 23;2009:1-4.
Nie et al., Long non-coding RNAs: versatile master regulators of gene expression and crucial players in cancer. Am J Transl Res. 2012;4(2):127-50. Epub Apr. 8, 2012.
Nishida et al., Synthesis, RNA selective hybridization and high nuclease resistance of an oligonucleotide containing novel bridged nucleic acid with cyclic urea structure. Chem Commun (Camb). Aug. 7, 2010;46(29):5283-5. doi: 10.1039/c0cc00154f. Epub Jun. 22, 2010.
Numata et al., Comparative analysis of cis-encoded antisense RNAs in eukaryotes. Gene. May 1, 2007;392(1-2):134-41.
Numata et al., Identification of novel endogenous antisense transcripts by DNA microarray analysis targeting complementary strand of annotated genes. BMC Genomics. Aug. 22, 2009;10:392. doi: 10.1186/1471-2164-10-392.
Okada et al., Comparative expression analysis uncovers novel features of endogenous antisense transcription. Hum Mol Genet. Jun. 1, 2008;17(11):1631-40. doi: 10.1093/hmg/ddn051. Epub Feb. 18, 2008.
Ørom et al., LNA-modified oligonucleotides mediate specific inhibition of microRNA function. Gene. May 10, 2006;372:137-41. Epub Feb. 24, 2006.
Ozsolak et al., Comprehensive polyadenylation site maps in yeast and human reveal pervasive alternative polyadenylation. Cell. Dec. 10, 2010;143(6):1018-29. doi: 10.1016/j.cell.2010.11.020.
Pandey et al., Kcnq1ot1 antisense noncoding RNA mediates lineage-specific transcriptional silencing through chromatin-level regulation. Mol Cell. Oct. 24, 2008;32(2):232-46. doi: 10.1016/j.molcel.2008.08.022.
Paro et al., Extending the frontiers of epigenetic regulation. Curr Opin Genet Dev. Apr. 2010;20(2):107-9. doi: 10.1016/j.gde.2010.03.011.
Pasini et al., Suz12 is essential for mouse development and for EZH2 histone methyltransferase activity. EMBO J. Oct. 13, 2004;23(20):4061-71. Epub Sep. 23, 2004.
Peng et al., Jarid2/Jumonji coordinates control of PRC2 enzymatic activity and target gene occupancy in pluripotent cells. Cell. Dec. 24, 2009;139(7):1290-302. doi: 10.1016/j.cell.2009.12.002. Epub Jul. 29, 2010. 24 pages.
Penny et al., Requirement for Xist in X chromosome inactivation. Nature. Jan. 11, 1996;379(6561):131-7.
Pereira et al., Ezh2, the histone methyltransferase of PRC2, regulates the balance between self-renewal and differentiation in the cerebral cortex. Proc Natl Acad Sci U S A. Sep. 7, 2010;107(36):15957-62. doi: 10.1073/pnas.1002530107. Epub Aug. 23, 2010.
Petersen et al., LNA: a versatile tool for therapeutics and genomics. Trends Biotech. Feb. 2003;21(2):74-81. Review.
Pietersen et al., Stem cell regulation by polycomb repressors: postponing commitment. Curr Opin Cell Biol. Apr. 2008;20(2):201-7. doi: 10.1016/j.ceb.2008.01.004. Epub Mar. 4, 2008. Review.
Plath et al., Role of Histone H3 Lysine 27 Methylation in X Inactivation. Science. Apr. 4, 2003;300:131-5. doi: 10.1126/science.1084274.
Ponting et al., Evolution and functions of long noncoding RNAs. Cell. Feb. 20, 2009;136(4):62941. doi: 10.1016/j.cell.2009.02.006. Review.
Prensner et al., Transcriptome sequencing across a prostate cancer cohort identifies PCAT-1, an unannotated lincRNA implicated in disease progression. Nat Biotechnol. Jul. 31, 2011;29(8):742-9. doi: 10.1038/nbt.1914.

(56) References Cited

OTHER PUBLICATIONS

Qi et al., Repurposing CRISPR as an RNA-guided platform for sequence-specific control of gene expression. Cell. Feb. 28, 2013;152(5):1173-83. doi: 10.1016/j.cell.2013.02.022.
Rader, Molecular regulation of HDL metabolism and function: implications for novel therapies. J Clin Invest. Dec. 2006;116(12):3090-100.
Rajasekhar et al., Concise review: roles of polycomb group proteins in development and disease: a stem cell perspective. Stem Cells. Oct. 2007;25(10):2498-510. Epub Jun. 28, 2007. Review.
Redrup et al., The long noncoding RNA Kcnq1ot1 organises a lineage-specific nuclear domain for epigenetic gene silencing. Development. Feb. 2009;136(4):525-30. doi: 10.1242/dev.031328. Epub Jan. 14, 2009. 14 pages.
Ringrose et al., Epigenetic regulation of cellular memory by the Polycomb and Trithorax group proteins. Annu Rev Genet. 2004;38:413-43. Review.
Rinn et al., Functional demarcation of active and silent chromatin domains in human HOX loci by noncoding RNAs. Cell. Jun. 29, 2007;129(7):1311-23.
Rinn et al., Genome Regulation by Long Noncoding RNAs. Annu Rev Biochem. 2012;81:145-66.
Røsok et al., Systematic identification of sense-antisense transcripts in mammalian cells. Nat Biotechnol. Jan. 2004;22(1):104-8. Epub Dec. 14, 2003.
Rozen et al., Primer3 on the WWW for general users and for biologist programmers. Methods Mol Biol. 2000;132:365-86.
Sankaran et al., MicroRNA-15a and -16-1 act via MYB to elevate fetal hemoglobin expression in human trisomy 13. Proc Natl Acad Sci U S A. Jan. 25, 2011;108(4):1519-24.
Sankaran, Targeted therapeutic strategies for fetal hemoglobin induction. Hematol Am Soc Hematol Educ Program. 2011;2011:459-65.
Sarma et al., Locked nucleic acids (LNAs) reveal sequence requirements and kinetics of Xist RNA localization to the X chromosome. Proc Natl Acad Sci U S A. Dec. 21, 2010;107(51):22196-201. doi: 10.1073/pnas.1009785107. Epub Dec. 6, 2010.
Saxena et al., Long non-coding RNA modifies chromatin. Bioessays. 2011;33:830-9. Review.
Schadt et al., An integrative genomics approach to infer causal associations between gene expression and disease. Nat Genet. Jul. 2005;37(7):710-7. Epub Jun. 10, 2005.
Schlesinger et al., Polycomb-mediated methylation on Lys27 of histone H3 pre-marks genes for de novo methylation in cancer. Nat Genet. Feb. 2007;39(2):232-6. Epub Dec. 31, 2006.
Schoeftner et al., Recruitment of PRC1 function at the initiation of X inactivation independent of PRC2 and silencing. EMBO J. Jul. 12, 2006;25(13):3110-22. Epub Jun. 8, 2006.
Schuettengruber et al., Genome regulation by polycomb and trithorax proteins. Cell. Feb. 23, 2007;128(4):735-45.
Schultz et al., Enhancers compete with a long non-coding RNA for regulation of the Kcnq1 domain. Nucl Acids Res. 2015;43(2):745-59.
Schwartz et al., Genome-wide analysis of Polycomb targets in *Drosophila melanogaster*. Nat Genet. Jun. 2006;38(6):700-5.
Schwartz et al., Polycomb complexes and epigenetic states. Curr Opin Cell Biol. 2008;20:26673. doi: 10.1016/j.ceb.2008.03.002.
Schwartz et al., Polycomb silencing mechanisms and the management of genomic programmes. Nat Rev Genet. Jan. 2007;8(1):9-22.
Seong et al., Huntingtin facilitates polycomb repressive complex 2. Hum Mol Genet. Feb. 15, 2010;19(4):573-83. doi: 10.1093/hmg/ddp524. Epub Nov. 23, 2009.
Shaver et al., Origin of the polycomb repressive complex 2 and gene silencing by an E(z) homolog in the unicellular alga Chlamydomonas. Epigenetics. May 16, 2010;5(4):301-12. Epub May 24, 2010.
Shen et al,. EZH1 mediates methylation on histone H3 lysine 27 and complements EZH2 in maintaining stem cell identity and executing pluripotency. Mol Cell. Nov. 21, 2008;32(4):491-502. doi: 10.1016/j.molcel.2008.10.016.
Shen et al., Jumonji modulates polycomb activity and self-renewal versus differentiation of stem cells. Cell. Dec. 24, 2009;139(7):1303-14. doi: 10.1016/j.cell.2009.12.003. Epub Jun. 24, 2010. 26 pages.
Shore et al., Pregnancy-induced noncoding RNA (PINC) associates with polycomb repressive complex 2 and regulates mammary epithelial differentiation. PLoS Genet. 2012;8(7):e1002840. doi: 10.1371/journal.pgen.1002840. Epub Jul. 26, 2012.
Simon et al., High-resolution Xist binding maps reveal two-step spreading during X-chromosome inactivation. Nature. Dec. 19, 2013;504(7480):465-9. doi: 10.1038/nature12719. Epub Oct. 27, 2013.
Simon et al., Roles of the EZH2 histone methyltransferase in cancer epigenetics. Mutat Res. Dec. 1, 2008;647(1-2):21-9. Review.
Sing et al., A vertebrate Polycomb response element governs segmentation of the posterior hindbrain. Cell. Sep. 4, 2009;138(5):885-97. doi: 10.1016/j.cell.2009.08.020.
Sparmann et al., Polycomb silencers control cell fate, development and cancer. Nat Rev Cancer. Nov. 2006;6(11):846-56. Review.
Submission. EBI Accession No. ADH50651. Baker et al. Mar. 25, 2004.
Submission. EBI Accession No. EMBL:GC092872. Palma et al. Aug. 31, 2008.
Summerton, Morpholino antisense oligomers: the case for an Rnase H-independent structural type. Biochim Biophys Acta. Dec. 10, 1999;1489(1):141-58.
Sun et al., Evidence for a preferential targeting of 3'-UTRs by cis-encoded natural antisense transcripts. Nucleic Acids Res. Oct. 4, 2005;33(17):5533-43. Print 2005.
Sun et al., SNPs in human miRNA genes affect biogenesis and function. RNA. Sep. 2009;15(9):1640-51. doi: 10.1261/rna.1560209. Epub Jul. 17, 2009.
Tae et al., Bromodomain protein 7 interacts with PRMT5 and PRC2, and is involved in transcriptional repression of their target genes. Nucleic Acids Res. Jul. 2011;39(13):5424-38. doi: 10.1093/nar/gkr170.
Taft et al., Non-coding RNAs: regulators of disease. J Pathol. Jan. 2010;220(2):126-39. doi: 10.1002/path.2638. Review.
Taft et al., Tiny RNAs associated with transcription start sites in animals. Nat Genet. May 2009;41(5):572-8. doi: 10.1038/ng.312. Epub Apr. 19, 2009. Erratum in: Nat Genet. Jul. 2009;41(7):859.
Takagi et al., Role of Sp1 in transcription of human ATP2A2 gene in keratinocytes. J Invest Dermatol. Jan. 2008;128(1):96-103. Epub Jun. 28, 2007.
Takahashi et al., Deletion of Gtl2, imprinted non-coding RNA, with its differentially methylated region induces lethal parent-origin-dependent defects in mice. Hum Mol Genet. May 15, 2009;18(10):1879-88. doi: 10.1093/hmg/ddp108. Epub Mar. 4, 2009.
Tano et al., MALAT-1 enhances cell motility of lung adenocarcinoma cells by influencing the expression of motility-related genes. FEBS Lett. Nov. 19, 2010;584(22):4575-80. doi: 10.1016/j.febslet.2010.10.008. Epub Oct. 13, 2010.
Thomas et al., Development of apolipoprotein B antisense molecules as a therapy for hyperlipidemia. Curr Atheroscler Rep. Jan. 2010;12(1):58-65. doi: 10.1007/s11883-009-0078-7.
Thorvaldsen et al., A YY1 bridge for X inactivation. Cell. Jul. 8, 2011;146(1):11-3. doi: 10.1016/j .cell.2011.06.029.
Thorvaldsen et al., SnapShot: imprinted gene clusters. Cell. Sep. 7, 2007;130(5):958.
Tian et al., The long noncoding RNA, Jpx, is a molecular switch for X chromosome inactivation. Cell. Oct. 29, 2010;143(3):390-403. doi: 10.1016/j.cell.2010.09.049. 21 pages.
Tsai et al., Higher order chromatin structure at the X-inactivation center via looping DNA. Dev Biol. Jul. 15, 2008;319(2):416-25. doi: 10.1016/j.ydbio.2008.04.010. Epub Apr. 18, 2008. 22 pages.
Tsai et al., Long noncoding RNA as modular scaffold of histone modification complexes. Science. Aug. 6, 2010;329(5992):689-93. doi: 10.1126/science.1192002. Epub Nov. 2, 2010. 9 pages.
Van Peer et al., miRBase Tracker: keeping track of microRNA annotation changes. Database (Oxford). Aug. 25, 2014;2014. pii:bau080. doi: 10.1093/database/bau080. Print 2014.
Varela et al., Natural Antisense Makes Sense for Gene-specific Activation in Brain. Mol Ther Nucleic Acids. May 15, 2012;1:e24. doi: 10.1038/mtna.2012.17.

(56) References Cited

OTHER PUBLICATIONS

Venter et al., The sequence of the human genome. Science. Feb. 16, 2011;291(5507):1304-51. Erratum in: Science Jun. 5, 2001;292(5523):1838.
Vickers et al., Fully modified 2' MOE oligonucleotides redirect polyadenylation. Nucleic Acids Res. Mar. 15, 2001;29(6):1293-9.
Wahlestedt, Natural antisense and noncoding RNA transcripts as potential drug targets. Drug Discov Today. Jun. 2006;11(11-12):503-8.
Wahlestedt, Targeting long non-coding RNA to therapeutically upregulate gene expression. Nature Rev Drug Disc. Jun. 2013;12:433-46. Review.
Wan et al., Regulation of imprinting in clusters: noncoding RNAs versus insulators. Adv Genet. 2008;61:207-23. Review.
Wang et al., Long non-coding RNA UCA1a(CUDR) promotes proliferation and tumorigenesis of bladder cancer. Int J Oncol. Jul. 2012;41(1):276-84.
Wang et al., Molecular mechanisms of long noncoding RNAs. Cell Press. Sep. 16, 2011; 43(6):904-14.
Whitehead et al., Variation in tissue-specific gene expression among natural populations. Genome Biol. 2005;6(2):R13. Epub Jan. 26, 2005.
Williamson et al., Identification of an imprinting control region affecting the expression of all transcripts in the Gnas cluster. Nat Genet. Mar. 2006;38(3):350-5.
Wilusz et al., A triple helix stabilizes the 3' ends of long noncoding RNAs that lack poly(A) tails. Genes Dev. Nov. 1, 2012;26(21):2392-407. doi: 10.1101/gad.204438.112. Epub Oct. 16, 2012.
Wilusz et al., Long noncoding RNAs: functional surprises from the RNA world. Genes Dev. Jul. 1, 2009;23(13):1494-504. doi:10.1101/gad.1800909.
Woo et al., A Region of theHuman HOXDCluster that Confers Polycomb-Group Responsiveness. Cell. Jan. 8, 2010;140:99-110.
Woo et al., Gene activation of SMN by selective disruption of lncRNA-mediated recruitment of PRC2 for the treatment of spinal muscular atrophy. Proc Natl Acad Sci U S A. Feb. 21, 2017;114(8):E1509-E1518. doi:10.1073/pnas.1616521114. Epub Feb. 13, 2017.
Wu et al., Binding interactions between long noncoding RNA HOTAIR and PRC2 proteins. Biochemistry. Dec. 31, 2013;52(52):9519-27. doi: 10.1021/bi401085h.
Wutz et al., A Shift from Reversible to Irreversible X Inactivation Is Triggered during ES Cell Differentiation. Molec Cell. Apr. 2000;5:695-705.
Xiong et al., Polycomb antagonizes p300/CREB-binding protein associated factor to silence FOXP3 in a Kruppel-like factor-dependent manner. J Biol Chem. Oct. 5, 2012;287(41):34372-85. doi: 10.1074/jbc.M111.325332. Epub Aug. 15, 2012.
Yakali et al., Supramolecular chirality-sensing DNA-mimicry of a norbornane derivative decorated with isoxazoline and methylpyrolidine-2,5-dione ring. J Mol Structure. Jun. 10, 2013;1041:164-174.
Yang et al., High fidelity PCR with an off/on switch mediated by proofreading polymerases combining with phosphorothioate-modified primer. Biochem Biophys Res Commun. Mar. 4, 2005;328(1):265-72. Erratum in: Biochem Biophys Res Commun. Jun. 3, 2005;331(2):682. Zhang, Jia [removed]; Li, Kai [removed].
Yang et al., Long noncoding RNAs: fresh perspectives into the RNA world. Trends Biochem Sci. Jan. 2012;39(1):35-43. doi: 10.1016/j.tibs.2013.10.002. Epub Nov. 27, 2013. Review.
Yang et al., The histone code regulating expression of the imprinted mouse Igf2r gene. Endocrinology. Dec. 2003;144(12):5658-70.
Yap et al., Molecular interplay of the noncoding RNA ANRIL and methylated histone H3 lysine 27 by polycomb CBX7 in transcriptional silencing of INK4a. Mol Cell. Jun. 11, 2010;38(5):662-74. doi: 10.1016/j.molcel.2010.03.021. Epub Jun. 11, 2011. 23 pages.
Yatsuki et al., Sequence-based structural features between Kvlqt1 and Tapa1 on mouse chromosome 7F4/F5 corresponding to the Beckwith-Wiedemann syndrome region on human 11p15.5: long-stretches of unusually well conserved intronic sequences of kvlqt1 between mouse and human. DNA Res. Jun. 30, 2000;7(3):195-206.

Yu et al., Single-stranded RNAs use RNAi to potently and allele-selectively inhibit mutant huntingtin expression. Cell. Aug. 31, 2012;150(5):895-908. doi: 10.1016/j.cell.2012.08.002.
Zhang et al., Long noncoding RNA-mediated intrachromosomal interactions promote imprinting at the *Kcnq1* locus. J Cell Biol. 2014;204(1):61-75.
Zhang et al., NATsDB: Natural Antisense Transcripts DataBase. Nucleic Acids Res. Jan. 2007;35(Database issue):D156-61. Epub Nov. 1, 2006.
Zhang et al., Perinucleolar Targeting of the Inactive X during S Phase: Evidence for a Role in the Maintenance of Silencing. Cell. May 18, 2007;129:693-706.
Zhao et al., Genome-wide identification of polycomb-associated RNAs by RIP-seq. Mol Cell. Dec. 22, 2010;40(6):939-53.
Zhao et al., Polycomb proteins targeted by a short repeat RNA to the mouse X-chromosome. Science. 2008; 322(5902):750-756. doi:10.1126/science.1163045. E-pub version.
Zhou et al., Targeting RNA-splicing for SMA treatment. Mol Cells. Mar. 2012;33(3):223-8. doi: 10.1007/s10059-012-0005-6.
International Search Report and Written Opinion for Application No. PCT/US2013/041461 dated Aug. 21, 2013.
International Preliminary Report on Patentability for Application No. PCT/US2013/041461 dated Nov. 27, 2014.
[No Author Listed] Catalogue of Parent of Origin Effects, Imprinted Genes and Related Effects, Parental Origins of de novo Mutations, downloaded at http://igc.otago.ac.nz/home.html on May 22, 2015, 2 pgs.
Anderson et al., Post-transcriptional regulons coordinate the initiation and resolution of inflammation. Nat Rev Immunol. Jan. 2010;10(1):24-35. doi: 10.1038/nri2685.
Axelson, The Notch signaling cascade in neuroblastoma: role of the basic helix-loop-helix proteins HASH-1 and HES-1. Cancer Lett. Feb. 20, 2004;204(2):171-8. Review.
Blauw et al., SMN1 gene duplications are associated with sporadic ALS. Neurology. Mar. 13, 2012;78(11):776-80. doi: 10.1212/WNL.0b013e318249f697. Epub Feb. 8, 2012.
Burghes et al., Antisense oligonucleotides and spinal muscular atrophy: skipping along. Genes Dev. Aug. 1, 2010;24(15):1574-9. doi:10.1101/gad.1961710.
Burglen et al., Structure and organization of the human survival motor neurone (SMN) gene. Genomics. Mar. 15, 1996;32(3):479-82.
Cloonan et al., Stem cell transcriptome profiling via massive-scale mRNA sequencing. Nat Methods. Jul. 2008;5(7):613-9.
Corcia et al., Homozygous SMN2 deletion is a protective factor in the Swedish ALS population. Eur J Hum Genet. May 2012;20(5):588-91. doi: 10.1038/ejhg.2011.255. Epub Jan. 25, 2012.
Corcia et al., The importance of the SMN genes in the genetics of sporadic ALS. Amyotroph Lateral Scler. Oct.-Dec. 2009;10(5-6):436-40. doi: 10.3109/17482960902759162.
Daughters et al., RNA gain-of-function in spinocerebellar ataxia type 8. PLoS Genet. Aug. 2009;5(8):e1000600. doi: 10.1371/journal.pgen.1000600. Epub Aug. 14, 2009.
Dominski et al., Identification and characterization by antisense oligonucleotides of exon and intron sequences required for splicing. Mol Cell Biol. Nov. 1994; 14(11): 7445-7454.
Dominski et al., Restoration of correct splicing in thalassemic pre-mRNA by antisense oligonucleotides. Proc Natl Acad Sci U S A. Sep. 15, 1993;90(18):8673-7.
Du et al., Progress toward therapy with antisense-mediated splicing modulation. Curr Opin Mol Ther. Apr. 2009;11(2):116-23.
Edwards et al., The evolution of the DLK1-DIO3 imprinted domain in mammals. PLoS Biol. Jun. 3, 2008;6(6):e135. doi: 10.1371/journal.pbio.0060135.
ENCODE Project Consortium. A user's guide to the encyclopedia of DNA elements (ENCODE). PLoS Biol. Apr. 2011;9(4):e1001046. doi: 10.1371/journal.pbio.1001046. Epub Apr. 19, 2011.
Feldkötter et al., Quantitative analyses of SMN1 and SMN2 based on real-time lightCycler PCR: fast and highly reliable carrier testing and prediction of severity of spinal muscular atrophy. Am J Hum Genet. Feb. 2002;70(2):358-68. Epub Dec. 21, 2001.
Genbank Submission; NCBI, Accession No. AM773775. Radha et al., Jul. 13, 2007.

(56) References Cited

OTHER PUBLICATIONS

Genbank Submission; NCBI, Accession No. NG_008691.1 Mar. 2011. 11 pages.
Genbank Submission; NCBI, Accession No. NG_009361.1; Salomons et al.; Jun. 27, 2016.
Genbank Submission; NCBI,Accession No. NM_007294.3; Orban et al.; May 25, 2016.
Genbank Submission; NCBI,Accession No. NM_199461.3; Miles et al.; Jun. 4, 2016.
Genbank Submission; NIH/NCBI, Accession No. AA106140. Marra et al., Feb. 4, 1997. 1 page.
Genbank Submission; NIH/NCBI, Accession No. ABZ86223. Nyce et al. Oct. 17, 2003.
Genbank Submission; NIH/NCBI, Accession No. NM_022876.2. Singh et al. Mar. 13, 2011. 11 pages.
Gerbino et al., Mislocalised FUS mutants stall spliceosomal snRNPs in the cytoplasm. Neurobiol Dis. Jul. 2013;55:120-8. doi:10.1016/j.nbd.2013.03.003. Epub Mar. 21, 2013.
Huang, Shoujun et al., Non-encoding RNA and development of animals, Science China Life Science, Dec. 31, 2009; pp. 21-30.
Jensen et al., Chapter 6: CLIP—Crosslinking and ImmunoPrecipitation of In Vivo RNA Targets of RNA-Binding Proteins. Methods in Molecular Biology. 2008;488:85-98.
Kariya et al., Mutant superoxide dismutase 1 (SOD1), a cause of amyotrophic lateral sclerosis, disrupts the recruitment of SMN, the spinal muscular atrophy protein to nuclear Cajal bodies. Hum Mol Genet. Aug. 1, 2012;21(15):3421-34. doi: 10.1093/hmg/dds174. Epub May 11, 2012.
Keil et al., A short antisense oligonucleotide ameliorates symptoms of severe mouse models of spinal muscular atrophy. Mol Ther Nucleic Acids. Jul. 8, 2012;3:e174. doi: 10.1038/mtna.2014.23.
Kim et al., Widespread transcription at neuronal activity-regulated enhancers. Nature. 2010; 465 (7295):182-7. Epub Jan. 12, 2011. 15 pages.
Latorra et al., Design considerations and effects of LNA in PCR primers. Mol Cell Probes. Oct. 2003;17(5):253-9.
Lebedeva et al., Phosphorothioate Oligodeoxynucleotides as inhibitors of gene expression: antisense and non-antisense effects. 1991. 99-118.
Lee et al., Homozygous SMN2 Deletion is a Major Risk Factor among Twenty-Five Korean Sporadic Amyotrophic Lateral Sclerosis Patients . Yonsei Med J. Jan. 2012;53(1):53-57.
Lee et al., Yin Yang 1 positively regulates BRCA1 and inhibits mammary cancer formation. Oncogene. 2012;31:116-27.
Liang et al., B1-induced caspase-independent apoptosis in MCF-7 cells is mediated by down-regulation of Bc1-2 via p53 binding to P2 promoter TATA box. Toxicol Appl Pharmacol. Oct. 1, 2011;256(1):52-61. doi:10.1016/j.taap.2011.07.010. Epub Jul. 23, 2011.
Lim et al., Modulation of survival motor neuron pre-mRNA splicing by inhibition of alternative 3' splice site pairing. J Biol Chem. Nov. 30, 2001;276(48):45476-83. Epub Oct. 2, 2001.
Mercer et al., Structure and function of long noncoding RNAs in epigenetic regulation. Mar. 5, 2013;20:300-7.
Mikkelsen et al., Genome-wide maps of chromatin state in pluripotent and lineage-committed cells. Nature. Aug. 2, 2007;448(7153):553-60. doi:10.1038/nature06008. Epub Aug. 13, 2010.
Miyajima et al., Identification of a cis-acting element for the regulation of SMN exon 7 splicing. J Biol Chem. Jun. 28, 2002;277(26):23271-7. Epub Apr. 15, 2002.
Modarresi et al., Inhibition of natural antisense transcripts in vivo results in gene-specific transcriptional upregulation. Nat Biotechnol. Mar. 25, 2012;30(5):453-9. doi: 10.1038/nbt.2158. 21 pages.
Mortazavi et al., Mapping and quantifying mammalian transcriptomes by RNA-Seq. Nat Methods. Jul. 2008;5(7):621-8.
Niwano et al., Lentiviral vector-mediated SERCA2 gene transfer protects against heart failure and left ventricular remodeling after myocardial infarction in rats. Mol Ther. Jun. 2008;16(6):1026-32. doi: 10.1038/mt.2008.61. Epub Mar. 25, 2008.

Pedersen et al., Identification and classification of conserved RNA secondary structures in the human genome. PLoS Comput Biol. Apr. 2006;2(4):e33. Epub Apr. 21, 2006.
Reyon et al., FLASH assembly of TALENs for high-throughput genome editing. Nat Biotechnol. May 2012;30(5):460-5. doi: 10.1038/nbt.2170.
Sciabola et al., Improved nucleic acid descriptors for siRNA efficacy prediction. Nucleic Acids Res. Feb. 1, 2013;41(3):1383-94. doi: 10.1093/nar/gks1191. Epub Dec. 14, 2012.
Seila et al., Divergent transcription from active promoters. Science. Dec. 19, 2008;322(5909):1849-51. doi: 10.1126/science.1162253. Epub Dec. 4, 2008.
Shiraki et al., Cap analysis gene expression for high-throughput analysis of transcriptional starting point and identification of promoter usage. Proc Natl Acad Sci U S A. Dec. 23, 2003;100(26):15776-81. Epub Dec. 8, 2003.
Singh et al., A short antisense oligonucleotide masking a unique intronic motif prevents skipping of a critical exon in spinal muscular atrophy. RNA Biol. Jul.-Aug. 2009;6(3):341-50. Epub Jul. 14, 2009.
Singh et al., Splicing of a Critical Exon of Human Survival Motor Neuron Is Regulated by a Unique Silencer Element Located in the Last Intron. Mol Cell Biol. Feb. 2006;26(4):1333-46. doi: 10.1128/MCB.26.4.1333-1346.2006.
Sirchia et al., Misbehaviour of XIST RNA in breast cancer cells. PLoS One. 2009;4(5):e5559. doi: 10.1371/journal.pone.0005559. Epub May 15, 2009.
Skordis et al., antisense oligonucleotides provide a trans-acting splicing enhancer that stimulates SMN2 gene expression in patient fibroblasts. Proc Natl Acad Sci U S A. Apr. 1, 2003;100(7):4114-9. Epub Mar. 17, 2003.
Torarinsson et al., Thousands of corresponding human and mouse genomic regions unalignable in primary sequence contain common RNA structure. Genome Res. Jul. 2006;16(7):885-9. Epub Jun. 2, 2006. Erratum in: Genome Res. Nov. 2006;16(11):1439.
Tsuiji et al., Spliceosome integrity is defective in the motor neuron diseases ALS and SMA. EMBO Mol Med. Feb. 2013;5(2):221-34. doi: 10.1002/emmm 201202303. Epub Jan. 25, 2013.
Turner et al., Survival motor neuron deficiency enhances progression in an amyotrophic lateral sclerosis mouse model. Neurobiol Dis. Jun. 2009;34(3):511-7. doi: 10.1016/j.nbd.2009.03.005. Epub Mar. 28, 2009.
Ule et al., CLIP Identifies Nova-Regulated RNA Networks in the Brain. Science. 2003;302:1212-5. doi: 10.1126/science.1090095.
Ule et al., CLIP: A method for identifying protein-RNA interaction sites in living cells. Methods. 2005;37:376-86.
Valen et al., Genome-wide detection and analysis of hippocampus core promoters using DeepCAGE. Genome Res. Feb. 2009;19(2):255-65. doi: 10.1101/gr.084541.108. Epub Dec. 2008.
Veldink et al., SMN genotypes producing less SMN protein increase susceptibility to and severity of sporadic ALS. Neurology. Sep. 27, 2005;65(6):820-5. Epub Aug. 10, 2005.
Wang et al., Correlation between Dnase I hypersensitive site distribution and gene expression in HeLa S3 cells. PLoS One. 2012;7(8):e42414. doi: 10.1371/journal.pone.0042414. Epub Aug. 2012.
Wang et al., Multifunctional transcription factor YY1: a therapeutic target in human cancer? Expert Opin Ther Targets. 2006;10(2):253-66.
Williams et al., Oligonucleotide-mediated survival of motor neuron protein expression in CNS improves phenotype in a mouse model of spinal muscular atrophy. J Neurosci. Jun. 17, 2009;29(24):7633-8. doi: 10.1523/JNEUROSCI.0950-09.2009.
Yamazaki et al., FUS-SMN protein interactions link the motor neuron diseases ALS and SMA. Cell Rep. Oct. 25, 2012;2(4):799-806. doi:10.1016/j.celrep.2012.08.025. Epub Sep. 27, 2012.
Zaravinos et al., Yin yang 1 expression in human tumors. Cell Cycle. Feb. 1, 2010;9(3):512-22.

* cited by examiner

COMPOSITIONS AND METHODS FOR MODULATING MECP2 EXPRESSION

CROSS-REFERENCE TO RELATED APPLICATIONS

This application is a continuation which claims the benefit under 35 U.S.C. § 120 of U.S. application Ser. No. 14/401,237, entitled "COMPOSITIONS AND METHODS FOR MODULATING MECP2 EXPRESSION" filed on Nov. 14, 2014, which is a national stage filing under U.S.C. § 371 of PCT International Application PCT/US2013/041394, with an international filing date of May 16, 2013, which claims the benefit under 35 U.S.C. § 119(e) of U.S. Provisional Application No. 61/648,051, entitled "COMPOSITIONS AND METHODS FOR MODULATING MECP2 EXPRESSION", filed May 16, 2012, the contents of each of which are incorporated herein by reference in their entireties.

FIELD OF THE INVENTION

The invention relates to oligonucleotide based compositions, as well as methods of using oligonucleotide based compositions for treating disease.

BACKGROUND OF THE INVENTION

Rett syndrome is a developmental disorder of the brain occurring mostly in females characterized by normal early development, followed by a slowing of development resulting in loss of control of the hands, loss of speech, breathing problems, slowed brain and head growth, ambulatory problems, seizures, and mental retardation. Rett syndrome affects approximately 1 in 10,000 live female births. Most cases of Rett syndrome are caused by a mutation in the methyl CpG binding protein 2, or MECP2 gene, on the X chromosome that causes reduced activity or inactivation of MECP2.

MECP2 is a transcriptional repressor that binds to methylated DNA and is present in large quantities in mature nerve cells. MECP2 represses transcription from methylated gene promoters through interaction with histone deacetylase and the corepressor SIN3A. Many of the genes that are known to be regulated by the MECP2 protein play a role in normal brain function, particularly the maintenance of synapses. Mouse studies have demonstrated MECP2 mutations cause defects in synaptic function, especially in synaptic plasticity.

SUMMARY OF THE INVENTION

Aspects of the invention disclosed herein provide methods and compositions that are useful for upregulating MECP2 in cells. In some embodiments, single stranded oligonucleotides are provided that target a PRC2-associated region of a MECP2 gene (e.g., human MECP2) and thereby cause upregulation of the gene. In some embodiments, single stranded oligonucleotides are provided that target a PRC2-associated region of the gene encoding MECP2. In some embodiments, these single stranded oligonucleotides activate or enhance expression of MECP2 by relieving or preventing PRC2 mediated repression of MECP2.

Upregulation of MECP2 offers a treatment for diseases associated with decreased MECP2 activity. Aspects of the invention disclosed herein provide methods and compositions that are useful for upregulating MECP2 for the treatment and/or prevention of Rett Syndrome. MECP2 is also associated with MECP2-related severe neonatal encephalopathy, Angelman syndrome, and PPM-X syndrome. Accordingly, certain aspects of the invention disclosed herein provide methods and compositions that are useful for upregulating MECP2 for the treatment and/or prevention of MECP2-related severe neonatal encephalopathy, Angelman syndrome, and PPM-X syndrome.

Further aspects of the invention provide methods for selecting oligonucleotides for activating or enhancing expression of MECP2. In some embodiments, methods are provided for selecting a set of oligonucleotides that is enriched in candidates (e.g., compared with a random selection of oligonucleotides) for activating or enhancing expression of MECP2. Accordingly, the methods may be used to establish sets of clinical candidates that are enriched in oligonucleotides that activate or enhance expression of MECP2. Such libraries may be utilized, for example, to identify lead oligonucleotides for developing therapeutics to treat MECP2. Furthermore, in some embodiments, oligonucleotide chemistries are provided that are useful for controlling the pharmacokinetics, biodistribution, bioavailability and/or efficacy of the single stranded oligonucleotides for activating expression of MECP2.

According to some aspects of the invention single stranded oligonucleotides are provided that have a region of complementarity that is complementarty with (e.g., at least 8 consecutive nucleotides of) a PRC2-associated region of a MECP2 gene, e.g., a PRC2-associated region of the nucleotide sequence set forth as SEQ ID NO: 1 or 2. In some embodiments, the oligonucleotide has at least one of the following features: a) a sequence that is 5'X-Y-Z, in which X is any nucleotide and in which X is at the 5' end of the oligonucleotide, Y is a nucleotide sequence of 6 nucleotides in length that is not a human seed sequence of a microRNA, and Z is a nucleotide sequence of 1 to 23 nucleotides in length; b) a sequence that does not comprise three or more consecutive guanosine nucleotides; c) a sequence that has less than a threshold level of sequence identity with every sequence of nucleotides, of equivalent length to the second nucleotide sequence, that are between 50 kilobases upstream of a 5'-end of an off-target gene and 50 kilobases downstream of a 3'-end of the off-target gene; d) a sequence that is complementary to a PRC2-associated region that encodes an RNA that forms a secondary structure comprising at least two single stranded loops; and e) a sequence that has greater than 60% G-C content. In some embodiments, the single stranded oligonucleotide has at least two of features a), b), c), d), and e), each independently selected. In some embodiments, the single stranded oligonucleotide has at least three of features a), b), c), d), and e), each independently selected. In some embodiments, the single stranded oligonucleotide has at least four of features a), b), c), d), and e), each independently selected. In some embodiments, the single stranded oligonucleotide has each of features a), b), c), d), and e). In certain embodiments, the oligonucleotide has the sequence 5'X-Y-Z, in which the oligonucleotide is 8-50 nucleotides in length.

According to some aspects of the invention, single stranded oligonucleotides are provided that have a sequence X-Y-Z, in which X is any nucleotide, Y is a nucleotide sequence of 6 nucleotides in length that is not a seed sequence of a human microRNA, and Z is a nucleotide sequence of 1 to 23 nucleotides in length, in which the single stranded oligonucleotide is complementary with a PRC2-associated region of a MECP2 gene, e.g., a PRC2-associated region of the nucleotide sequence set forth as SEQ ID NO: 1 or 2. In some aspects of the invention, single stranded oligonucleotides are provided that have a sequence 5'-X-Y-Z, in which X is any nucleotide, Y is a nucleotide sequence of 6 nucleotides in length that is not a seed sequence of a human microRNA, and Z is a nucleotide sequence of 1 to 23 nucleotides in length, in which the single stranded oligonucleotide is complementary with at least 8 consecutive nucleotides of a PRC2-associated region of a MECP2 gene, e.g., a PRC2-associated region of the nucleotide sequence set forth as SEQ ID NO: 1 or 2. In some embodiments, Y is a sequence selected from Table 1. In some embodiments, the PRC2-associated region is a sequence listed in any one of SEQ ID NOS: 5 to 118.

In some embodiments, the single stranded oligonucleotide comprises a nucleotide sequence as set forth in any one of SEQ ID NOS: 119 to 83660, or a fragment thereof that is at least 8 nucleotides. In some embodiments, the single stranded oligonucleotide comprises a nucleotide sequence as set forth in any one of SEQ ID NOS: 119 to 83660, in which the 5' end of the nucleotide sequence provided is the 5' end of the oligonucleotide. In some embodiments, the region of complementarity (e.g., the at least 8 consecutive nucleotides) is also present within the nucleotide sequence set forth as SEQ ID NO: 3 or 4.

In some embodiments, the single stranded oligonucleotide comprises a nucleotide sequence as set forth in any one of SEQ ID NOS: 119 to 83660. In some embodiments, the single stranded oligonucleotide comprises a fragment of at least 8 nucleotides of a nucleotide sequence as set forth in any one of SEQ ID NOS: 119 to 83660.

In some embodiments, the PRC2-associated region is a sequence listed in any one of SEQ ID NOS: 5 to 84. In some embodiments, the single stranded oligonucleotide comprises a nucleotide sequence as set forth in any one of SEQ ID NOS: 119 to 47653 or a fragment thereof that is at least 8 nucleotides. In some embodiments, the single stranded oligonucleotide comprises a nucleotide sequence as set forth in any one of SEQ ID NOS: 119 to 47653, wherein the 5' end of the nucleotide sequence provided in any one of SEQ ID NOS: 119 to 47653 is the 5' end of the oligonucleotide. In some embodiments, the at least 8 consecutive nucleotides are also present within the nucleotide sequence set forth as SEQ ID NO: 3.

In some embodiments, the PRC2-associated region is a sequence listed in any one of SEQ ID NOS: 85 to 118. In some embodiments, the single stranded oligonucleotide comprises a nucleotide sequence as set forth in any one of SEQ ID NOS: 47462 to 83660 or a fragment thereof that is at least 8 nucleotides. In some embodiments, the single stranded oligonucleotide comprises a nucleotide sequence as set forth in any one of SEQ ID NOS: 47462 to 83660, wherein the 5' end of the nucleotide sequence provided in any one of SEQ ID NOS: 47462 to 83660 is the 5' end of the oligonucleotide. In some embodiments, the at least 8 consecutive nucleotides are present within the nucleotide sequence set forth as SEQ ID NO: 4.

In some embodiments, a single stranded oligonucleotide comprises a nucleotide sequence as set forth in Table 3. In some embodiments, the single stranded oligonucleotide comprises a fragment of at least 8 nucleotides of a nucleotide sequence as set forth in Table 3. In some embodiments, a single stranded oligonucleotide consists of a nucleotide sequence as set forth in Table 3.

In some embodiments, the single stranded oligonucleotide does not comprise three or more consecutive guanosine nucleotides. In some embodiments, the single stranded oligonucleotide does not comprise four or more consecutive guanosine nucleotides.

In some embodiments, the single stranded oligonucleotide is 8 to 30 nucleotides in length. In some embodiments, the single stranded oligonucleotide is up to 50 nucleotides in length. In some embodiments, the single stranded oligonucleotide is 8 to 10 nucleotides in length and all but 1, 2, or 3 of the nucleotides of the complementary sequence of the PRC2-associated region are cytosine or guanosine nucleotides.

In some embodiments, the single stranded oligonucleotide is complementary with at least 8 consecutive nucleotides of a PRC2-associated region of a MECP2 gene, e.g., a PRC2-associated region of a nucleotide sequence set forth as SEQ ID NO: 1 or 2, in which the nucleotide sequence of the single stranded oligonucleotide comprises one or more of a nucleotide sequence selected from the group consisting of (a) (X)Xxxxxx, (X)xXxxxx, (X)xxXxxx, (X)xxxXxx, (X)xxxxXx and (X)xxxxxX, (b) (X)XXxxxx, (X)XxXxxx, (X)XxxXxx, (X)XxxxXx, (X)XxxxxX, (X)xXXxxx, (X)xXxXxx, (X)xXxxXx, (X)xXxxxX, (X)xxXXxx, (X)xxXxXx, (X)xxXxxX, (X)xxxXXx, (X)xxxXxX and (X)xxxxXX, (c) (X)XXXxxx, (X)xXXXxx, (X)xxXXXx, (X)xxxXXX, (X)XXxXxx, (X)XXxxXx, (X)XXxxxX, (X)xXXxXx, (X)xXXxxX, (X)xxXXxX, (X)XxXXxx, (X)XxxXXx, (X)XxxxXX, (X)XxXxXx (X)XxxxXX, (X)xXxXXx, (X)xXxxXX, (X)xxXXXx, (X)xXxXxX and (X)XxXxXx, (d) (X)xxXXXX, (X)xXxXXX, (X)xXXxXX, (X)xXXXxX, (X)xXXXXx, (X)xXXXXX, (X)XxxXXXX, (X)XxXxXX, (X)XxXXxx, (X)XxXXxX, (X)XxXXXx, (X)XxxXx, (X)XXxxXX, (X)XXxXxX, (X)XXxXXx, (X)XXXxxX, (X)XXXxXx, and (X)XXXXxx, (e) (X)xXXXXX, (X)XxXXXX, (X)XXxXXX, (X)XXXxXX, (X)XXXXxX and (X)XXXXXx, and (f) XXXXXX, XxXXXXX, XXxXXXX, XXXxXXX, XXXXxXX, XXXXXxX and XXXXXXx, wherein "X" denotes a nucleotide analogue, (X) denotes an optional nucleotide analogue, and "x" denotes a DNA or RNA nucleotide unit.

In some embodiments, at least one nucleotide of the oligonucleotide is a nucleotide analogue. In some embodiments, the at least one nucleotide analogue results in an increase in Tm of the oligonucleotide in a range of 1 to 5° C. compared with an oligonucleotide that does not have the at least one nucleotide analogue.

In some embodiments, at least one nucleotide of the oligonucleotide comprises a 2' O-methyl. In some embodiments, each nucleotide of the oligonucleotide comprises a 2' O-methyl. In some embodiments, the oligonucleotide comprises at least one ribonucleotide, at least one deoxyribonucleotide, or at least one bridged nucleotide. In some embodiments, the bridged nucleotide is a LNA nucleotide, a cEt nucleotide or a ENA modified nucleotide. In some embodiments, each nucleotide of the oligonucleotide is a LNA nucleotide.

In some embodiments, the nucleotides of the oligonucleotide comprise alternating deoxyribonucleotides and 2'-fluoro-deoxyribonucleotides. In some embodiments, the nucleotides of the oligonucleotide comprise alternating deoxyribonucleotides and 2'-O-methyl nucleotides. In some embodiments, the nucleotides of the oligonucleotide comprise alternating deoxyribonucleotides and ENA nucleotide analogues. In some embodiments, the nucleotides of the oligonucleotide comprise alternating deoxyribonucleotides and LNA nucleotides. In some embodiments, the 5' nucleotide of the oligonucleotide is a deoxyribonucleotide. In some embodiments, the nucleotides of the oligonucleotide comprise alternating LNA nucleotides and 2'-O-methyl nucleotides. In some embodiments, the 5' nucleotide of the oligonucleotide is a LNA nucleotide. In some embodiments, the nucleotides of the oligonucleotide comprise deoxyribonucleotides flanked by at least one LNA nucleotide on each of the 5' and 3' ends of the deoxyribonucleotides.

In some embodiments, the single stranded oligonucleotide comprises modified internucleotide linkages (e.g., phosphorothioate internucleotide linkages or other linkages) between at least two, at least three, at least four, at least five or more nucleotides. In some embodiments, the single stranded oligonucleotide comprises modified internucleotide linkages (e.g., phosphorothioate internucleotide linkages or other linkages) between between all nucleotides.

In some embodiments, the nucleotide at the 3' position of the oligonucleotide has a 3' hydroxyl group. In some embodiments, the nucleotide at the 3' position of the oligonucleotide has a 3' thiophosphate. In some embodiments, the single stranded oligonucleotide has a biotin moiety or other moiety conjugated to its 5' or 3' nucleotide. In some embodiments, the single stranded oligonucleotide has cholesterol, Vitamin A, folate, sigma receptor ligands, aptamers, peptides, such as CPP, hydrophobic molecules, such as lipids, ASGPR or dynamic polyconjugates and variants thereof at its 5' or 3' end.

According to some aspects of the invention compositions are provided that comprise any of the oligonucleotides disclosed herein, and a carrier. In some embodiments, compositions are provided that comprise any of the oligonucleotides in a buffered solution. In some embodiments, the oligonucleotide is conjugated to the carrier. In some embodiments, the carrier is a peptide. In some embodiments, the carrier is a steroid. According to some aspects of the invention pharmaceutical compositions are provided that comprise any of the oligonucleotides disclosed herein, and a pharmaceutically acceptable carrier.

According to other aspects of the invention, kits are provided that comprise a container housing any of the compositions disclosed herein.

According to some aspects of the invention, methods of increasing expression of MECP2 in a cell are provided. In some embodiments, the methods involve delivering any one or more of the single stranded oligonucleotides disclosed herein into the cell. In some embodiments, delivery of the single stranded oligonucleotide into the cell results in a level of expression of MECP2 that is greater (e.g., at least 50% greater) than a level of expression of MECP2 in a control cell that does not comprise the single stranded oligonucleotide.

According to some aspects of the invention, methods of increasing levels of MECP2 in a subject are provided. According to some aspects of the invention, methods of treating a condition (e.g., Rett Syndrome, MECP2-related severe neonatal encephalopathy, Angelman syndrome, PPM-X syndrome) associated with decreased levels of MECP2 in a subject are provided. In some embodiments, the methods involve administering any one or more of the single stranded oligonucleotides disclosed herein to the subject.

BRIEF DESCRIPTION OF TABLES

Table 1: Hexamers that are not seed sequences of human miRNAs

Table 2: A listing of oligonucleotide modifications

Table 3: Formatted oligonucleotide sequences made for testing showing nucleotide modifications. The table shows the sequence of the modified nucleotides, where lnaX represents an LNA nucleotide with 3' phosphorothioate linkage, omeX is a 2'-O-methyl nucleotide, dX is a deoxy nucleotide. An s at the end of a nucleotide code indicates that the nucleotide had a 3' phosphorothioate linkage. The "-Sup" at the end of the sequence marks the fact that the 3' end lacks either a phosphate or thiophosphate on the 3' linkage. The Formatted Sequence column shows the sequence of the oligonucleotide, including modified nucleotides.

DETAILED DESCRIPTION OF CERTAIN EMBODIMENTS OF THE INVENTION

Aspects of the invention provided herein relate to the discovery of polycomb repressive complex 2 (PRC2)-interacting RNAs. Polycomb repressive complex 2 (PRC2) is a histone methyltransferase and a known epigenetic regulator involved in silencing of genomic regions through methylation of histone H3. Among other functions, PRC2 interacts with long noncoding RNAs (lncRNAs), such as RepA, Xist, and Tsix, to catalyze trimethylation of histone H3-lysine27. PRC2 contains four subunits, Eed, Suz12, RbAp48, and Ezh2. Aspects of the invention relate to the recognition that single stranded oligonucleotides that bind to PRC2-associated regions of RNAs (e.g., lncRNAs) that are expressed from within a genomic region that encompasses or that is in functional proximity to the MECP2 gene can induce or enhance expression of MECP2. In some embodiments, this upregulation is believed to result from inhibition of PRC2 mediated repression of MECP2.

As used herein, the term "PRC2-associated region" refers to a region of a nucleic acid that comprises or encodes a sequence of nucleotides that interact directly or indirectly with a component of PRC2. A PRC2-associated region may be present in a RNA (e.g., a long non-coding RNA (lncRNA)) that that interacts with a PRC2. A PRC2-associated region may be present in a DNA that encodes an RNA that interacts with PRC2. In some cases, the PRC2-associated region is equivalently referred to as a PRC2-interacting region.

In some embodiments, a PRC2-associated region is a region of an RNA that crosslinks to a component of PRC2 in response to in situ ultraviolet irradiation of a cell that expresses the RNA, or a region of genomic DNA that encodes that RNA region. In some embodiments, a PRC2-associated region is a region of an RNA that immunoprecipitates with an antibody that targets a component of PRC2, or a region of genomic DNA that encodes that RNA region. In some embodiments, a PRC2-associated region is a region of an RNA that immunoprecipitates with an antibody that binds specifically to SUZ12, EED, EZH2 or RBBP4 (which as noted above are components of PRC2), or a region of genomic DNA that encodes that RNA region.

In some embodiments, a PRC2-associated region is a region of an RNA that is protected from nucleases (e.g., RNases) in an RNA-immunoprecipitation assay that employs an antibody that targets a component of PRC2, or a region of genomic DNA that encodes that protected RNA region. In some embodiments, a PRC2-associated region is a region of an RNA that is protected from nucleases (e.g., RNases) in an RNA-immunoprecipitation assay that employs an antibody that targets SUZ12, EED, EZH2 or RBBP4, or a region of genomic DNA that encodes that protected RNA region.

In some embodiments, a PRC2-associated region is a region of an RNA within which occur a relatively high frequency of sequence reads in a sequencing reaction of products of an RNA-immunoprecipitation assay that employs an antibody that targets a component of PRC2, or a region of genomic DNA that encodes that RNA region. In some embodiments, a PRC2-associated region is a region of an RNA within which occur a relatively high frequency of sequence reads in a sequencing reaction of products of an RNA-immunoprecipitation assay that employs an antibody that binds specifically to SUZ12, EED, EZH2 or RBBP4, or a region of genomic DNA that encodes that protected RNA region. In such embodiments, the PRC2-associated region may be referred to as a "peak."

In some embodiments, a PRC2-associated region comprises a sequence of 40 to 60 nucleotides that interact with PRC2 complex. In some embodiments, a PRC2-associated region comprises a sequence of 40 to 60 nucleotides that encode an RNA that interacts with PRC2. In some embodiments, a PRC2-associated region comprises a sequence of up to 5 kb in length that comprises a sequence (e.g., of 40 to 60 nucleotides) that interacts with PRC2. In some embodiments, a PRC2-associated region comprises a sequence of up to 5 kb in length within which an RNA is encoded that has a sequence (e.g., of 40 to 60 nucleotides) that is known to interact with PRC2. In some embodiments, a PRC2-associated region comprises a sequence of about 4 kb in length that comprise a sequence (e.g., of 40 to 60 nucleotides) that interacts with PRC2. In some embodiments, a PRC2-associated region comprises a sequence of about 4 kb in length within which an RNA is encoded that includes a sequence (e.g., of 40 to 60 nucleotides) that is known to interact with PRC2. In some embodiments, a PRC2-associated region has a sequence as set forth in any one of SEQ ID NOS: 5 to 118.

In some embodiments, single stranded oligonucleotides are provided that specifically bind to, or are complementary to, a PRC2-associated region in a genomic region that encompasses or that is in proximity to the MECP2 gene. In some embodiments, single stranded oligonucleotides are provided that specifically bind to, or are complementary to, a PRC2-associated region that has a sequence as set forth in any one of SEQ ID NOS: 5 to 118. In some embodiments, single stranded oligonucleotides are provided that specifically bind to, or are complementary to, a PRC2-associated region that has a sequence as set forth in any one of SEQ ID NOS: 5 to 118 combined with up to 2 kb, up to 5 kb, or up to 10 kb of flanking sequences from a corresponding genomic region to which these SEQ IDs map (e.g., in a human genome). In some embodiments, single stranded oligonucleotides have a sequence as set forth in any one of SEQ ID NOS: 119 to 83660. In some embodiments, single stranded oligonucleotides have a sequence as set forth in Table 3.

Without being bound by a theory of invention, these oligonucleotides are able to interfere with the binding of and function of PRC2, by preventing recruitment of PRC2 to a specific chromosomal locus. For example, a single administration of single stranded oligonucleotides designed to specifically bind a PRC2-associated region lncRNA can stably displace not only the lncRNA, but also the PRC2 that binds to the lncRNA, from binding chromatin. After displacement, the full complement of PRC2 is not recovered for up to 24 hours. Further, lncRNA can recruit PRC2 in a cis fashion, repressing gene expression at or near the specific chromosomal locus from which the lncRNA was transcribed.

Methods of modulating gene expression are provided, in some embodiments, that may be carried out in vitro, ex vivo, or in vivo. It is understood that any reference to uses of compounds throughout the description contemplates use of the compound in preparation of a pharmaceutical composition or medicament for use in the treatment of condition (e.g., Rett Syndrome, MECP2-related severe neonatal encephalopathy, Angelman syndrome, PPM-X syndrome) associated with decreased levels or activity of MECP2. Thus, as one nonlimiting example, this aspect of the invention includes use of such single stranded oligonucleotides in the preparation of a medicament for use in the treatment of disease, wherein the treatment involves upregulating expression of MECP2.

In further aspects of the invention, methods are provided for selecting a candidate oligonucleotide for activating expression of MECP2. The methods generally involve selecting as a candidate oligonucleotide, a single stranded oligonucleotide comprising a nucleotide sequence that is complementary to a PRC2-associated region (e.g., a nucleotide sequence as set forth in any one of SEQ ID NOS: 5 to 118). In some embodiments, sets of oligonucleotides may be selected that are enriched (e.g., compared with a random selection of oligonucleotides) in oligonucleotides that activate expression of MECP2.

Single Stranded Oligonucleotides for Modulating Expression of MECP2

In one aspect of the invention, single stranded oligonucleotides complementary to the PRC2-associated regions are provided for modulating expression of MECP2 in a cell. In some embodiments, expression of MECP2 is upregulated or increased. In some embodiments, single stranded oligonucleotides complementary to these PRC2-associated regions inhibit the interaction of PRC2 with long RNA transcripts such that gene expression is upregulated or increased. In some embodiments, single stranded oligonucleotides complementary to these PRC2-associated regions inhibit the interaction of PRC2 with long RNA transcripts, resulting in reduced methylation of histone H3 and reduced gene inactivation, such that gene expression is upregulated or increased. In some embodiments, this interaction may be disrupted or inhibited due to a change in the structure of the long RNA that prevents or reduces binding to PRC2. The oligonucleotide may be selected using any of the methods disclosed herein for selecting a candidate oligonucleotide for activating expression of MECP2.

The single stranded oligonucleotide may comprise a region of complementarity that is complementary with a PRC2-associated region of a nucleotide sequence set forth in any one of SEQ ID NOS: 1 to 4. The region of complementarity of the single stranded oligonucleotide may be complementary with at least 6, e.g., at least 7, at least 8, at least 9, at least 10, at least 15 or more consecutive nucleotides of the PRC2-associated region.

The PRC2-associated region may map to a position in a chromosome between 50 kilobases upstream of a 5'-end of the MECP2 gene and 50 kilobases downstream of a 3'-end of the MECP2 gene. The PRC2-associated region may map to a position in a chromosome between 25 kilobases upstream of a 5'-end of the MECP2 gene and 25 kilobases downstream of a 3'-end of the MECP2 gene. The PRC2-associated region may map to a position in a chromosome between 12 kilobases upstream of a 5'-end of the MECP2 gene and 12 kilobases downstream of a 3'-end of the MECP2 gene. The PRC2-associated region may map to a position in a chromosome between 5 kilobases upstream of a 5'-end of the MECP2 gene and 5 kilobases downstream of a 3'-end of the MECP2 gene.

The genomic position of the selected PRC2-associated region relative to the MECP2 gene may vary. For example, the PRC2-associated region may be upstream of the 5' end of the MECP2 gene. The PRC2-associated region may be downstream of the 3' end of the MECP2 gene. The PRC2-associated region may be within an intron of the MECP2 gene. The PRC2-associated region may be within an exon of the MECP2 gene. The PRC2-associated region may traverse an intron-exon junction, a 5'-UTR-exon junction or a 3'-UTR-exon junction of the MECP2 gene.

The single stranded oligonucleotide may comprise a sequence having the formula X—Y—Z, in which X is any nucleotide, Y is a nucleotide sequence of 6 nucleotides in length that is not a human seed sequence of a microRNA, and Z is a nucleotide sequence of varying length. In some embodiments X is the 5' nucleotide of the oligonucleotide. In some embodiments, when X is anchored at the 5' end of the oligonucleotide, the oligonucleotide does not have any nucleotides or nucleotide analogs linked 5' to X. In some embodiments, other compounds such as peptides or sterols may be linked at the 5' end in this embodiment as long as they are not nucleotides or nucleotide analogs. In some embodiments, the single stranded oligonucleotide has a sequence 5'X-Y-Z and is 8-50 nucleotides in length. Oligonucleotides that have these sequence characteristics are predicted to avoid the miRNA pathway. Therefore, in some embodiments, oligonucleotides having these sequence characteristics are unlikely to have an unintended consequence of functioning in a cell as a miRNA molecule. The Y sequence may be a nucleotide sequence of 6 nucleotides in length set forth in Table 1.

The single stranded oligonucleotide may have a sequence that does not contain guanosine nucleotide stretches (e.g., 3 or more, 4 or more, 5 or more, 6 or more consecutive guanosine nucleotides). In some embodiments, oligonucleotides having guanosine nucleotide stretches have increased non-specific binding and/or off-target effects, compared with oligonucleotides that do not have guanosine nucleotide stretches.

The single stranded oligonucleotide may have a sequence that has less than a threshold level of sequence identity with every sequence of nucleotides, of equivalent length, that map to a genomic position encompassing or in proximity to an off-target gene. For example, an oligonucleotide may be designed to ensure that it does not have a sequence that maps to genomic positions encompassing or in proximity with all known genes (e.g., all known protein coding genes) other than MECP2. In a similar embodiment, an oligonucleotide may be designed to ensure that it does not have a sequence that maps to any other known PRC2-associated region, particularly PRC2-associated regions that are functionally related to any other known gene (e.g., any other known protein coding gene). In either case, the oligonucleotide is expected to have a reduced likelihood of having off-target effects. The threshold level of sequence identity may be 50%, 60%, 70%, 80%, 85%, 90%, 95%, 99% or 100% sequence identity.

The single stranded oligonucleotide may have a sequence that is complementary to a PRC2-associated region that encodes an RNA that forms a secondary structure comprising at least two single stranded loops. In has been discovered that, in some embodiments, oligonucleotides that are complementary to a PRC2-associated region that encodes an RNA that forms a secondary structure comprising one or more single stranded loops (e.g., at least two single stranded loops) have a greater likelihood of being active (e.g., of being capable of activating or enhancing expression of a target gene) than a randomly selected oligonucleotide. In some cases, the secondary structure may comprise a double stranded stem between the at least two single stranded loops. Accordingly, the region of complementarity between the oligonucleotide and the PRC2-associated region may be at a location of the PRC2 associated region that encodes at least a portion of at least one of the loops. In some cases, the region of complementarity between the oligonucleotide and the PRC2-associated region may be at a location of the PRC2-associated region that encodes at least a portion of at least two of the loops. In some cases, the region of complementarity between the oligonucleotide and the PRC2-associated region may be at a location of the PRC2 associated region that encodes at least a portion of the double stranded stem. In some embodiments, a PRC2-associated region (e.g., of an lncRNA) is identified (e.g., using RIP-Seq methodology or information derived therefrom). In some embodiments, the predicted secondary structure RNA (e.g., lncRNA) containing the PRC2-associated region is determined using RNA secondary structure prediction algorithms, e.g., RNAfold, mfold. In some embodiments, oligonucleotides are designed to target a region of the RNA that forms a secondary structure comprising one or more single stranded loop (e.g., at least two single stranded loops) structures which may comprise a double stranded stem between the at least two single stranded loops.

The single stranded oligonucleotide may have a sequence that is has greater than 30% G-C content, greater than 40% G-C content, greater than 50% G-C content, greater than 60% G-C content, greater than 70% G-C content, or greater than 80% G-C content. The single stranded oligonucleotide may have a sequence that has up to 100% G-C content, up to 95% G-C content, up to 90% G-C content, or up to 80% G-C content. In some embodiments in which the oligonucleotide is 8 to 10 nucleotides in length, all but 1, 2, 3, 4, or 5 of the nucleotides of the complementary sequence of the PRC2-associated region are cytosine or guanosine nucleotides. In some embodiments, the sequence of the PRC2-associated region to which the single stranded oligonucleotide is complementary comprises no more than 3 nucleotides selected from adenine and uracil.

The single stranded oligonucleotide may be complementary to a chromosome of a different species (e.g., a mouse, rat, rabbit, goat, monkey, etc.) at a position that encompasses or that is in proximity to that species' homolog of MECP2. The single stranded oligonucleotide may be complementary to a human genomic region encompassing or in proximity to the MECP2 gene and also be complementary to a mouse genomic region encompassing or in proximity to the mouse homolog of MECP2. For example, the single stranded oligonucleotide may be complementary to a sequence as set forth in SEQ ID NO: 1 or 2, which is a human genomic region encompassing or in proximity to the MECP2 gene, and also be complementary to a sequence as set forth in SEQ ID NO: 3 or 4, which is a mouse genomic region encompassing or in proximity to the mouse homolog of the MECP2 gene. Oligonucleotides having these characteristics may be tested in vivo or in vitro for efficacy in multiple species (e.g., human and mouse). This approach also facilitates development of clinical candidates for treating human disease by selecting a species in which an appropriate animal exists for the disease.

In some embodiments, the region of complementarity of the single stranded oligonucleotide is complementary with at least 8 to 15, 8 to 30, 8 to 40, or 10 to 50, or 5 to 50, or 5 to 40 bases, e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 consecutive nucleotides of a PRC2-associated region. In some embodiments, the region of complementarity is complementary with at least 8 consecutive nucleotides of a PRC2-associated region. In some embodiments the sequence of the single stranded oligonucleotide is based on an RNA sequence that binds to PRC2, or a portion thereof, said portion having a length of from 5 to 40 contiguous base pairs, or about 8 to 40 bases, or about 5 to 15, or about 5 to 30, or about 5 to 40 bases, or about 5 to 50 bases.

Complementary, as the term is used in the art, refers to the capacity for precise pairing between two nucleotides. For example, if a nucleotide at a certain position of an oligonucleotide is capable of hydrogen bonding with a nucleotide at the same position of PRC2-associated region, then the single stranded nucleotide and PRC2-associated region are considered to be complementary to each other at that position. The single stranded nucleotide and PRC2-associated region are complementary to each other when a sufficient number of corresponding positions in each molecule are occupied by nucleotides that can hydrogen bond with each other through their bases. Thus, "complementary" is a term which is used to indicate a sufficient degree of complementarity or precise pairing such that stable and specific binding occurs between the single stranded nucleotide and PRC2-associated region. For example, if a base at one position of a single stranded nucleotide is capable of hydrogen bonding with a base at the corresponding position of a PRC2-associated region, then the bases are considered to be complementary to each other at that position. 100% complementarity is not required.

The single stranded oligonucleotide may be at least 80% complementary to (optionally one of at least 85%, 90%, 91%, 92%, 93%, 94%, 95%, 96%, 97%, 98%, 99% or 100% complementary to) the consecutive nucleotides of a PRC2-associated region. In some embodiments the single stranded oligonucleotide may contain 1, 2 or 3 base mismatches compared to the portion of the consecutive nucleotides of a PRC2-associated region. In some embodiments the single stranded oligonucleotide may have up to 3 mismatches over 15 bases, or up to 2 mismatches over 10 bases.

It is understood in the art that a complementary nucleotide sequence need not be 100% complementary to that of its target to be specifically hybridizable. In some embodiments, a complementary nucleic acid sequence for purposes of the present disclosure is specifically hybridizable when binding of the sequence to the target molecule (e.g., lncRNA) interferes with the normal function of the target (e.g., lncRNA) to cause a loss of activity (e.g., inhibiting PRC2-associated repression with consequent up-regulation of gene expression) and there is a sufficient degree of complementarity to avoid non-specific binding of the sequence to non-target sequences under conditions in which avoidance of non-specific binding is desired, e.g., under physiological conditions in the case of in vivo assays or therapeutic treatment, and in the case of in vitro assays, under conditions in which the assays are performed under suitable conditions of stringency.

In some embodiments, the single stranded oligonucleotide is 7, 8, 9, 10, 11, 12, 13, 14, 15, 16, 17, 18, 19, 20, 21, 22, 23, 24, 25, 26, 27, 28, 29, 30, 35, 40, 45, 50 or more nucleotides in length. In a preferred embodiment, the oligonucleotide is 8 to 30 nucleotides in length.

In some embodiments, the PRC2-associated region occurs on the same DNA strand as a gene sequence (sense). In some embodiments, the PRC2-associated region occurs on the opposite DNA strand as a gene sequence (anti-sense). Oligonucleotides complementary to a PRC2-associated region can bind either sense or anti-sense sequences. Base pairings may include both canonical Watson-Crick base pairing and non-Watson-Crick base pairing (e.g., Wobble base pairing and Hoogsteen base pairing). It is understood that for complementary base pairings, adenosine-type bases (A) are complementary to thymidine-type bases (T) or uracil-type bases (U), that cytosine-type bases (C) are complementary to guanosine-type bases (G), and that universal bases such as 3-nitropyrrole or 5-nitroindole can hybridize to and are considered complementary to any A, C, U, or T. Inosine (I) has also been considered in the art to be a universal base and is considered complementary to any A, C, U or T.

In some embodiments, any one or more thymidine (T) nucleotides (or modified nucleotide thereof) or uridine (U) nucleotides (or a modified nucleotide thereof) in a sequence provided herein, including a sequence provided in the sequence listing, may be replaced with any other nucleotide suitable for base pairing (e.g., via a Watson-Crick base pair) with an adenosine nucleotide. In some embodiments, any one or more thymidine (T) nucleotides (or modified nucleotide thereof) or uridine (U) nucleotides (or a modified nucleotide thereof) in a sequence provided herein, including a sequence provided in the sequence listing, may be suitably replaced with a different pyrimidine nucleotide or vice versa. In some embodiments, any one or more thymidine (T) nucleotides (or modified nucleotide thereof) in a sequence provided herein, including a sequence provided in the sequence listing, may be suitably replaced with a uridine (U) nucleotide (or a modified nucleotide thereof) or vice versa. In some embodiments, GC content of the single stranded oligonucleotide is preferably between about 30-60%. Contiguous runs of three or more Gs or Cs may not be preferable in some embodiments. Accordingly, in some embodiments, the oligonucleotide does not comprise a stretch of three or more guanosine nucleotides.

In some embodiments, the single stranded oligonucleotide specifically binds to, or is complementary to an RNA that is encoded in a genome (e.g., a human genome) as a single contiguous transcript (e.g., a non-spliced RNA). In some embodiments, the single stranded oligonucleotide specifically binds to, or is complementary to an RNA that is encoded in a genome (e.g., a human genome), in which the distance in the genome between the 5' end of the coding region of the RNA and the 3' end of the coding region of the RNA is less than 1 kb, less than 2 kb, less than 3 kb, less than 4 kb, less than 5 kb, less than 7 kb, less than 8 kb, less than 9 kb, less than 10 kb, or less than 20 kb.

It is to be understood that any oligonucleotide provided herein can be excluded. In some embodiments, it has been found that single stranded oligonucleotides disclosed herein may increase expression of mRNA corresponding to the gene by at least about 50% (i.e. 150% of normal or 1.5 fold), or by about 2 fold to about 5 fold. In some embodiments, expression may be increased by at least about 15 fold, 20 fold, 30 fold, 40 fold, 50 fold or 100 fold, or any range between any of the foregoing numbers. It has also been found that increased mRNA expression has been shown to correlate to increased protein expression.

In some or any of the embodiments of the oligonucleotides described herein, or processes for designing or synthesizing them, the oligonucleotides will upregulate gene expression and may specifically bind or specifically hybridize or be complementary to the PRC2 binding RNA that is transcribed from the same strand as a protein coding reference gene. The oligonucleotide may bind to a region of the PRC2 binding RNA that originates within or overlaps an intron, exon, intron exon junction, 5' UTR, 3' UTR, a translation initiation region, or a translation termination region of a protein coding sense strand of a reference gene (refGene).

In some or any of the embodiments of oligonucleotides described herein, or processes for designing or synthesizing them, the oligonucleotides will upregulate gene expression and may specifically bind or specifically hybridize or be complementary to a PRC2 binding RNA that transcribed from the opposite strand (the antisense strand) of a protein coding reference gene. The oligonucleotide may bind to a region of the PRC2 binding RNA that originates within or overlaps an intron, exon, intron exon junction, 5' UTR, 3' UTR, a translation initiation region, or a translation termination region of a protein coding antisense strand of a reference gene The oligonucleotides described herein may be modified, e.g., comprise a modified sugar moiety, a modified internucleoside linkage, a modified nucleotide and/or combinations thereof. In addition, the oligonucleotides can exhibit one or more of the following properties: do not induce substantial cleavage or degradation of the target RNA; do not cause substantially complete cleavage or degradation of the target RNA; do not activate the RNAse H pathway; do not activate RISC; do not recruit any Argonaute family protein; are not cleaved by Dicer; do not mediate alternative splicing; are not immune stimulatory; are nuclease resistant; have improved cell uptake compared to unmodified oligonucleotides; are not toxic to cells or mammals; may have improved endosomal exit; do interfere with interaction of lncRNA with PRC2, preferably the Ezh2 subunit but optionally the Suz12, Eed, RbAp46/48 subunits or accessory factors such as Jarid2; do decrease histone H3 lysine27 methylation and/or do upregulate gene expression.

Oligonucleotides that are designed to interact with RNA to modulate gene expression are a distinct subset of base sequences from those that are designed to bind a DNA target (e.g., are complementary to the underlying genomic DNA sequence from which the RNA is transcribed).

Any of the oligonucleotides disclosed herein may be linked to one or more other oligonucleotides disclosed herein by a linker, e.g., a cleavable linker.

Method for Selecting Candidate Oligonucleotides for Activating Expression of MECP2

Methods are provided herein for selecting a candidate oligonucleotide for activating or enhancing expression of MECP2. The target selection methods may generally involve steps for selecting single stranded oligonucleotides having any of the structural and functional characteristics disclosed herein. Typically, the methods involve one or more steps aimed at identifying oligonucleotides that target a PRC2-associated region that is functionally related to MECP2, for example a PRC2-associated region of a lncRNA that regulates expression of MECP2 by facilitating (e.g., in a cis-regulatory manner) the recruitment of PRC2 to the MECP2 gene. Such oligonucleotides are expected to be candidates for activating expression of MECP2 because of their ability to hybridize with the PRC2-associated region of a nucleic acid (e.g., a lncRNA). In some embodiments, this hybridization event is understood to disrupt interaction of PRC2 with the nucleic acid (e.g., a lncRNA) and as a result disrupt recruitment of PRC2 and its associated co-repressors (e.g., chromatin remodeling factors) to the MECP2 gene locus.

Methods of selecting a candidate oligonucleotide may involve selecting a PRC2-associated region (e.g., a nucleotide sequence as set forth in any one of SEQ ID NOS: 5 to 118) that maps to a chromosomal position encompassing or in proximity to the MECP2 gene (e.g., a chromosomal position having a sequence as set forth in any one of SEQ ID NOS: 1 to 4). The PRC2-associated region may map to the strand of the chromosome comprising the sense strand of the MECP2 gene, in which case the candidate oligonucleotide is complementary to the sense strand of the MECP2 gene (i.e., is antisense to the MECP2 gene). Alternatively, the PRC2-associated region may map to the strand of the first chromosome comprising the antisense strand of the MECP2 gene, in which case the oligonucleotide is complementary to the antisense strand (the template strand) of the MECP2 gene (i.e., is sense to the MECP2 gene).

Methods for selecting a set of candidate oligonucleotides that is enriched in oligonucleotides that activate expression of MECP2 may involve selecting one or more PRC2-associated regions that map to a chromosomal position that encompasses or that is in proximity to the MECP2 gene and selecting a set of oligonucleotides, in which each oligonucleotide in the set comprises a nucleotide sequence that is complementary with the one or more PRC2-associated regions. As used herein, the phrase, "a set of oligonucleotides that is enriched in oligonucleotides that activate expression of" refers to a set of oligonucleotides that has a greater number of oligonucleotides that activate expression of a target gene (e.g., MECP2) compared with a random selection of oligonucleotides of the same physicochemical properties (e.g., the same GC content, $T_m$, length etc.) as the enriched set.

Where the design and/or synthesis of a single stranded oligonucleotide involves design and/or synthesis of a sequence that is complementary to a nucleic acid or PRC2-associated region described by such sequence information, the skilled person is readily able to determine the complementary sequence, e.g., through understanding of Watson Crick base pairing rules which form part of the common general knowledge in the field.

In some embodiments design and/or synthesis of a single stranded oligonucleotide involves manufacture of an oligonucleotide from starting materials by techniques known to those of skill in the art, where the synthesis may be based on a sequence of a PRC2-associated region, or portion thereof.

Methods of design and/or synthesis of a single stranded oligonucleotide may involve one or more of the steps of:

Identifying and/or selecting PRC2-associated region;

Designing a nucleic acid sequence having a desired degree of sequence identity or complementarity to a PRC2-associated region or a portion thereof;

Synthesizing a single stranded oligonucleotide to the designed sequence;

Purifying the synthesized single stranded oligonucleotide; and

Optionally mixing the synthesized single stranded oligonucleotide with at least one pharmaceutically acceptable diluent, carrier or excipient to form a pharmaceutical composition or medicament.

Single stranded oligonucleotides so designed and/or synthesized may be useful in method of modulating gene expression as described herein.

Preferably, single stranded oligonucleotides of the invention are synthesized chemically. Oligonucleotides used to practice this invention can be synthesized in vitro by well-known chemical synthesis techniques.

Oligonucleotides of the invention can be stabilized against nucleolytic degradation such as by the incorporation of a modification, e.g., a nucleotide modification. For example, nucleic acid sequences of the invention include a phosphorothioate at least the first, second, or third internucleotide linkage at the 5' or 3' end of the nucleotide sequence. As another example, the nucleic acid sequence can include a 2'-modified nucleotide, e.g., a 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-

O-DMAOE), 2'-O-dimethylaminopropyl (2'-O-DMAP), 2'-O-dimethylaminoethyloxyethyl (2'-O-DMAEOE), or 2'-O—N-methylacetamido (2'-O—NMA). As another example, the nucleic acid sequence can include at least one 2'-O-methyl-modified nucleotide, and in some embodiments, all of the nucleotides include a 2'-O-methyl modification. In some embodiments, the nucleic acids are "locked," i.e., comprise nucleic acid analogues in which the ribose ring is "locked" by a methylene bridge connecting the 2'-O atom and the 4'-C atom.

It is understood that any of the modified chemistries or formats of single stranded oligonucleotides described herein can be combined with each other, and that one, two, three, four, five, or more different types of modifications can be included within the same molecule.

In some embodiments, the method may further comprise the steps of amplifying the synthesized single stranded oligonucleotide, and/or purifying the single stranded oligonucleotide (or amplified single stranded oligonucleotide), and/or sequencing the single stranded oligonucleotide so obtained.

As such, the process of preparing a single stranded oligonucleotide may be a process that is for use in the manufacture of a pharmaceutical composition or medicament for use in the treatment of disease, optionally wherein the treatment involves modulating expression of a gene associated with a PRC2-associated region.

In the methods described above a PRC2-associated region may be, or have been, identified, or obtained, by a method that involves identifying RNA that binds to PRC2.

Such methods may involve the following steps: providing a sample containing nuclear ribonucleic acids, contacting the sample with an agent that binds specifically to PRC2 or a subunit thereof, allowing complexes to form between the agent and protein in the sample, partitioning the complexes, synthesizing nucleic acid that is complementary to nucleic acid present in the complexes.

Where the single stranded oligonucleotide is based on a PRC2-associated region, or a portion of such a sequence, it may be based on information about that sequence, e.g., sequence information available in written or electronic form, which may include sequence information contained in publicly available scientific publications or sequence databases.

Nucleotide Analogues

In some embodiments, the oligonucleotide may comprise at least one ribonucleotide, at least one deoxyribonucleotide, and/or at least one bridged nucleotide. In some embodiments, the oligonucleotide may comprise a bridged nucleotide, such as a locked nucleic acid (LNA) nucleotide, a constrained ethyl (cEt) nucleotide, or an ethylene bridged nucleic acid (ENA) nucleotide. Examples of such nucleotides are disclosed herein and known in the art. In some embodiments, the oligonucleotide comprises a nucleotide analog disclosed in one of the following United States patent or patent Application Publications: U.S. Pat. Nos. 7,399,845, 7,741,457, 8,022,193, 7,569,686, 7,335,765, 7,314,923, 7,335,765, and 7,816,333, US 20110009471, the entire contents of each of which are incorporated herein by reference for all purposes. The oligonucleotide may have one or more 2' O-methyl nucleotides. The oligonucleotide may consist entirely of 2' O-methyl nucleotides.

Often the single stranded oligonucleotide has one or more nucleotide analogues. For example, the single stranded oligonucleotide may have at least one nucleotide analogue that results in an increase in $T_m$ of the oligonucleotide in a range of 1° C., 2° C., 3° C., 4° C., or 5° C. compared with an oligonucleotide that does not have the at least one nucleotide analogue. The single stranded oligonucleotide may have a plurality of nucleotide analogues that results in a total increase in $T_m$ of the oligonucleotide in a range of 2° C., 3° C., 4° C., 5° C., 6° C., 7° C., 8° C., 9° C., 10° C., 15° C., 20° C., 25° C., 30° C., 35° C., 40° C., 45° C. or more compared with an oligonucleotide that does not have the nucleotide analogue.

The oligonucleotide may be of up to 50 nucleotides in length in which 2 to 10, 2 to 15, 2 to 16, 2 to 17, 2 to 18, 2 to 19, 2 to 20, 2 to 25, 2 to 30, 2 to 40, 2 to 45, or more nucleotides of the oligonucleotide are nucleotide analogues. The oligonucleotide may be of 8 to 30 nucleotides in length in which 2 to 10, 2 to 15, 2 to 16, 2 to 17, 2 to 18, 2 to 19, 2 to 20, 2 to 25, 2 to 30 nucleotides of the oligonucleotide are nucleotide analogues. The oligonucleotide may be of 8 to 15 nucleotides in length in which 2 to 4, 2 to 5, 2 to 6, 2 to 7, 2 to 8, 2 to 9, 2 to 10, 2 to 11, 2 to 12, 2 to 13, 2 to 14 nucleotides of the oligonucleotide are nucleotide analogues. Optionally, the oligonucleotides may have every nucleotide except 1, 2, 3, 4, 5, 6, 7, 8, 9, or 10 nucleotides modified.

The oligonucleotide may consist entirely of bridged nucleotides (e.g., LNA nucleotides, cEt nucleotides, ENA nucleotides). The oligonucleotide may comprise alternating deoxyribonucleotides and 2'-fluoro-deoxyribonucleotides. The oligonucleotide may comprise alternating deoxyribonucleotides and 2'-O-methyl nucleotides. The oligonucleotide may comprise alternating deoxyribonucleotides and ENA nucleotide analogues. The oligonucleotide may comprise alternating deoxyribonucleotides and LNA nucleotides. The oligonucleotide may comprise alternating LNA nucleotides and 2'-O-methyl nucleotides. The oligonucleotide may have a 5' nucleotide that is a bridged nucleotide (e.g., a LNA nucleotide, cEt nucleotide, ENA nucleotide). The oligonucleotide may have a 5' nucleotide that is a deoxyribonucleotide.

The oligonucleotide may comprise deoxyribonucleotides flanked by at least one bridged nucleotide (e.g., a LNA nucleotide, cEt nucleotide, ENA nucleotide) on each of the 5' and 3' ends of the deoxyribonucleotides. The oligonucleotide may comprise deoxyribonucleotides flanked by 1, 2, 3, 4, 5, 6, 7, 8 or more bridged nucleotides (e.g., LNA nucleotides, cEt nucleotides, ENA nucleotides) on each of the 5' and 3' ends of the deoxyribonucleotides. The 3' position of the oligonucleotide may have a 3' hydroxyl group. The 3' position of the oligonucleotide may have a 3' thiophosphate.

The oligonucleotide may be conjugated with a label. For example, the oligonucleotide may be conjugated with a biotin moiety, cholesterol, Vitamin A, folate, sigma receptor ligands, aptamers, peptides, such as CPP, hydrophobic molecules, such as lipids, ASGPR or dynamic polyconjugates and variants thereof at its 5' or 3' end.

Preferably the single stranded oligonucleotide comprises one or more modifications comprising: a modified sugar moiety, and/or a modified internucleoside linkage, and/or a modified nucleotide and/or combinations thereof. It is not necessary for all positions in a given oligonucleotide to be uniformly modified, and in fact more than one of the modifications described herein may be incorporated in a single oligonucleotide or even at within a single nucleoside within an oligonucleotide.

In some embodiments, the single stranded oligonucleotides are chimeric oligonucleotides that contain two or more chemically distinct regions, each made up of at least one nucleotide. These oligonucleotides typically contain at least one region of modified nucleotides that confers one or more beneficial properties (such as, for example, increased nuclease resistance, increased uptake into cells, increased binding affinity for the target) and a region that is a substrate for enzymes capable of cleaving RNA:DNA or RNA:RNA hybrids. Chimeric single stranded oligonucleotides of the invention may be formed as composite structures of two or more oligonucleotides, modified oligonucleotides, oligonucleosides and/or oligonucleotide mimetics as described above. Such compounds have also been referred to in the art as hybrids or gapmers. Representative United States patents that teach the preparation of such hybrid structures comprise, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference.

In some embodiments, the single stranded oligonucleotide comprises at least one nucleotide modified at the 2' position of the sugar, most preferably a 2'-O-alkyl, 2'-O-alkyl-O-alkyl or 2'-fluoro-modified nucleotide. In other preferred embodiments, RNA modifications include 2'-fluoro, 2'-amino and 2' O-methyl modifications on the ribose of pyrimidines, abasic residues or an inverted base at the 3' end of the RNA. Such modifications are routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligodeoxynucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Most preferred are oligonucleotides with phosphorothioate backbones and those with heteroatom backbones, particularly $CH_2$—NH—O—$CH_2$, CH, ~N($CH_3$)~O~$CH_2$ (known as a methylene(methylimino) or MMI backbone, $CH_2$—O—N($CH_3$)—$CH_2$, $CH_2$—N($CH_3$)—N($CH_3$)—$CH_2$ and O—N($CH_3$)—$CH_2$—$CH_2$ backbones, wherein the native phosphodiester backbone is represented as O—P—O—$CH_2$,); amide backbones (see De Mesmaeker et al. Ace. Chem. Res. 1995, 28:366-374); morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455, 233; 5,466,677; 5,476,925; 5,519,126; 5,536,821; 5,541,306; 5,550,111; 5,563, 253; 5,571,799; 5,587,361; and 5,625,050.

Morpholino-based oligomeric compounds are described in Dwaine A. Braasch and David R. Corey, Biochemistry, 2002, 41(14), 4503-4510); Genesis, volume 30, issue 3, 2001; Heasman, J., Dev. Biol., 2002, 243, 209-214; Nasevicius et al., Nat. Genet., 2000, 26, 216-220; Lacerra et al., Proc. Natl. Acad. Sci., 2000, 97, 9591-9596; and U.S. Pat. No. 5,034,506, issued Jul. 23, 1991. In some embodiments, the morpholino-based oligomeric compound is a phosphorodiamidate morpholino oligomer (PMO) (e.g., as described in Iverson, Curr. Opin. Mol. Ther., 3:235-238, 2001; and Wang et al., J. Gene Med., 12:354-364, 2010; the disclosures of which are incorporated herein by reference in their entireties).

Cyclohexenyl nucleic acid oligonucleotide mimetics are described in Wang et al., J. Am. Chem. Soc., 2000, 122, 8595-8602.

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts; see U.S. Pat. Nos. 5,034,506; 5,166,315; 5,185,444; 5,214,134; 5,216,141; 5,235,033; 5,264, 562; 5, 264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

Modified oligonucleotides are also known that include oligonucleotides that are based on or constructed from arabinonucleotide or modified arabinonucleotide residues. Arabinonucleosides are stereoisomers of ribonucleosides, differing only in the configuration at the 2'-position of the sugar ring. In some embodiments, a 2'-arabino modification is 2'-F arabino. In some embodiments, the modified oligonucleotide is 2'-fluoro-D-arabinonucleic acid (FANA) (as described in, for example, Lon et al., Biochem., 41:3457-3467, 2002 and Min et al., Bioorg. Med. Chem. Lett., 12:2651-2654, 2002; the disclosures of which are incorporated herein by reference in their entireties). Similar modifications can also be made at other positions on the sugar, particularly the 3' position of the sugar on a 3' terminal nucleoside or in 2'-5' linked oligonucleotides and the 5' position of 5' terminal nucleotide.

PCT Publication No. WO 99/67378 discloses arabinonucleic acids (ANA) oligomers and their analogues for improved sequence specific inhibition of gene expression via association to complementary messenger RNA.

Other preferred modifications include ethylene-bridged nucleic acids (ENAs) (e.g., International Patent Publication No. WO 2005/042777, Morita et al., Nucleic Acid Res., Suppl 1:241-242, 2001; Surono et al., Hum. Gene Ther., 15:749-757, 2004; Koizumi, Curr. Opin. Mol. Ther., 8:144-149, 2006 and Horie et al., Nucleic Acids Symp. Ser (Oxf), 49:171-172, 2005; the disclosures of which are incorporated herein by reference in their entireties). Preferred ENAs include, but are not limited to, 2'-0,4'-C-ethylene-bridged nucleic acids.

Examples of LNAs are described in WO/2008/043753 and include compounds of the following general formula.

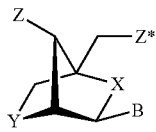

where X and Y are independently selected among the groups —O—, —S—, —N(H)—, N(R)—, —CH$_2$— or —CH— (if part of a double bond), —CH$_2$—O—, —CH$_2$—S—, —CH$_2$—N(H)—, —CH$_2$—N(R)—, —CH$_2$—CH$_2$— or —CH$_2$—CH— (if part of a double bond), —CH=CH—, where R is selected from hydrogen and C$_{1-4}$-alkyl; Z and Z* are independently selected among an internucleoside linkage, a terminal group or a protecting group; B constitutes a natural or non-natural nucleotide base moiety; and the asymmetric groups may be found in either orientation.

Preferably, the LNA used in the oligonucleotides described herein comprises at least one LNA unit according any of the formulas

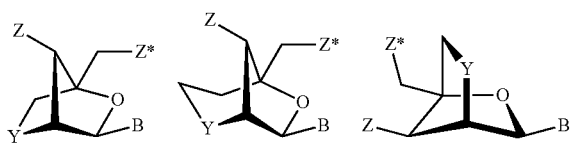

wherein Y is —O—, —S—, —NH—, or N(R$^H$); Z and Z* are independently selected among an internucleoside linkage, a terminal group or a protecting group; B constitutes a natural or non-natural nucleotide base moiety, and RH is selected from hydrogen and C$_{1-4}$-alkyl.

In some embodiments, the Locked Nucleic Acid (LNA) used in the oligonucleotides described herein comprises at least one Locked Nucleic Acid (LNA) unit according any of the formulas shown in Scheme 2 of PCT/DK2006/000512.

In some embodiments, the LNA used in the oligomer of the invention comprises internucleoside linkages selected from —O—P(O)$_2$—O—, —O—P(O,S)—O—, —O—P(S)$_2$—O—, —S—P(O)$_2$—O—, —S—P(O,S)—O—, —S—P(S)$_2$—O—, —O—P(O)$_2$—S—, —O—P(O,S)—S—, —S—P(O)$_2$—S—, —O—PO(R$^H$)—O—, O—PO (OCH$_3$)—O—, —O—PO(NR$^H$)—O—, —O—PO (OCH$_2$CH$_2$S—R)—O—, —O—PO(BH$_3$)—O—, —O—PO (NHR$^H$)—O—, —O—P(O)$_2$—NR$^H$—, —NR$^H$—P(O)$_2$—O—, —NR$^H$—CO—O—, where R$^H$ is selected from hydrogen and C$_{1-4}$-alkyl.

Specifically preferred LNA units are shown in scheme 2:

Scheme 2

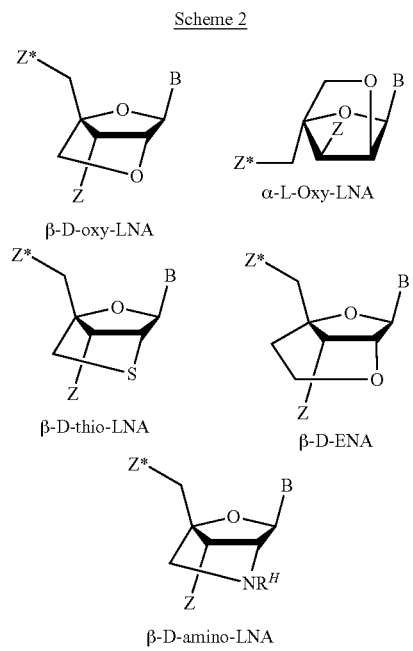

β-D-oxy-LNA  α-L-Oxy-LNA

β-D-thio-LNA  β-D-ENA

β-D-amino-LNA

The term "thio-LNA" comprises a locked nucleotide in which at least one of X or Y in the general formula above is selected from S or —CH$_2$—S—. Thio-LNA can be in both beta-D and alpha-L-configuration.

The term "amino-LNA" comprises a locked nucleotide in which at least one of X or Y in the general formula above is selected from —N(H)—, N(R)—, CH$_2$—N(H)—, and —CH$_2$—N(R)— where R is selected from hydrogen and C$_{1-4}$-alkyl. Amino-LNA can be in both beta-D and alpha-L-configuration.

The term "oxy-LNA" comprises a locked nucleotide in which at least one of X or Y in the general formula above represents —O— or —CH$_2$—O—. Oxy-LNA can be in both beta-D and alpha-L-configuration.

The term "ena-LNA" comprises a locked nucleotide in which Y in the general formula above is —CH$_2$—O— (where the oxygen atom of —CH$_2$—O— is attached to the 2'-position relative to the base B).

LNAs are described in additional detail herein.

One or more substituted sugar moieties can also be included, e.g., one of the following at the 2' position: OH, SH, SCH$_3$, F, OCN, OCH$_3$ OCH$_3$, OCH$_3$ O(CH$_2$)n CH$_3$, O(CH$_2$)n NH$_2$ or O(CH$_2$)n CH$_3$ where n is from 1 to about 10; C1 to C10 lower alkyl, alkoxyalkoxy, substituted lower alkyl, alkaryl or aralkyl; Cl; Br; CN; CF$_3$; OCF$_3$; O—, S—, or N-alkyl; O—, S—, or N-alkenyl; SOCH$_3$; SO$_2$ CH$_3$; ONO$_2$; NO$_2$; N$_3$; NH2; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. A preferred modification includes 2'-methoxyethoxy [2'-O—CH$_2$CH$_2$OCH$_3$, also known as 2'-O-(2-methoxyethyl)] (Martin et al, Helv. Chim. Acta, 1995, 78, 486). Other preferred modifications include 2'-methoxy (2'-O—CH$_3$), 2'-propoxy (2'-OCH$_2$ CH$_2$CH$_3$) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics such as cyclobutyls in place of the pentofuranosyl group.

Single stranded oligonucleotides can also include, additionally or alternatively, nucleobase (often referred to in the art simply as "base") modifications or substitutions. As used herein, "unmodified" or "natural" nucleobases include adenine (A), guanine (G), thymine (T), cytosine (C) and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2'-deoxycytosine and often referred to in the art as 5-Me-C), 5-hydroxymethylcytosine (HMC), glycosyl HMC and gentobiosyl HMC, isocytosine, pseudoisocytosine, as well as synthetic nucleobases, e.g., 2-aminoadenine, 2-(methylamino)adenine, 2-(imidazolylalkyl)adenine, 2-(aminoalkylamino)adenine or other heterosubstituted alkyladenines, 2-thiouracil, 2-thiothymine, 5-bromouracil, 5-hydroxymethyluracil, 5-propynyluracil, 8-azaguanine, 7-deazaguanine, N6 (6-aminohexyl)adenine, 6-aminopurine, 2-aminopurine, 2-chloro-6-aminopurine and 2,6-diaminopurine or other diaminopurines. See, e.g., Kornberg, "DNA Replication," W. H. Freeman & Co., San Francisco, 1980, pp 75-'7'7; and Gebeyehu, G., et al. Nucl. Acids Res., 15:4513 (1987)). A "universal" base known in the art, e.g., inosine, can also be included. 5-Me-C substitutions have been shown to increase nucleic acid duplex stability by 0.6-1.2° C. (Sanghvi, in Crooke, and Lebleu, eds., Antisense Research and Applications, CRC Press, Boca Raton, 1993, pp. 276-278) and may be used as base substitutions.

It is not necessary for all positions in a given oligonucleotide to be uniformly modified, and in fact more than one of the modifications described herein may be incorporated in a single oligonucleotide or even at within a single nucleoside within an oligonucleotide.

In some embodiments, both a sugar and an internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative United States patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al, Science, 1991, 254, 1497-1500.

Single stranded oligonucleotides can also include one or more nucleobase (often referred to in the art simply as "base") modifications or substitutions. As used herein, "unmodified" or "natural" nucleobases comprise the purine bases adenine (A) and guanine (G), and the pyrimidine bases thymine (T), cytosine (C) and uracil (U). Modified nucleobases comprise other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine and 3-deazaguanine and 3-deazaadenine.

Further, nucleobases comprise those disclosed in U.S. Pat. No. 3,687,808, those disclosed in "The Concise Encyclopedia of Polymer Science And Engineering", pages 858-859, Kroschwitz, ed. John Wiley & Sons, 1990; those disclosed by Englisch et al., Angewandle Chemie, International Edition, 1991, 30, page 613, and those disclosed by Sanghvi, Chapter 15, Antisense Research and Applications," pages 289-302, Crooke, and Lebleu, eds., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2<0>C (Sanghvi, et al., eds, "Antisense Research and Applications," CRC Press, Boca Raton, 1993, pp. 276-278) and are presently preferred base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,750,692, and 5,681,941, each of which is herein incorporated by reference.

In some embodiments, the single stranded oligonucleotides are chemically linked to one or more moieties or conjugates that enhance the activity, cellular distribution, or cellular uptake of the oligonucleotide. For example, one or more single stranded oligonucleotides, of the same or different types, can be conjugated to each other; or single stranded oligonucleotides can be conjugated to targeting moieties with enhanced specificity for a cell type or tissue type. Such moieties include, but are not limited to, lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al, Ann. N. Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Kabanov et al., FEBS Lett., 1990, 259, 327-330; Svinarchuk et al., Biochimie, 1993, 75, 49-54), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Mancharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-t oxycholesterol moiety (Crooke et al., J. Pharmacol. Exp. Ther., 1996, 277, 923-937). See also U.S. Pat. Nos. 4,828,979; 4,948,882; 5,218,105; 5,525,465; 5,541,313; 5,545,730; 5,552, 538; 5,578,717; 5,580,731; 5,580,731; 5,591,584; 5,109,124; 5,118,802; 5,138,045; 5,414,077; 5,486, 603; 5,512,439; 5,578,718; 5,608,046;

4,587,044; 4,605,735; 4,667,025; 4,762, 779; 4,789,737; 4,824,941; 4,835,263; 4,876,335; 4,904,582; 4,958,013; 5,082, 830; 5,112,963; 5,214,136; 5,082,830; 5,112,963; 5,214,136; 5, 245,022; 5,254,469; 5,258,506; 5,262,536; 5,272,250; 5,292,873; 5,317,098; 5,371,241, 5,391, 723; 5,416,203, 5,451,463; 5,510,475; 5,512,667; 5,514,785; 5, 565,552; 5,567,810; 5,574,142; 5,585,481; 5,587,371; 5,595,726; 5,597,696; 5,599,923; 5,599, 928 and 5,688,941, each of which is herein incorporated by reference.

These moieties or conjugates can include conjugate groups covalently bound to functional groups such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860, which are incorporated herein by reference. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

In some embodiments, single stranded oligonucleotide modification include modification of the 5' or 3' end of the oligonucleotide. In some embodiments, the 3' end of the oligonucleotide comprises a hydroxyl group or a thiophosphate. It should be appreciated that additional molecules (e.g. a biotin moiety or a fluorophor) can be conjugated to the 5' or 3' end of the single stranded oligonucleotide. In some embodiments, the single stranded oligonucleotide comprises a biotin moiety conjugated to the 5' nucleotide.

In some embodiments, the single stranded oligonucleotide comprises locked nucleic acids (LNA), ENA modified nucleotides, 2'-O-methyl nucleotides, or 2'-fluoro-deoxyribonucleotides. In some embodiments, the single stranded oligonucleotide comprises alternating deoxyribonucleotides and 2'-fluoro-deoxyribonucleotides. In some embodiments, the single stranded oligonucleotide comprises alternating deoxyribonucleotides and 2'-O-methyl nucleotides. In some embodiments, the single stranded oligonucleotide comprises alternating deoxyribonucleotides and ENA modified nucleotides. In some embodiments, the single stranded oligonucleotide comprises alternating deoxyribonucleotides and locked nucleic acid nucleotides. In some embodiments, the single stranded oligonucleotide comprises alternating locked nucleic acid nucleotides and 2'-O-methyl nucleotides.

In some embodiments, the 5' nucleotide of the oligonucleotide is a deoxyribonucleotide. In some embodiments, the 5' nucleotide of the oligonucleotide is a locked nucleic acid nucleotide. In some embodiments, the nucleotides of the oligonucleotide comprise deoxyribonucleotides flanked by at least one locked nucleic acid nucleotide on each of the 5' and 3' ends of the deoxyribonucleotides. In some embodiments, the nucleotide at the 3' position of the oligonucleotide has a 3' hydroxyl group or a 3' thiophosphate.

In some embodiments, the single stranded oligonucleotide comprises phosphorothioate internucleotide linkages. In some embodiments, the single stranded oligonucleotide comprises phosphorothioate internucleotide linkages between at least two nucleotides. In some embodiments, the single stranded oligonucleotide comprises phosphorothioate internucleotide linkages between all nucleotides.

It should be appreciated that the single stranded oligonucleotide can have any combination of modifications as described herein.

The oligonucleotide may comprise a nucleotide sequence having one or more of the following modification patterns.

(a) (X)Xxxxxx, (X)xXxxxx, (X)xxXxxx, (X)xxxXxx, (X)xxxxXx and (X)xxxxxX, (b) (X)XXxxxx, (X)XxXxxx, (X)XxxXxx, (X)XxxxXx, (X)XxxxxX, (X)xXXxxx, (X)xXxXxx, (X)xXxxXx, (X)xXxxxX, (X)xxXXxx, (X)xxXxXx, (X)xxXxxX, (X)xxxXXx, (X)xxxXxX and (X)xxxxXX, (c) (X)XXXxxx, (X)xXXXxx, (X)xxXXXx, (X)xxxXXX, (X)XXxXxx, (X)XXxxXx, (X)XXxxxX, (X)xXXxXx, (X)xXXxxX, (X)xxXXxX, (X)XxXXxx, (X)XxXxXx, (X)xXxXXx, (X)xXxxXX, (X)xxXxXX, (X)xXXxXX, (X)XxxXxX and (X)XxXxXx, (d) (X)xxXXX, (X)xXxXXX, (X)xXXxXX, (X)xXXXxX, (X)xXXXXx, (X)XxxXXX, (X)XxXxXX, (X)XxXXxX, (X)XxXXXx, (X)XXxxXX, (X)XXxXxX, (X)XXxXXx, (X)XXXxxX, (X)XXXxXx, (X)XXXXxx, and (X)XXXXxx, (e) (X)xXXXXX, (X)XxXXXX, (X)XXxXXX, (X)XXXxXX, (X)XXXXxX and (X)XXXXXx, and (f) XXXXXX, XxXXXXX, XXxXXXX, XXXxXXX, XXXXxXX, XXXXXxX and XXXXXXx, in which "X" denotes a nucleotide analogue, (X) denotes an optional nucleotide analogue, and "x" denotes a DNA or RNA nucleotide unit. Each of the above listed patterns may appear one or more times within an oligonucleotide, alone or in combination with any of the other disclosed modification patterns.

Methods for Modulating Gene Expression

In one aspect, the invention relates to methods for modulating gene expression in a cell (e.g., a cell for which MECP2 levels are reduced) for research purposes (e.g., to study the function of the gene in the cell). In another aspect, the invention relates to methods for modulating gene expression in a cell (e.g., a cell for which MECP2 levels are reduced) for gene or epigenetic therapy. The cells can be in vitro, ex vivo, or in vivo (e.g., in a subject who has a disease resulting from reduced expression or activity of MECP2. In some embodiments, methods for modulating gene expression in a cell comprise delivering a single stranded oligonucleotide as described herein. In some embodiments, delivery of the single stranded oligonucleotide to the cell results in a level of expression of gene that is at least 5%, 10%, 20%, 30%, 40%, 50%, 60%, 70%, 80%, 90%, 100%, 200% or more greater than a level of expression of gene in a control cell to which the single stranded oligonucleotide has not been delivered. In certain embodiments, delivery of the single stranded oligonucleotide to the cell results in a level of expression of gene that is at least 50% greater than a level of expression of gene in a control cell to which the single stranded oligonucleotide has not been delivered.

In another aspect of the invention, methods comprise administering to a subject (e.g. a human) a composition comprising a single stranded oligonucleotide as described herein to increase protein levels in the subject. In some embodiments, the increase in protein levels is at least 5%, 10%, 20%, 30%, 40%, 50%, 60%, 70%, 80%, 90%, 100%, 200%, or more, higher than the amount of a protein in the subject before administering.

As another example, to increase expression of MECP2 in a cell, the methods include introducing into the cell a single stranded oligonucleotide that is sufficiently complementary to a PRC2-associated region (e.g., of a long non-coding RNA) that maps to a genomic position encompassing or in proximity to the MECP2 gene.

In another aspect of the invention provides methods of treating a condition (e.g., Rett Syndrome, MECP2-related severe neonatal encephalopathy, Angelman syndrome, PPM-X syndrome) associated with decreased levels of expression of MECP2 in a subject, the method comprising administering a single stranded oligonucleotide as described herein.

A subject can include a non-human mammal, e.g. mouse, rat, guinea pig, rabbit, cat, dog, goat, cow, or horse. In preferred embodiments, a subject is a human. Single stranded oligonucleotides have been employed as therapeutic moieties in the treatment of disease states in animals, including humans. Single stranded oligonucleotides can be useful therapeutic modalities that can be configured to be useful in treatment regimes for the treatment of cells, tissues and animals, especially humans.

For therapeutics, an animal, preferably a human, suspected of having Rett Syndrome, MECP2-related severe neonatal encephalopathy, Angelman syndrome, or PPM-X syndrome is treated by administering single stranded oligonucleotide in accordance with this invention. For example, in one non-limiting embodiment, the methods comprise the step of administering to the animal in need of treatment, a therapeutically effective amount of a single stranded oligonucleotide as described herein.

Formulation, Delivery, and Dosing

The oligonucleotides described herein can be formulated for administration to a subject for treating a condition (e.g., Rett Syndrome, MECP2-related severe neonatal encephalopathy, Angelman syndrome, PPM-X syndrome) associated with decreased levels of MECP2. It should be understood that the formulations, compositions and methods can be practiced with any of the oligonucleotides disclosed herein.

The formulations may conveniently be presented in unit dosage form and may be prepared by any methods well known in the art of pharmacy. The amount of active ingredient (e.g., an oligonucleotide or compound of the invention) which can be combined with a carrier material to produce a single dosage form will vary depending upon the host being treated, the particular mode of administration, e.g., intradermal or inhalation. The amount of active ingredient which can be combined with a carrier material to produce a single dosage form will generally be that amount of the compound which produces a therapeutic effect, e.g. tumor regression.

Pharmaceutical formulations of this invention can be prepared according to any method known to the art for the manufacture of pharmaceuticals. Such formulations can contain sweetening agents, flavoring agents, coloring agents and preserving agents. A formulation can be admixtured with nontoxic pharmaceutically acceptable excipients which are suitable for manufacture. Formulations may comprise one or more diluents, emulsifiers, preservatives, buffers, excipients, etc. and may be provided in such forms as liquids, powders, emulsions, lyophilized powders, sprays, creams, lotions, controlled release formulations, tablets, pills, gels, on patches, in implants, etc.

A formulated single stranded oligonucleotide composition can assume a variety of states. In some examples, the composition is at least partially crystalline, uniformly crystalline, and/or anhydrous (e.g., less than 80, 50, 30, 20, or 10% water). In another example, the single stranded oligonucleotide is in an aqueous phase, e.g., in a solution that includes water. The aqueous phase or the crystalline compositions can, e.g., be incorporated into a delivery vehicle, e.g., a liposome (particularly for the aqueous phase) or a particle (e.g., a microparticle as can be appropriate for a crystalline composition). Generally, the single stranded oligonucleotide composition is formulated in a manner that is compatible with the intended method of administration.

In some embodiments, the composition is prepared by at least one of the following methods: spray drying, lyophilization, vacuum drying, evaporation, fluid bed drying, or a combination of these techniques; or sonication with a lipid, freeze-drying, condensation and other self-assembly.

A single stranded oligonucleotide preparation can be formulated or administered (together or separately) in combination with another agent, e.g., another therapeutic agent or an agent that stabilizes a single stranded oligonucleotide, e.g., a protein that complexes with single stranded oligonucleotide. Still other agents include chelators, e.g., EDTA (e.g., to remove divalent cations such as $Mg^{2+}$), salts, RNAse inhibitors (e.g., a broad specificity RNAse inhibitor such as RNAsin) and so forth.

In one embodiment, the single stranded oligonucleotide preparation includes another single stranded oligonucleotide, e.g., a second single stranded oligonucleotide that modulates expression of a second gene or a second single stranded oligonucleotide that modulates expression of the first gene. Still other preparation can include at least 3, 5, ten, twenty, fifty, or a hundred or more different single stranded oligonucleotide species. Such single stranded oligonucleotides can mediated gene expression with respect to a similar number of different genes. In one embodiment, the single stranded oligonucleotide preparation includes at least a second therapeutic agent (e.g., an agent other than an oligonucleotide).

Route of Delivery

A composition that includes a single stranded oligonucleotide can be delivered to a subject by a variety of routes. Exemplary routes include: intravenous, intradermal, topical, rectal, parenteral, anal, intravaginal, intranasal, pulmonary, ocular. The term "therapeutically effective amount" is the amount of oligonucleotide present in the composition that is needed to provide the desired level of MECP2 expression in the subject to be treated to give the anticipated physiological response. The term "physiologically effective amount" is that amount delivered to a subject to give the desired palliative or curative effect. The term "pharmaceutically acceptable carrier" means that the carrier can be administered to a subject with no significant adverse toxicological effects to the subject.

The single stranded oligonucleotide molecules of the invention can be incorporated into pharmaceutical compositions suitable for administration. Such compositions typically include one or more species of single stranded oligonucleotide and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The pharmaceutical compositions of the present invention may be administered in a number of ways depending upon whether local or systemic treatment is desired and upon the area to be treated. Administration may be topical (including ophthalmic, vaginal, rectal, intranasal, transdermal), oral or parenteral. Parenteral administration includes intravenous drip, subcutaneous, intraperitoneal or intramuscular injection, or intrathecal or intraventricular administration.

The route and site of administration may be chosen to enhance targeting. For example, to target muscle cells, intramuscular injection into the muscles of interest would be a logical choice. Lung cells might be targeted by administering the single stranded oligonucleotide in aerosol form. The vascular endothelial cells could be targeted by coating a balloon catheter with the single stranded oligonucleotide and mechanically introducing the oligonucleotide.

Topical administration refers to the delivery to a subject by contacting the formulation directly to a surface of the subject. The most common form of topical delivery is to the skin, but a composition disclosed herein can also be directly applied to other surfaces of the body, e.g., to the eye, a mucous membrane, to surfaces of a body cavity or to an internal surface. As mentioned above, the most common topical delivery is to the skin. The term encompasses several routes of administration including, but not limited to, topical and transdermal. These modes of administration typically include penetration of the skin's permeability barrier and efficient delivery to the target tissue or stratum. Topical administration can be used as a means to penetrate the epidermis and dermis and ultimately achieve systemic delivery of the composition. Topical administration can also be used as a means to selectively deliver oligonucleotides to the epidermis or dermis of a subject, or to specific strata thereof, or to an underlying tissue.

Formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful.

Transdermal delivery is a valuable route for the administration of lipid soluble therapeutics. The dermis is more permeable than the epidermis and therefore absorption is much more rapid through abraded, burned or denuded skin. Inflammation and other physiologic conditions that increase blood flow to the skin also enhance transdermal adsorption. Absorption via this route may be enhanced by the use of an oily vehicle (inunction) or through the use of one or more penetration enhancers. Other effective ways to deliver a composition disclosed herein via the transdermal route include hydration of the skin and the use of controlled release topical patches. The transdermal route provides a potentially effective means to deliver a composition disclosed herein for systemic and/or local therapy. In addition, iontophoresis (transfer of ionic solutes through biological membranes under the influence of an electric field), phonophoresis or sonophoresis (use of ultrasound to enhance the absorption of various therapeutic agents across biological membranes, notably the skin and the cornea), and optimization of vehicle characteristics relative to dose position and retention at the site of administration may be useful methods for enhancing the transport of topically applied compositions across skin and mucosal sites.

Both the oral and nasal membranes offer advantages over other routes of administration. For example, oligonucleotides administered through these membranes may have a rapid onset of action, provide therapeutic plasma levels, avoid first pass effect of hepatic metabolism, and avoid exposure of the oligonucleotides to the hostile gastrointestinal (GI) environment. Additional advantages include easy access to the membrane sites so that the oligonucleotide can be applied, localized and removed easily.

In oral delivery, compositions can be targeted to a surface of the oral cavity, e.g., to sublingual mucosa which includes the membrane of ventral surface of the tongue and the floor of the mouth or the buccal mucosa which constitutes the lining of the cheek. The sublingual mucosa is relatively permeable thus giving rapid absorption and acceptable bioavailability of many agents. Further, the sublingual mucosa is convenient, acceptable and easily accessible.

A pharmaceutical composition of single stranded oligonucleotide may also be administered to the buccal cavity of a human being by spraying into the cavity, without inhalation, from a metered dose spray dispenser, a mixed micellar pharmaceutical formulation as described above and a propellant. In one embodiment, the dispenser is first shaken prior to spraying the pharmaceutical formulation and propellant into the buccal cavity.

Compositions for oral administration include powders or granules, suspensions or solutions in water, syrups, slurries, emulsions, elixirs or non-aqueous media, tablets, capsules, lozenges, or troches. In the case of tablets, carriers that can be used include lactose, sodium citrate and salts of phosphoric acid. Various disintegrants such as starch, and lubricating agents such as magnesium stearate, sodium lauryl sulfate and talc, are commonly used in tablets. For oral administration in capsule form, useful diluents are lactose and high molecular weight polyethylene glycols. When aqueous suspensions are required for oral use, the nucleic acid compositions can be combined with emulsifying and suspending agents. If desired, certain sweetening and/or flavoring agents can be added.

Parenteral administration includes intravenous drip, subcutaneous, intraperitoneal or intramuscular injection, intrathecal or intraventricular administration. In some embodiments, parental administration involves administration directly to the site of disease (e.g. injection into a tumor).

Formulations for parenteral administration may include sterile aqueous solutions which may also contain buffers, diluents and other suitable additives. Intraventricular injection may be facilitated by an intraventricular catheter, for example, attached to a reservoir. For intravenous use, the total concentration of solutes should be controlled to render the preparation isotonic.

Any of the single stranded oligonucleotides described herein can be administered to ocular tissue. For example, the compositions can be applied to the surface of the eye or nearby tissue, e.g., the inside of the eyelid. For ocular administration, ointments or droppable liquids may be delivered by ocular delivery systems known to the art such as applicators or eye droppers. Such compositions can include mucomimetics such as hyaluronic acid, chondroitin sulfate, hydroxypropyl methylcellulose or poly(vinyl alcohol), preservatives such as sorbic acid, EDTA or benzylchronium chloride, and the usual quantities of diluents and/or carriers. The single stranded oligonucleotide can also be administered to the interior of the eye, and can be introduced by a needle or other delivery device which can introduce it to a selected area or structure.

Pulmonary delivery compositions can be delivered by inhalation by the patient of a dispersion so that the composition, preferably single stranded oligonucleotides, within the dispersion can reach the lung where it can be readily absorbed through the alveolar region directly into blood circulation. Pulmonary delivery can be effective both for systemic delivery and for localized delivery to treat diseases of the lungs.

Pulmonary delivery can be achieved by different approaches, including the use of nebulized, aerosolized, micellular and dry powder-based formulations. Delivery can be achieved with liquid nebulizers, aerosol-based inhalers, and dry powder dispersion devices. Metered-dose devices are preferred. One of the benefits of using an atomizer or inhaler is that the potential for contamination is minimized because the devices are self-contained. Dry powder dispersion devices, for example, deliver agents that may be readily formulated as dry powders. A single stranded oligonucleotide composition may be stably stored as lyophilized or spray-dried powders by itself or in combination with suitable powder carriers. The delivery of a composition for inhalation can be mediated by a dosing timing element which can include a timer, a dose counter, time measuring device, or a time indicator which when incorporated into the device enables dose tracking, compliance monitoring, and/or dose triggering to a patient during administration of the aerosol medicament.

The term "powder" means a composition that consists of finely dispersed solid particles that are free flowing and capable of being readily dispersed in an inhalation device and subsequently inhaled by a subject so that the particles reach the lungs to permit penetration into the alveoli. Thus, the powder is said to be "respirable." Preferably the average particle size is less than about 10 μm in diameter preferably with a relatively uniform spheroidal shape distribution. More preferably the diameter is less than about 7.5 μm and most preferably less than about 5.0 μm. Usually the particle size distribution is between about 0.1 μm and about 5 μm in diameter, particularly about 0.3 μm to about 5 μm.

The term "dry" means that the composition has a moisture content below about 10% by weight (% w) water, usually below about 5% w and preferably less it than about 3% w. A dry composition can be such that the particles are readily dispersible in an inhalation device to form an aerosol.

The types of pharmaceutical excipients that are useful as carrier include stabilizers such as human serum albumin (HSA), bulking agents such as carbohydrates, amino acids and polypeptides; pH adjusters or buffers; salts such as sodium chloride; and the like. These carriers may be in a crystalline or amorphous form or may be a mixture of the two.

Suitable pH adjusters or buffers include organic salts prepared from organic acids and bases, such as sodium citrate, sodium ascorbate, and the like; sodium citrate is preferred. Pulmonary administration of a micellar single stranded oligonucleotide formulation may be achieved through metered dose spray devices with propellants such as tetrafluoroethane, heptafluoroethane, dimethylfluoropropane, tetrafluoropropane, butane, isobutane, dimethyl ether and other non-CFC and CFC propellants.

Exemplary devices include devices which are introduced into the vasculature, e.g., devices inserted into the lumen of a vascular tissue, or which devices themselves form a part of the vasculature, including stents, catheters, heart valves, and other vascular devices. These devices, e.g., catheters or stents, can be placed in the vasculature of the lung, heart, or leg.

Other devices include non-vascular devices, e.g., devices implanted in the peritoneum, or in organ or glandular tissue, e.g., artificial organs. The device can release a therapeutic substance in addition to a single stranded oligonucleotide, e.g., a device can release insulin.

In one embodiment, unit doses or measured doses of a composition that includes single stranded oligonucleotide are dispensed by an implanted device. The device can include a sensor that monitors a parameter within a subject. For example, the device can include pump, e.g., and, optionally, associated electronics.

Tissue, e.g., cells or organs can be treated with a single stranded oligonucleotide, ex vivo and then administered or implanted in a subject. The tissue can be autologous, allogeneic, or xenogeneic tissue. E.g., tissue can be treated to reduce graft v. host disease. In other embodiments, the tissue is allogeneic and the tissue is treated to treat a disorder characterized by unwanted gene expression in that tissue. E.g., tissue, e.g., hematopoietic cells, e.g., bone marrow hematopoietic cells, can be treated to inhibit unwanted cell proliferation. Introduction of treated tissue, whether autologous or transplant, can be combined with other therapies. In some implementations, the single stranded oligonucleotide treated cells are insulated from other cells, e.g., by a semipermeable porous barrier that prevents the cells from leaving the implant, but enables molecules from the body to reach the cells and molecules produced by the cells to enter the body. In one embodiment, the porous barrier is formed from alginate.

In one embodiment, a contraceptive device is coated with or contains a single stranded oligonucleotide. Exemplary devices include condoms, diaphragms, IUD (implantable uterine devices, sponges, vaginal sheaths, and birth control devices.

Dosage

In one aspect, the invention features a method of administering a single stranded oligonucleotide (e.g., as a compound or as a component of a composition) to a subject (e.g., a human subject). In one embodiment, the unit dose is between about 10 mg and 25 mg per kg of bodyweight. In one embodiment, the unit dose is between about 1 mg and 100 mg per kg of bodyweight. In one embodiment, the unit dose is between about 0.1 mg and 500 mg per kg of bodyweight. In some embodiments, the unit dose is more than 0.001, 0.005, 0.01, 0.05, 0.1, 0.5, 1, 2, 5, 10, 25, 50 or 100 mg per kg of bodyweight.

The defined amount can be an amount effective to treat or prevent a disease or disorder, e.g., a disease or disorder associated with the MECP2. The unit dose, for example, can be administered by injection (e.g., intravenous or intramuscular), an inhaled dose, or a topical application.

In some embodiments, the unit dose is administered daily. In some embodiments, less frequently than once a day, e.g., less than every 2, 4, 8 or 30 days. In another embodiment, the unit dose is not administered with a frequency (e.g., not a regular frequency). For example, the unit dose may be administered a single time. In some embodiments, the unit dose is administered more than once a day, e.g., once an hour, two hours, four hours, eight hours, twelve hours, etc.

In one embodiment, a subject is administered an initial dose and one or more maintenance doses of a single stranded oligonucleotide. The maintenance dose or doses are generally lower than the initial dose, e.g., one-half less of the initial dose. A maintenance regimen can include treating the subject with a dose or doses ranging from 0.0001 to 100 mg/kg of body weight per day, e.g., 100, 10, 1, 0.1, 0.01, 0.001, or 0.0001 mg per kg of bodyweight per day. The maintenance doses may be administered no more than once every 1, 5, 10, or 30 days. Further, the treatment regimen may last for a period of time which will vary depending upon the nature of the particular disease, its severity and the overall condition of the patient. In some embodiments the dosage may be delivered no more than once per day, e.g., no more than once per 24, 36, 48, or more hours, e.g., no more than once for every 5 or 8 days. Following treatment, the patient can be monitored for changes in his condition and for alleviation of the symptoms of the disease state. The dosage of the oligonucleotide may either be increased in the event the patient does not respond significantly to current dosage levels, or the dose may be decreased if an alleviation of the symptoms of the disease state is observed, if the disease state has been ablated, or if undesired side-effects are observed.

The effective dose can be administered in a single dose or in two or more doses, as desired or considered appropriate under the specific circumstances. If desired to facilitate repeated or frequent infusions, implantation of a delivery device, e.g., a pump, semi-permanent stent (e.g., intravenous, intraperitoneal, intracisternal or intracapsular), or reservoir may be advisable.

In some embodiments, the oligonucleotide pharmaceutical composition includes a plurality of single stranded oligonucleotide species. In another embodiment, the single stranded oligonucleotide species has sequences that are non-overlapping and non-adjacent to another species with respect to a naturally occurring target sequence (e.g., a PRC2-associated region). In another embodiment, the plurality of single stranded oligonucleotide species is specific for different PRC2-associated regions. In another embodiment, the single stranded oligonucleotide is allele specific. In some cases, a patient is treated with a single stranded oligonucleotide in conjunction with other therapeutic modalities.

Following successful treatment, it may be desirable to have the patient undergo maintenance therapy to prevent the recurrence of the disease state, wherein the compound of the invention is administered in maintenance doses, ranging from 0.0001 mg to 100 mg per kg of body weight.

The concentration of the single stranded oligonucleotide composition is an amount sufficient to be effective in treating or preventing a disorder or to regulate a physiological condition in humans. The concentration or amount of single stranded oligonucleotide administered will depend on the parameters determined for the agent and the method of administration, e.g. nasal, buccal, pulmonary. For example, nasal formulations may tend to require much lower concentrations of some ingredients in order to avoid irritation or burning of the nasal passages. It is sometimes desirable to dilute an oral formulation up to 10-100 times in order to provide a suitable nasal formulation.

Certain factors may influence the dosage required to effectively treat a subject, including but not limited to the severity of the disease or disorder, previous treatments, the general health and/or age of the subject, and other diseases present. Moreover, treatment of a subject with a therapeutically effective amount of a single stranded oligonucleotide can include a single treatment or, preferably, can include a series of treatments. It will also be appreciated that the effective dosage of a single stranded oligonucleotide used for treatment may increase or decrease over the course of a particular treatment. For example, the subject can be monitored after administering a single stranded oligonucleotide composition. Based on information from the monitoring, an additional amount of the single stranded oligonucleotide composition can be administered.

Dosing is dependent on severity and responsiveness of the disease condition to be treated, with the course of treatment lasting from several days to several months, or until a cure is effected or a diminution of disease state is achieved. Optimal dosing schedules can be calculated from measurements of MECP2 expression levels in the body of the patient. Persons of ordinary skill can easily determine optimum dosages, dosing methodologies and repetition rates. Optimum dosages may vary depending on the relative potency of individual compounds, and can generally be estimated based on EC50s found to be effective in in vitro and in vivo animal models. In some embodiments, the animal models include transgenic animals that express a human MECP2. In another embodiment, the composition for testing includes a single stranded oligonucleotide that is complementary, at least in an internal region, to a sequence that is conserved between MECP2 in the animal model and the MECP2 in a human.

In one embodiment, the administration of the single stranded oligonucleotide composition is parenteral, e.g. intravenous (e.g., as a bolus or as a diffusible infusion), intradermal, intraperitoneal, intramuscular, intrathecal, intraventricular, intracranial, subcutaneous, transmucosal, buccal, sublingual, endoscopic, rectal, oral, vaginal, topical, pulmonary, intranasal, urethral or ocular. Administration can be provided by the subject or by another person, e.g., a health care provider. The composition can be provided in measured doses or in a dispenser which delivers a metered dose. Selected modes of delivery are discussed in more detail below.

Kits

In certain aspects of the invention, kits are provided, comprising a container housing a composition comprising a single stranded oligonucleotide. In some embodiments, the composition is a pharmaceutical composition comprising a single stranded oligonucleotide and a pharmaceutically acceptable carrier. In some embodiments, the individual components of the pharmaceutical composition may be provided in one container. Alternatively, it may be desirable to provide the components of the pharmaceutical composition separately in two or more containers, e.g., one container for single stranded oligonucleotides, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

The present invention is further illustrated by the following Examples, which in no way should be construed as further limiting. The entire contents of all of the references (including literature references, issued patents, published patent applications, and co-pending patent applications) cited throughout this application are hereby expressly incorporated by reference.

EXAMPLES

The invention is further described in the following examples, which do not limit the scope of the invention described in the claims.

Materials and Methods:

Real Time PCR

RNA is harvested from the cells using Promega SV 96 Total RNA Isolation system or Trizol omitting the DNAse step. RNA harvested from cells is normalized so that equal RNA is input to each reverse transcription reaction. Reverse transcriptase reactions are performed using the Superscript II kit and real time PCR performed on cDNA samples using icycler SYBR green chemistry (Biorad). A baseline level of mRNA expression for MECP2 is determined through quantitative PCR as outlined above. Baseline levels are also determined for mRNA of various housekeeping genes which are constitutively expressed. A "control" housekeeping gene with approximately the same level of baseline expression as the target gene is chosen for comparison purposes.

Cell Culture

Human hepatocyte Hep3B, human hepatocyte HepG2 cells, mouse hepatoma Hepa1-6 cells, and human renal proximal tubule epithelial cells (RPTEC) are cultured using conditions known in the art (see, e.g. Current Protocols in Cell Biology).

Oligonucleotide Design

Oligonucleotides were designed within PRC2-interacting regions in order to upregulate MECP2. The sequence and structure of each oligonucleotide is shown in Table 3. The following table provides a description of the nucleotide analogs, modifications and intranucleotide linkages used for certain oligonucleotides tested and described in Table 2.

In Vitro Transfection of Cells with Oligonucleotides

Oligonucleotides are designed within PRC2-interacting regions in order to upregulate MECP2. Cells are seeded into each well of 24-well plates at a density of 25,000 cells per 500 uL and transfections are performed with Lipofectamine and the single stranded oligonucleotides. Control wells contain Lipofectamine alone. At 48 hours post-transfection, approximately 200 uL of cell culture supernatants are stored at −80 C for ELISA. At 48 hours post-transfection, RNA is harvested from the cells and quantitative PCR is carried out as outlined above. The percent induction of target mRNA expression by each oligonucleotide is determined by normalizing mRNA levels in the presence of the oligonucleotide to the mRNA levels in the presence of control (Lipofectamine alone). This is compared side-by-side with the increase in mRNA expression of the "control" housekeeping gene.

In Vitro Delivery of Single Stranded Oligonucleotides

Oligonucleotides are designed as candidates for upregulating MECP2 expression.

The single stranded oligonucleotides are designed to be complementary to a PRC2-interacting region within a sequence as set forth in SEQ ID NO: 1 or 2. The oligonucleotides are tested in at least duplicate. Briefly, cells are transfected in vitro with each of the oligonucleotides as described above. MECP2 expression in cells following treatment is evaluated by qRT-PCR. Oligonucleotides that upregulate MECP2 expression are identified.

TABLE 1

Hexamers that are not seed sequences of human miRNAs

AAAAAA, AAAAAG, AAAACA, AAAAGA, AAAAGC, AAAAGG,
AAAAUA, AAACAA, AAACAC, AAACAG, AAACAU, AAACCC,
AAACCU, AAACGA, AAACGC, AAACGU, AAACUA, AAACUC,
AAACUU, AAAGAU, AAAGCC, AAAGGA, AAAGGG, AAAGUC,
AAAUAC, AAAUAU, AAAUCG, AAAUCU, AAAUGC, AAAUGU,
AAAUUA, AAAUUG, AACAAC, AACAAG, AACAAU, AACACA,
AACACG, AACAGA, AACAGC, AACAGG, AACAUC, AACAUG,
AACCAA, AACCAC, AACCAG, AACCAU, AACCCC, AACCCG,
AACCGA, AACCGC, AACCGG, AACCUA, AACCUU, AACGAA,
AACGAC, AACGAG, AACGAU, AACGCU, AACGGG, AACGGU,
AACGUA, AACGUC, AACGUG, AACGUU, AACUAU, AACUCA,
AACUCC, AACUCG, AACUGA, AACUGC, AACUGU, AACUUA,
AACUUC, AACUUG, AACUUU, AAGAAA, AAGAAG, AAGAAU,
AAGACG, AAGAGA, AAGAGC, AAGAGG, AAGAGU, AAGAUU,
AAGCAA, AAGCAC, AAGCAG, AAGCAU, AAGCCA, AAGCCC,
AAGCCG, AAGCCU, AAGCGA, AAGCGG, AAGCGU, AAGCUA,
AAGGAA, AAGGAC, AAGGCU, AAGGGC, AAGGGU, AAGGUU,
AAGUAA, AAGUAC, AAGUAU, AAGUCC, AAGUCG, AAGUGA,
AAGUGG, AAGUUA, AAGUUU, AAUAAA, AAUAAC, AAUAAG,
AAUAAU, AAUACA, AAUACC, AAUACG, AAUAGA, AAUAGC,
AAUAGG, AAUAGU, AAUAUC, AAUAUU, AAUCAA, AAUCAU,
AAUCCA, AAUCCC, AAUCCG, AAUCGA, AAUCGC, AAUCGU,
AAUCUA, AAUCUG, AAUCUU, AAUGAA, AAUGAC, AAUGAG,
AAUGAU, AAUGCG, AAUGCU, AAUGGA, AAUGGU, AAUGUA,
AAUGUC, AAUGUG, AAUUAA, AAUUAC, AAUUAG, AAUUCC,
AAUUCG, AAUUGA, AAUUGG, AAUUGU, AAUUUC, AAUUUG,
ACAAAA, ACAAAC, ACAAAG, ACAAAU, ACAACC, ACAACG,
ACAACU, ACAAGA, ACAAGC, ACAAGU, ACAAUC, ACAAUG,
ACAAUU, ACACAG, ACACCA, ACACCC, ACACCG, ACACCU,
ACACGA, ACACGC, ACACGU, ACACUC, ACACUG, ACACUU,
ACAGAA, ACAGAC, ACAGCC, ACAGCG, ACAGCU, ACAGGG,
ACAGUC, ACAGUG, ACAGUU, ACAUAA, ACAUAC, ACAUCC,
ACAUCG, ACAUCU, ACAUGA, ACAUGC, ACAUGU, ACAUUG,
ACAUUU, ACCAAA, ACCAAC, ACCAAG, ACCAAU, ACCACC,
ACCACG, ACCAGA, ACCAGU, ACCAUA, ACCAUG, ACCAUU,
ACCCAA, ACCCAC, ACCCCA, ACCCCG, ACCCGA, ACCCGC,
ACCCUA, ACCCUC, ACCCUU, ACCGAA, ACCGAC, ACCGAU,
ACCGCA, ACCGCC, ACCGCG, ACCGCU, ACCGGA, ACCGGC,
ACCGGU, ACCGUA, ACCGUC, ACCGUG, ACCGUU, ACCUAA,
ACCUAC, ACCUAG, ACCUAU, ACCUCA, ACCUCC, ACCUCG,
ACCUCU, ACCUGA, ACCUGC, ACCUGU, ACCUUA, ACCUUC,
ACCUUU, ACGAAA, ACGAAC, ACGAAG, ACGAAU, ACGACA,
ACGACC, ACGACG, ACGACU, ACGAGA, ACGAGC, ACGAGG,
ACGAGU, ACGAUA, ACGAUC, ACGAUG, ACGAUU, ACGCAA,
ACGCAG, ACGCAU, ACGCCC, ACGCCG, ACGCCU, ACGCGA,
ACGCGG, ACGCGU, ACGCUA, ACGCUG, ACGCUU, ACGGAA,
ACGGAC, ACGGAG, ACGGAU, ACGGCC, ACGGCG, ACGGCU,
ACGGGC, ACGGGG, ACGGGU, ACGGUA, ACGGUC, ACGGUG,
ACGUU, ACGUAA, ACGUAC, ACGUAU, ACGUCC, ACGUCG,
ACGUCU, ACGUGA, ACGUGC, ACGUGG, ACGUGU, ACGUUA,
ACGUUC, ACGUUG, ACGUUU, ACUAAA, ACUAAG, ACUAAU,
ACUACA, ACUACC, ACUACG, ACUACU, ACUAGG, ACUAUC,
ACUAUG, ACUAUU, ACUCAU, ACUCCC, ACUCCG, ACUCCU,
ACUCGA, ACUCGC, ACUCGG, ACUCUC, ACUCUU, ACUGAG,
ACUGAU, ACUGCC, ACUGCG, ACUGCU, ACUGGG, ACUGGU,
ACUGUC, ACUUAA, ACUUAC, ACUUAU, ACUUCA, ACUUCC,
ACUUCG, ACUUCU, ACUUGA, ACUUGU, ACUUGU, ACUUUA,
ACUUUC, ACUUUG, AGAAAA, AGAAAC, AGAAAG, AGAACC,
AGAACG, AGAACU, AGAAGC, AGAAGU, AGAAUA, AGAAUC,
AGAAUG, AGAAUU, AGACAA, AGACAC, AGACAU, AGACCA,
AGACCC, AGACCG, AGACCU, AGACGA, AGACGC, AGACGU,
AGACUA, AGACUC, AGACUU, AGAGAC, AGAGAG, AGAGAU,
AGAGCC, AGAGCG, AGAGCU, AGAGGC, AGAGGG, AGAGGU,
AGAGUA, AGAGUU, AGAUAC, AGAUAG, AGAUAU, AGAUCC,
AGAUCG, AGAUCU, AGAUGA, AGAUGC, AGAUGG, AGAUUA,
AGAUUC, AGAUUG, AGAUUU, AGCAAC, AGCACA, AGCACG,
AGCACU, AGCAGA, AGCAUA, AGCAUC, AGCAUG, AGCCAA,
AGCCAU, AGCCCA, AGCCGA, AGCCGC, AGCCGG, AGCCGU,
AGCCUA, AGCCUC, AGCGAA, AGCGAG, AGCGAU, AGCGCA,
AGCGCC, AGCGCG, AGCGCU, AGCGGA, AGCGGC, AGCGGU,

TABLE 1-continued

Hexamers that are not seed sequences of human miRNAs

AGCGUA, AGCGUC, AGCGUG, AGCGUU, AGCUAA, AGCUAC,
AGCUAG, AGCUAU, AGCUCA, AGCUCC, AGCUCG, AGCUCU,
AGCUGA, AGCUGG, AGCUGU, AGCUUC, AGCUUU, AGGAAU,
AGGACC, AGGACG, AGGAGA, AGGAGU, AGGAUA, AGGCAA,
AGGCAU, AGGCCG, AGGCGA, AGGCGC, AGGCGG, AGGCUA,
AGGCUC, AGGCUU, AGGGAC, AGGGAU, AGGGGA, AGGGGU,
AGGGUA, AGGGUG, AGGUAA, AGGUAC, AGGUCA, AGGUCC,
AGGUCU, AGGUGA, AGGUGC, AGGUGG, AGGUGU, AGGUUC,
AGGUUG, AGUAAA, AGUAAG, AGUAAU, AGUACA, AGUACG,
AGUAGC, AGUAGG, AGUAUA, AGUAUC, AGUAUG, AGUAUU,
AGUCAA, AGUCAC, AGUCAG, AGUCAU, AGUCCA, AGUCCG,
AGUCCU, AGUCGA, AGUCGC, AGUCGG, AGUCGU, AGUCUA,
AGUCUC, AGUCUG, AGUCUU, AGUGAA, AGUGAC, AGUGCG,
AGUGGG, AGUGUC, AGUUAA, AGUUAC, AGUUAG, AGUUCC,
AGUUCG, AGUUGA, AGUUGC, AGUUGU, AGUUUA, AGUUUC,
AGUUUG, AGUUUU, AUAAAC, AUAAAU, AUAACA, AUAACC,
AUAACG, AUAACU, AUAAGA, AUAAGC, AUAAGG, AUAAGU,
AUAAUC, AUAAUG, AUAAUU, AUACAC, AUACAG, AUACAU,
AUACCA, AUACCC, AUACCG, AUACGA, AUACGC, AUACGG,
AUACGU, AUACUA, AUACUC, AUACUG, AUACUU, AUAGAA,
AUAGAC, AUAGAU, AUAGCA, AUAGCG, AUAGCU, AUAGGA,
AUAGGU, AUAGUA, AUAGUC, AUAGUG, AUAGUU, AUAUAC,
AUAUAG, AUAUCA, AUAUCC, AUAUCG, AUAUCU, AUAUGA, AUAUGC,
AUAUGG, AUAUGU, AUAUUC, AUAUUG, AUAUUU, AUCAAA,
AUCAAC, AUCAAG, AUCAAU, AUCACA, AUCACC, AUCACG,
AUCAGC, AUCAGG, AUCCAA, AUCCAU, AUCCCA, AUCCCG,
AUCCGA, AUCCGC, AUCCGG, AUCCUA, AUCCUC, AUCCUG,
AUCGAA, AUCGAC, AUCGAG, AUCGAU, AUCGCA, AUCGCC,
AUCGCG, AUCGCU, AUCGGC, AUCGGG, AUCGGU, AUCGUC,
AUCGUG, AUCGUU, AUCUAA, AUCUAC, AUCUAG, AUCUAU,
AUCUCC, AUCUCG, AUCUGU, AUCUUG, AUCUUU, AUGAAA,
AUGAAC, AUGAAG, AUGAAU, AUGACC, AUGACU, AUGAGG,
AUGAGU, AUGAUA, AUGAUC, AUGAUU, AUGCAA, AUGCAG,
AUGCCA, AUGCCC, AUGCCG, AUGCGA, AUGCGG, AUGCGU,
AUGCUC, AUGCUU, AUGGAC, AUGGCC, AUGGGA, AUGGGC,
AUGGGU, AUGGUC, AUGGUG, AUGUAC, AUGUAU, AUGUCA,
AUGUCC, AUGUCG, AUGUGU, AUGUUA, AUGUUC, AUUAAA,
AUUAAC, AUUAAG, AUUAAU, AUUACA, AUUACC, AUUACG,
AUUACU, AUUAGA, AUUAGC, AUUAGG, AUUAGU, AUUAUC,
AUUAUG, AUUCAC, AUUCCA, AUUCCG, AUUCCU,
AUUCGA, AUUCGC, AUUCGG, AUUCGU, AUUCUA, AUUCUC,
AUUCUU, AUUGAA, AUUGAC, AUUGAU, AUUGCC, AUUGCG,
AUUGCU, AUUGGA, AUUGGC, AUUGGU, AUUUAA, AUUUAG, AUUUAU,
AUUGUC, AUUGUG, AUUGUU, AUUUAA, AUUUAG, AUUUAU,
AUUUCC, AUUUCG, AUUUCU, AUUUGA, AUUUGC, AUUUGU,
AUUUUA, AUUUUC, AUUUUG, AUUUUU, CAAAAG, CAAACA,
CAAACC, CAAACG, CAAAGA, CAAAGG, CAAAUA,
CAAAUU, CAACAC, CAACAU, CAACCA, CAACCC, CAACCG,
CAACGA, CAACGC, CAACGG, CAACGU, CAACUA, CAACUC,
CAACUG, CAACUU, CAAGAA, CAAGAC, CAAGAU, CAAGCA,
CAAGCC, CAAGCG, CAAGCU, CAAGGA, CAAGGG, CAAGUC,
CAAGUG, CAAGUU, CAAUAA, CAAUAC, CAAUAG, CAAUCC,
CAAUCG, CAAUCU, CAAUGA, CAAUGC, CAAUGG, CAAUGU,
CAAUUC, CAAUUG, CAAUUU, CACAAU, CACACA, CACACG,
CACACU, CACAGA, CACAGG, CACAGU, CACAUA, CACAUC,
CACAUU, CACCAA, CACCAC, CACCAU, CACCCA, CACCCC,
CACCCG, CACCGA, CACCGC, CACCGG, CACCGU, CACCUA,
CACCUU, CACGAA, CACGAC, CACGAG, CACGAU, CACGCA,
CACGCC, CACGCU, CACGGA, CACGGC, CACGGG, CACGGU,
CACGUA, CACGUC, CACGUG, CACGUU, CACUAA, CACUAG,
CACUAU, CACUCA, CACUCG, CACUGA, CACUGC, CACUGG,
CACUUA, CACUUC, CACUUU, CAGAAA, CAGAAG, CAGAAU,
CAGACC, CAGACG, CAGAGC, CAGAUA, CAGAUC, CAGCCG,
CAGCCU, CAGCGA, CAGCGC, CAGCGG, CAGCGU, CAGCUC,
CAGCUU, CAGGAU, CAGGGG, CAGGGU, CAGGUA, CAGGUC,
CAGGUU, CAGUAC, CAGUCG, CAGUUG, CAUAAA, CAUAAC,
CAUAAG, CAUAAU, CAUACA, CAUACC, CAUACG, CAUACU,
CAUAGA, CAUAGG, CAUAGU, CAUAUA, CAUAUC, CAUAUG,
CAUCAA, CAUCAC, CAUCAG, CAUCAU, CAUCCA, CAUCCC,
CAUCCG, CAUCGA, CAUCGC, CAUCGG, CAUCGU, CAUCUA,
CAUCUC, CAUCUG, CAUCUU, CAUGAA, CAUGAC, CAUGAG,
CAUGAU, CAUGCA, CAUGCG, CAUGCU, CAUGGC, CAUGGU,
CAUGGG, CAUGGU, CAUGUA, CAUGUC, CAUGUU, CAUUAA,
CAUUAC, CAUUAG, CAUUCA, CAUUCC, CAUUCG, CAUUCU,
CAUUGA, CAUUGG, CAUUUC, CAUUUG, CAUUUU, CCAAAA,
CCAAAC, CCAAAG, CCAAAU, CCAACA, CCAACC, CCAACG,
CCAACU, CCAAGA, CCAAGC, CCAAGG, CCAAUC, CCAAUG,
CCAAUU, CCACAA, CCACAC, CCACAG, CCACAU, CCACCA,
CCACCC, CCACCG, CCACCU, CCACGA, CCACGC, CCACGG,
CCACGU, CCACUA, CCACUC, CCACUU, CCAGAA, CCAGAC,
CCAGAG, CCAGCC, CCAGGU, CCAGUC, CCAGUU, CCAUAA,
CCAUAC, CCAUAG, CCAUAU, CCAUCA, CCAUCC, CCAUCU,
CCAUGA, CCAUGC, CCAUGG, CCAUUC, CCAUUG, CCAUUU,
CCCAAC, CCCAAG, CCCAAU, CCCACA, CCCAGA, CCCAGC,
CCCAGU, CCCAUA, CCCAUC, CCCAUG, CCCAUU, CCCCAA,
CCCCAG, CCCCAU, CCCCCC, CCCCCG, CCCCCU, CCCCGA,
CCCCGC, CCCCGU, CCCCUA, CCCCUC, CCCGAA, CCCGAC,
CCCGAU, CCCGCA, CCCGCU, CCCGGA, CCCGGC, CCCGUA,
CCCGUG, CCCGUU, CCCUAA, CCCUAG, CCCUCA, CCCUCU,
CCCUGC, CCCUUA, CCCUUC, CCCUUU, CCGAAA, CCGAAC,
CCGAAU, CCGACA, CCGACC, CCGACG, CCGACU, CCGAGA,
CCGAGG, CCGAGU, CCGAUA, CCGAUC, CCGAUG, CCGAUU,
CCGCAA, CCGCAC, CCGCAG, CCGCAU, CCGCCA, CCGCCC,
CCGCCG, CCGCCU, CCGCGA, CCGCGC, CCGCGG, CCGCGU,
CCGCUA, CCGCUC, CCGCUG, CCGCUU, CCGGAA, CCGGAU,
CCGGCA, CCGGCC, CCGGCG, CCGGCU, CCGGGA, CCGGGC,
CCGGGG, CCGGGU, CCGGUA, CCGGUC, CCGGUG, CCGUAA,
CCGUAG, CCGUAU, CCGUCA, CCGUCC, CCGUCG, CCGUGA,
CCGUAG, CCGUGA, CCGUUC, CCGUUG, CCGUUU, CCUAAC,
CCUAAG, CCUAAU, CCUACA, CCUACC, CCUACG, CCUACU,
CCUAGA, CCUAGC, CCUAGG, CCUAGU, CCUAUA, CCUAUC,
CCUAUG, CCUAUU, CCUCAA, CCUCAC, CCUCAG, CCUCAU,
CCUCCA, CCUCCC, CCUCCG, CCUCGA, CCUCGC, CCUCGG,
CCUCGU, CCUCUA, CCUCUG, CCUGAC, CCUGAU, CCUGCA,
CCUGGG, CCUGGU, CCUGUU, CCUUAA, CCUUAC, CCUUAG,
CCUUAU, CCUUCG, CCUUGA, CCUUGU, CCUUUA, CCUUUC,
CCUUUU, CGAAAA, CGAAAG, CGAAAU, CGAACA, CGAACC,
CGAACG, CGAACU, CGAAGA, CGAAGC, CGAAGG,
CGAAGU, CGAAUA, CGAAUC, CGAAUG, CGAAUU, CGACAA,
CGACAC, CGACAU, CGACCA, CGACCU, CGACGA, CGACGC,
CGACGG, CGACGU, CGACUA, CGACUG, CGACUU, CGAGAA,
CGAGAC, CGAGAG, CGAGAU, CGAGCA, CGAGCC, CGAGCG,
CGAGCU, CGAGGC, CGAGGG, CGAGGU, CGAGUA, CGAGUC,
CGAGUG, CGAGUU, CGAUAA, CGAUAC, CGAUAG, CGAUAU,
CGAUCA, CGAUCC, CGAUCG, CGAUCU, CGAUGA, CGAUGC,
CGAUGG, CGAUGU, CGAUUA, CGAUUC, CGAUUG, CGAUUU,
CGCAAA, CGCAAC, CGCAAG, CGCAAU, CGCACA, CGCACC,
CGCACG, CGCAGA, CGCAGC, CGCAGG, CGCAGU, CGCAUA,
CGCAUC, CGCAUG, CGCAUU, CGCCAA, CGCCAC, CGCCAG,
CGCCAU, CGCCCA, CGCCCC, CGCCCG, CGCCGA, CGCCGC,
CGCCGG, CGCCGU, CGCCUA, CGCCUG, CGCCUU, CGCGAA,
CGCGAC, CGCGAG, CGCGAU, CGCGCA, CGCGCC, CGCGCG,
CGCGCU, CGCGGA, CGCGGC, CGCGGG, CGCGGU, CGCGUA,
CGCGUC, CGCGUG, CGCGUU, CGCUAA, CGCUAC, CGCUAG,
CGCUAU, CGCUCA, CGCUCC, CGCUCG, CGCUCU, CGCUGA,
CGCUGC, CGCUGG, CGCUGU, CGCUUA, CGCUUC, CGCUUG,
CGGAAA, CGGAAC, CGGAAG, CGGACA, CGGACC, CGGACG,
CGGACU, CGGAGC, CGGAGG, CGGAGU, CGGAUA, CGGAUU,
CGGCAA, CGGCAC, CGGCAG, CGGCCA, CGGCCC, CGGCCG,
CGGCGC, CGGCGG, CGGCGU, CGGCUA, CGGCUC, CGGCUG,
CGGCUU, CGGGAA, CGGGAC, CGGGAG, CGGGAU, CGGGCA,
CGGGCC, CGGGCG, CGGGCU, CGGGGA, CGGGUA, CGGGUC,
CGGGUG, CGGUAA, CGGUAC, CGGUAG, CGGUAU, CGGUCA,
CGGUCG, CGGUCU, CGGUGA, CGGUGG, CGGUGU, CGGUUA,
CGGUUC, CGGUUG, CGGUUU, CGUAAA, CGUAAC, CGUAAG,
CGUAAU, CGUACA, CGUACG, CGUACU, CGUAGA, CGUAGC,
CGUAGG, CGUAGU, CGUAUA, CGUAUC, CGUAUG, CGUAUU,
CGUCAA, CGUCAC, CGUCAG, CGUCAU, CGUCCA, CGUCCC,
CGUCCG, CGUCCU, CGUCGA, CGUCGG, CGUCGU, CGUCUA,
CGUCUC, CGUCUG, CGUCUU, CGUGAA, CGUGAC, CGUGAG,
CGUGAU, CGUGCC, CGUGCU, CGUGCU, CGUGGA, CGUGGG,
CGUGGU, CGUGUA, CGUGUG, CGUUAA, CGUUAC, CGUUAG,
CGUUAU, CGUUCA, CGUUCC, CGUUCG, CGUUCU, CGUUGA,
CGUUGC, CGUUGU, CGUUUA, CGUUUC, CGUUUU, CUAAAA,
CUAAAC, CUAAAU, CUAACA, CUAACC, CUAACG, CUAACU,
CUAAGA, CUAAGC, CUAAGU, CUAAUA, CUAAUC, CUAAUG,
CUACAC, CUACAU, CUACCA, CUACCC, CUACCG, CUACCU,
CUACGA, CUACGC, CUACGG, CUACGU, CUACUA, CUACUC,
CUACUG, CUAGAA, CUAGAC, CUAGAG, CUAGCA, CUAGCC,
CUAGCG, CUAGCU, CUAGGA, CUAGGG, CUAGGU, CUAGUG,
CUAGUU, CUAUAA, CUAUAG, CUAUAU, CUAUCA, CUAUCC,
CUAUCG, CUAUCU, CUAUGA, CUAUGC, CUAUGG, CUAUGU,
CUAUUA, CUAUUG, CUCAAC, CUCAAG, CUCAAU, CUCACC,
CUCACG, CUCAGC, CUCAUA, CUCAUC, CUCAUG, CUCAUU,

TABLE 1-continued

Hexamers that are not seed sequences of human miRNAs

CUCCAC, CUCCCC, CUCCCG, CUCCGA, CUCCGC, CUCCGG, CUCCUA, CUCCUC, CUCCUU, CUCGAA, CUCGAC, CUCGAG, CUCGAU, CUCGCA, CUCGCC, CUCGCG, CUCGGG, CUCGGU, CUCGUA, CUCGUC, CUCGUG, CUCGUU, CUCUAA, CUCUAC, CUCUAU, CUCUCA, CUCUCC, CUCUCU, CUCUGC, CUCUGU, CUCUUA, CUCUUG, CUGAAG, CUGACC, CUGAGC, CUGAUA, CUGAUC, CUGCCG, CUGCCU, CUGCGA, CUGCUA, CUGCUU, CUGGAG, CUGGAU, CUGGCG, CUGGGU, CUGUAC, CUGUCA, CUGUCC, CUGUCG, CUGUGG, CUGUGU, CUGUUA, CUGUUU, CUUAAC, CUUAAG, CUUAAU, CUUACC, CUUACG, CUUAGA, CUUAGC, CUUAGG, CUUAGU, CUUAUA, CUUAUC, CUUAUG, CUUAUU, CUUCAG, CUUCAU, CUUCCA, CUUCCC, CUUCCG, CUUCCU, CUUCGA, CUUCGC, CUUCGG, CUUCGU, CUUCUA, CUUGAC, CUUGAG, CUUGAU, CUUGCA, CUUGCC, CUUGCG, CUUGCU, CUUGGC, CUUGGU, CUUGUU, CUUUAC, CUUUAG, CUUUAU, CUUUCA, CUUUCG, CUUUCU, CUUUGA, CUUUGC, CUUUGU, CUUUUA, CUUUUC, CUUUUG, CUUUUU, GAAAAA, GAAAAG, GAAACC, GAAACG, GAAAGA, GAAAGC, GAAAGU, GAAAUA, GAAAUC, GAAAUG, GAAAUU, GAACAA, GAACAC, GAACAG, GAACAU, GAACCA, GAACCC, GAACCG, GAACCU, GAACGA, GAACGC, GAACGG, GAACGU, GAACUA, GAACUG, GAACUU, GAAGAC, GAAGAG, GAAGCA, GAAGCG, GAAGCU, GAAGUC, GAAUAA, GAAUAC, GAAUAG, GAAUAU, GAAUCC, GAAUCG, GAAUCU, GAAUGA, GAAUGC, GAAUGU, GAAUUA, GAAUUC, GAAUUU, GACAAA, GACAAG, GACAAU, GACACC, GACAGA, GACAGG, GACAUA, GACAUG, GACAUU, GACCAA, GACCAC, GACCAG, GACCCA, GACCCC, GACCCG, GACCGC, GACCGG, GACCGU, GACCUA, GACCUC, GACCUU, GACGAA, GACGAC, GACGAG, GACGAU, GACGCA, GACGCC, GACGCG, GACGCU, GACGGA, GACGGC, GACGGU, GACGUA, GACGUC, GACGUG, GACGUU, GACUAA, GACUAC, GACUAG, GACUAU, GACUCA, GACUCC, GACUCG, GACUGG, GACUGU, GACUUA, GACUUG, GACUUU, GAGAAU, GAGAGA, GAGAGC, GAGAGG, GAGAUA, GAGAUC, GAGCAA, GAGCAU, GAGCCA, GAGCCG, GAGCGG, GAGCGU, GAGGGU, GAGGUC, GAGGUG, GAGUAA, GAGUAG, GAGUCC, GAGUUC, GAGUUU, GAUAAA, GAUAAC, GAUAAG, GAUAAU, GAUACA, GAUACC, GAUACG, GAUACU, GAUAGA, GAUAGC, GAUAGG, GAUAGU, GAUAUA, GAUCAA, GAUCAC, GAUCAG, GAUCCA, GAUCCC, GAUCCU, GAUCGC, GAUCGG, GAUCGU, GAUCUA, GAUCUG, GAUCUU, GAUGAA, GAUGAC, GAUGAG, GAUGCA, GAUGCC, GAUGCG, GAUGCU, GAUGGC, GAUGGG, GAUGGU, GAUGUG, GAUGUU, GAUUAA, GAUUAU, GAUUCA, GAUUCG, GAUUCU, GAUUGA, GAUUGC, GAUUUA, GAUUUC, GAUUUG, GAUUUU, GCAAAC, GCAAAG, GCAAAU, GCAACA, GCAACC, GCAAGC, GCAAGU, GCAAUA, GCAAUC, GCAAUG, GCAAUU, GCACAA, GCACAC, GCACAG, GCACCC, GCACCG, GCACCU, GCACGA, GCACGC, GCACGU, GCACUA, GCACUC, GCACUG, GCACUU, GCAGAU, GCAGCC, GCAGCG, GCAGGC, GCAGUA, GCAGUC, GCAGUG, GCAGUU, GCAUAA, GCAUAG, GCAUAU, GCAUCG, GCAUCU, GCAUGA, GCAUGC, GCAUGG, GCAUGU, GCAUUA, GCAUUC, GCAUUG, GCAUUU, GCCAAA, GCCAAC, GCCAAU, GCCACA, GCCACC, GCCACG, GCCAGA, GCCAGU, GCCAUA, GCCAUC, GCCAUG, GCCAUU, GCCCAA, GCCCAC, GCCCAG, GCCCCG, GCCCGA, GCCCGU, GCCGAA, GCCGAC, GCCGAG, GCCGAU, GCCGCA, GCCGCU, GCCGGA, GCCGGC, GCCGGG, GCCGGU, GCCGUA, GCCGUC, GCCGUG, GCCGUU, GCCUAA, GCCUAU, GCCUCA, GCCUCC, GCCUCG, GCCUGA, GCCUUA, GCCUAU, GCCUUU, GCGAAA, GCGAAC, GCGACA, GCGACU, GCGACC, GCGACG, GCGACU, GCGAGA, GCGAGC, GCGAGG, GCGAGU, GCGAUA, GCGAUC, GCGAUG, GCGAUU, GCGCAA, GCGCAC, GCGCAG, GCGCAU, GCGCCA, GCGCCC, GCGCCU, GCGCGA, GCGCGU, GCGCUA, GCGCUC, GCGCUG, GCGCUU, GCGGAA, GCGGAC, GCGGAU, GCGGCA, GCGGCC, GCGGCU, GCGGGA, GCGGUA, GCGGUC, GCGGUU, GCGUAA, GCGUAC, GCGUAG, GCGUAU, GCGUCA, GCGUCC, GCGUCG, GCGUCU, GCGUGA, GCGUGC, GCGUGG, GCGUGU, GCGUUA, GCGUUC, GCGUUG, GCGUUU, GCUAAC, GCUAAG, GCUAAU, GCUACC, GCUACG, GCUACU, GCUAGA, GCUAGG, GCUAGU, GCUAUA, GCUAUC, GCUAUU, GCUCAA, GCUCAC, GCUCAG, GCUCAU, GCUCCA, GCUCCC, GCUCCG, GCUCCU, GCUCGA, GCUCGC, GCUCGU, GCUCUC, GCUCUU, GCUGAA, GCUGAC, GCUGCA, GCUGCC, GCUGCG, GCUGCU, GCUGUG, GCUGUU, GCUUAC, GCUUAG, GCUUAU, GCUUCA, GCUUCG, GCUUGA, GCUUGG, GCUUGU, GCUUUA, GCUUUG, GGAAAG, GGAACA, GGAACC, GGAACG, GGAACU, GGAAGU, GGAAUA, GGAAUC, GGAAUU, GGACAA, GGACAC, GGACAG, GGACAU, GGACCG, GGACGA, GGACGC, GGACGU, GGACUA, GGACUC, GGACUU, GGAGAC, GGAGCA, GGAGCG, GGAGGG, GGAGUA, GGAUAA, GGAUAC, GGAUCA, GGAUCC, GGAUCG, GGAUCU, GGAUGC, GGAUUA, GGAUUG, GGCAAU, GGCACA, GGCACU, GGCAGA, GGCAUA, GGCAUC, GGCCAC, GGCCGA, GGCCCC, GGCCGA, GGCCGC, GGCCGU, GGCCUA, GGCCUG, GGCCUU, GGCGAA, GGCGAG, GGCGAU, GGCGCA, GGCGCU, GGCGGU, GGCGUA, GGCGUC, GGCGUG, GGCUUU, GGCUAA, GGCUAC, GGCUAG, GGCUAU, GGCUCC, GGCUCG, GGCUGA, GGCUUA, GGCUUC, GGCUUG, GGGAAU, GGGACA, GGGAGA, GGGAGU, GGGAUA, GGGAUU, GGGCAA, GGGCAC, GGGCAG, GGGCCG, GGGCGG, GGGGCC, GGGGGG, GGGGGU, GGGGUA, GGGUAC, GGGUAU, GGGUCA, GGGUCC, GGGUCG, GGGUGA, GGGUGC, GGGUUG, GGGUUA, GGUAAA, GGUAAC, GGUAAG, GGUAAU, GGUACA, GGUACC, GGUACG, GGUACU, GGUAGC, GGUAGG, GGUAGU, GGUAUA, GGUAUC, GGUAUG, GGUCAA, GGUCAC, GGUCAG, GGUCAU, GGUCCA, GGUCCG, GGUCCU, GGUCGA, GGUCGC, GGUCGG, GGUCGU, GGUCUC, GGUCUU, GGUGAA, GGUGAC, GGUGAU, GGUGCA, GGUGCC, GGUGGC, GGUGUA, GGUGUC, GGUUAA, GGUUAG, GGUUAU, GGUUCA, GGUUCC, GGUUCG, GGUUGC, GGUUUC, GUUAAA, GUAAAG, GUAAAU, GUAACC, GUAACG, GUAACU, GUAAGA, GUAAGC, GUAAGG, GUAAGU, GUAAUA, GUAAUC, GUAAUG, GUAAUU, GUACAA, GUACAC, GUACAG, GUACAU, GUACCA, GUACCC, GUACCG, GUACCU, GUACGA, GUACGC, GUACGG, GUACGU, GUACUA, GUACUG, GUACUU, GUAGAA, GUAGAC, GUAGCA, GUAGCC, GUAGCG, GUAGCU, GUAGGA, GUAGGC, GUAGGG, GUAGGU, GUAGUA, GUAGUC, GUAUAA, GUAUAC, GUAUAG, GUAUAU, GUAUCA, GUAUCG, GUAUCU, GUAUGA, GUAUGC, GUAUGG, GUAUUA, GUAUUG, GUAUUU, GUCAAA, GUCAAG, GUCAAU, GUCACA, GUCACC, GUCACG, GUCAGA, GUCAGC, GUCAGG, GUCAUA, GUCAUC, GUCAUG, GUCCAA, GUCCAC, GUCCAU, GUCCCC, GUCCCU, GUCCGA, GUCCGC, GUCCGG, GUCCGU, GUCCUA, GUCCUG, GUCCUU, GUCGAA, GUCGAC, GUCGAG, GUCGAU, GUCGCA, GUCGCC, GUCGCG, GUCGCU, GUCGGA, GUCGGC, GUCGGG, GUCGGU, GUCGUA, GUCGUC, GUCGUU, GUCUAA, GUCUAG, GUCUCA, GUCUCC, GUCUCG, GUCUGA, GUCUGG, GUCUGU, GUCUUC, GUCUUU, GUGAAA, GUGAAC, GUGAGA, GUGAGC, GUGAGU, GUGAUC, GUGAUG, GUGAUU, GUGCAC, GUGCAU, GUGCCC, GUGCCG, GUGCGA, GUGCGG, GUGCGU, GUGCUA, GUGCUC, GUGCUG, GUGGAA, GUGGCG, GUGGUC, GUGGUG, GUGGUU, GUGUAA, GUGUAG, GUGUCG, GUGUGA, GUGUGC, GUGUGU, GUGUUG, GUGUUU, GUUAAA, GUUAAC, GUUAAG, GUUACA, GUUACC, GUUACG, GUUACU, GUUAGA, GUUAGC, GUUAGU, GUUAUA, GUUAUC, GUUAUU, GUUCAA, GUUCAC, GUUCAG, GUUCCA, GUUCCG, GUUCGA, GUUCGC, GUUCGU, GUUCUA, GUUCUG, GUUGAA, GUUGAC, GUUGAG, GUUGAU, GUUGCA, GUUGCU, GUUGGA, GUUGGC, GUUGGU, GUUGUG, GUUGUG, GUUGUC, GUUGGA, GUUGGG, GUUGUA, GUUGUG, GUUUAU, GUUUCA, GUUUCC, GUUUCU, GUUUGA, GUUUGC, GUUUGG, GUUUGU, GUUUUA, GUUUUC, GUUUUU, UAAAAA, UAAAAC, UAAAAG, UAAAAU, UAAACA, UAAACC, UAAACG, UAAACU, UAAAGA, UAAAGG, UAAAGU, UAAAUA, UAAAUC, UAAAUG, UAAAUU, UAACAA, UAACAC, UAACAG, UAACCA, UAACCC, UAACCG, UAACCU, UAACGA, UAACGC, UAACGG, UAACGU, UAACUA, UAACUG, UAACUU, UAAGAG, UAAGAU, UAAGCA, UAAGCC, UAAGCG, UAAGCU, UAAGGA, UAAGGC, UAAGGU, UAAGGU, UAAGUA, UAAGUG, UAAGUU, UAAUAA, UAAUCA, UAAUCC, UAAUCG, UAAUCU, UAAUGA, UAAUGG, UAAUGU, UAAUUA, UAAUUC, UAAUUG, UACAAC, UACAAG, UACAAU, UACACC, UACACG, UACACU, UACAGA, UACAGC, UACAGU, UACAUC, UACAUU, UACCAA, UACCAC, UACCAG, UACCAU, UACCCA, UACCCG, UACCCU, UACCGA, UACCGC, UACCGG, UACCGU, UACCUA, UACCUG, UACGAA, UACGAC, UACGAG, UACGAU, UACGCA, UACGCC, UACGCG, UACGUG, UACGUU, UACUAA, UACUAC, UACUAG, UACUAU, UACUCA, UACUCC, UACUCG, UACUCU, UACUGA, UACUGC, UACUGG, UACUUA, UACUUG, UACUUU, UAGAAA, UAGAAG, UAGAAU, UAGACA, UAGACC, UAGAGA, UAGAGC, UAGAGU, UAGAUA, UAGAUC, UAGAUG, UAGCAU, UAGCCC, UAGCCG, UAGCCU, UAGCGA, UAGCGC, UAGCGU, UAGCUA, UAGCUC, UAGCUG, UAGGAA, UAGGAU, UAGGCG, UAGGCU, UAGGGU, UAGGUC, UAGGUG, UAGGUU, UAGUAA, UAGUAC, UAGUAG, UAGUAU, UAGUCA, UAGUCG, UAGUGU, UAGUUA, UAGUUC,

TABLE 1-continued

Hexamers that are not seed sequences of human miRNAs

UAGUUG, UAGUUU, UAUAAC, UAUAAG, UAUACU, UAUAGA,
UAUAGC, UAUAGG, UAUAGU, UAUAUA, UAUAUC, UAUAUG,
UAUAUU, UAUCAA, UAUCAC, UAUCAU, UAUCCA, UAUCCC,
UAUCCG, UAUCCU, UAUCGA, UAUCGC, UAUCGG, UAUCGU,
UAUCUA, UAUCUC, UAUCUG, UAUCUU, UAUGAA, UAUGAC,
UAUGAG, UAUGAU, UAUGCA, UAUGCG, UAUGCU, UAUGGA,
UAUGGC, UAUGUC, UAUGUG, UAUGUU, UAUUAG, UAUUCA,
UAUUCC, UAUUCG, UAUUCU, UAUUGA, UAUUGG, UAUUUA,
UAUUUC, UAUUUG, UAUUUU, UCAAAA, UCAAAC, UCAAAG,
UCAACC, UCAACU, UCAAGA, UCAAGC, UCAAUA, UCAAUC,
UCAAUG, UCAAUU, UCACCC, UCACCG, UCACCU, UCACGA,
UCACGC, UCACGG, UCACGU, UCACUA, UCACUC, UCACUU,
UCAGAA, UCAGAC, UCAGAG, UCAGCG, UCAGCU, UCAGGA,
UCAGGC, UCAGGU, UCAGUC, UCAGUU, UCAUAA, UCAUCA,
UCAUCC, UCAUCG, UCAUGC, UCAUGG, UCAUGU, UCAUUA,
UCAUUG, UCCAAA, UCCAAC, UCCAAG, UCCAU, UCCACA,
UCCACC, UCCACG, UCCAGC, UCCAGG, UCCAUA, UCCAUC,
UCCAUU, UCCCAA, UCCCAG, UCCCAU, UCCCCC, UCCCCG,
UCCCCU, UCCCGA, UCCCGC, UCCCGG, UCCCGU, UCCCUA,
UCCCUC, UCCGAA, UCCGAC, UCCGAG, UCCGAU, UCCGCA,
UCCGCC, UCCGGA, UCCGGC, UCCGGU, UCCGUA, UCCGUC,
UCCGUG, UCCUAA, UCCUCA, UCCUCG, UCCUCU, UCCUGC,
UCCUGU, UCCUUA, UCCUUC, UCCUUU, UCGAAA, UCGAAC,
UCGAAG, UCGAAU, UCGACA, UCGACC, UCGACG, UCGACU,
UCGAGA, UCGAGC, UCGAGG, UCGAUA, UCGAUC, UCGAUG,
UCGAUU, UCGCAA, UCGCAC, UCGCAG, UCGCAU, UCGCCA,
UCGCCC, UCGCCG, UCGCCU, UCGCGA, UCGCGC, UCGCGU,
UCGCUA, UCGCUC, UCGGAA, UCGGAC, UCGGAG, UCGGAU,
UCGGCA, UCGGCU, UCGGGG, UCGGGU, UCGGUC, UCGGUG,
UCGGUU, UCGUAA, UCGUAC, UCGUAG, UCGUAU, UCGUCA,
UCGUCC, UCGUCG, UCGUCU, UCUAAC, UCUAAG, UCUAAU,
UCUACA, UCUACC, UCUACG, UCUACU, UCUAGC, UCUAGG,
UCUAGU, UCUAUA, UCUAUC, UCUAUG, UCUAUU, UCUCAG,
UCUCAU, UCUCCG, UCUCGC, UCUCGG, UCUCGU, UCUCUC,
UCUGAA, UCUGAU, UCUGCA, UCUGCG, UCUGCU, UCUGGC,
UCUGGU, UCUGUC, UCUGUG, UCUGUU, UCUUAA, UCUUAC,
UCUUAG, UCUUAU, UCUUCA, UCUUCC, UCUUCG, UCUUCU,
UCUUGC, UCUUGG, UCUUGU, UCUUUA, UCUUUC, UCUUUG,
UCUUUU, UGAAAA, UGAAAC, UGAACA, UGAACC, UGAAGG,
UGAAUC, UGAAUG, UGACAA, UGACAC, UGACAG, UGACCA,
UGACCC, UGACCG, UGACGA, UGACGC, UGACGG, UGACGU,
UGACUA, UGACUC, UGACUU, UGAGAG, UGAGAU, UGAGCA,
UGAGCC, UGAGCU, UGAGGC, UGAGGU, UGAGUA, UGAGUU,
UGAUAC, UGAUAG, UGAUAU, UGAUCA, UGAUCG, UGAUCU,
UGAUGA, UGAUGC, UGAUGG, UGAUGU, UGAUUA, UGAUUC,
UGAUUG, UGAUUU, UGCAAC, UGCAAG, UGCACA, UGCACG,
UGCAGG, UGCAGU, UGCAUC, UGCCCA, UGCCCC, UGCCCG,
UGCCGA, UGCCGC, UGCCGG, UGCCGU, UGCCUA, UGCCUC,
UGCCUG, UGCCUU, UGCGAA, UGCGAC, UGCGAU, UGCGCC,
UGCGCG, UGCGCU, UGCGGC, UGCGGU, UGCGUA, UGCGUC,
UGCGUC, UGCGUG, UGCGUU, UGCUAC, UGCUAU, UGCUCC,
UGCUCG, UGCUGC, UGCUGG, UGCUGU, UGCUUA, UGCUUU,
UGGAAC, UGGAAG, UGGAGC, UGGAUC, UGGAUU, UGGCAA,
UGGCAC, UGGCAG, UGGCCG, UGGCCU, UGGCGA, UGGCGC,
UGGCGU, UGGCUA, UGGCUC, UGGCUU, UGGGAA, UGGGCA,
UGGGCC, UGGGGC, UGGGUC, UGGUAA, UGGUAG, UGGUAU,
UGGUCC, UGGUCG, UGGUCU, UGGUGA, UGGUGC, UGGUGG,
UGGUGU, UGGUUA, UGGUUG, UGUAAA, UGUAAC, UGUAAG,
UGUACC, UGUACG, UGUACU, UGUAGA, UGUAGC, UGUAGU,
UGUAUC, UGUAUU, UGUCAA, UGUCAC, UGUCAG, UGUCAU,
UGUCCA, UGUCCC, UGUCCG, UGUCGA, UGUCGC, UGUCGG,
UGUCGU, UGUCUA, UGUCUC, UGUGAC, UGUGAG, UGUGAU,
UGUGCA, UGUGCG, UGUGUA, UGUGUU, UGUUAC, UGUUAG,
UGUUAU, UGUUCA, UGUUCC, UGUUCG, UGUUGG, UGUUGU,
UGUUUA, UGUUUC, UGUUUG, UGUUUU, UUAAAA, UUAAAC,
UUAAAG, UUAAAU, UUACCC, UUACG, UUACU, UUAAGU,
UUAAUA, UUAAUC, UUAAUG, UUAAUU, UUACAA, UUACAC,
UUACAG, UUACAU, UUACCA, UUACCC, UUACCG, UUACCU,
UUACGA, UUACGC, UUACGG, UUACGU, UUACUA, UUACUC,
UUACUG, UUACUU, UUAGAA, UUAGAC, UUAGCC, UUAGCG,
UUAGCU, UUAGGA, UUAGGU, UUAGUA, UUAGUC, UUAGUU,
UUAUAA, UUAUAC, UUAUAG, UUAUAU, UUAUCC, UUAUCG,
UUAUCU, UUAUGA, UUAUGG, UUAUGU, UUAUUA, UUAUUC,
UUAUUG, UUAUUU, UUCAAC, UUCAAU, UUCACA, UUCACC,
UUCACG, UUCACU, UUCAGC, UUCAGG, UUCAGU, UUCAUA,
UUCAUC, UUCAUG, UUCAUU, UUCCAA, UUCCCA, UUCCCG,
UUCCGA, UUCCGU, UUCCUU, UUCGAA, UUCGAC, UUCGAG,
UUCGAU, UUCGCA, UUCGCC, UUCGCG, UUCGCU, UUCGGA,
UUCGGC, UUCGGG, UUCGGU, UUCGUA, UUCGUC, UUCGUG,
UUCGUU, UUCUAC, UUCUAG, UUCUCA, UUCUCG, UUCUGG,
UUCUUA, UUCUUU, UUGAAA, UUGAAC, UUGAAG, UUGAAU,
UUGACC, UUGACG, UUGACU, UUGAGA, UUGAGC, UUGAGU,
UUGAUA, UUGAUC, UUGAUG, UUGAUU, UUGCAA, UUGCAC,
UUGCAG, UUGCAU, UUGCCC, UUGCCG, UUGCGA, UUGCGC,
UUGCGG, UUGCGU, UUGCUA, UUGCUC, UUGCUG, UUGCUU,
UUGGAA, UUGGAG, UUGGCC, UUGGCG, UUGGCU, UUGGGC,
UUGGGU, UUGGUA, UUGGUG, UUGUAA, UUGUAC, UUGUCA,
UUGUCG, UUGUCU, UUGUGC, UUGUGG, UUGUUA, UUGUUG,
UUGUUU, UUUAAA, UUUAAC, UUUAAG, UUUAAU, UUUACA,
UUUACC, UUUACG, UUUACU, UUUAGA, UUUAGC, UUUAGG,
UUUAGU, UUUAUA, UUUAUC, UUUAUG, UUUAUU, UUUCAU,
UUUCCA, UUUCCG, UUUCCU, UUUCGA, UUUCGC, UUUCGG,
UUUCGU, UUUCUA, UUUCUC, UUUCUG, UUUCUU, UUUGAA,
UUUGAC, UUUGAG, UUUGAU, UUUGCC, UUUGCU, UUUGGA,
UUUGGC, UUUGGG, UUUGGU, UUUGUA, UUUGUC, UUUGUU,
UUUUAA, UUUUAG, UUUUAU, UUUUCC, UUUUCG, UUUUCU,
UUUUGA, UUUUGC, UUUUGG, UUUUGU, UUUUUA, UUUUUC,
UUUUUU

TABLE 2

A listing of oligonucleotide modifications

| Symbol | Feature Description |
| --- | --- |
| bio | 5' biotin |
| dAs | DNA w/3' thiophosphate |
| dCs | DNA w/3' thiophosphate |
| dGs | DNA w/3' thiophosphate |
| dTs | DNA w/3' thiophosphate |
| dG | DNA |
| enaAs | ENA w/3' thiophosphate |
| enaCs | ENA w/3' thiophosphate |
| enaGs | ENA w/3' thiophosphate |
| enaTs | ENA w/3' thiophosphate |
| fluAs | 2'-fluoro w/3' thiophosphate |
| fluCs | 2'-fluoro w/3' thiophosphate |
| fluGs | 2'-fluoro w/3' thiophosphate |
| fluUs | 2'-fluoro w/3' thiophosphate |
| lnaAs | LNA w/3' thiophosphate |
| lnaCs | LNA w/3' thiophosphate |
| lnaGs | LNA w/3' thiophosphate |
| lnaTs | LNA w/3' thiophosphate |
| omeAs | 2'-Ome w/3' thiophosphate |
| omeCs | 2'-Ome w/3' thiophosphate |
| omeGs | 2'-Ome w/3' thiophosphate |
| omeTs | 2'-Ome w/3' thiophosphate |
| lnaAs-Sup | LNA w/3' thiophosphate at 3' terminus |
| lnaCs-Sup | LNA w/3' thiophosphate at 3' terminus |
| lnaGs-Sup | LNA w/3' thiophosphate at 3' terminus |
| lnaTs-Sup | LNA w/3' thiophosphate at 3' terminus |
| lnaA-Sup | LNA w/3' OH at 3' terminus |
| lnaC-Sup | LNA w/3' OH at 3' terminus |
| lnaG-Sup | LNA w/3' OH at 3' terminus |
| lnaT-Sup | LNA w/3' OH at 3' terminus |
| omeA-Sup | 2'-Ome w/3' OH at 3' terminus |
| omeC-Sup | 2'-Ome w/3' OH at 3' terminus |
| omeG-Sup | 2'-Ome w/3' OH at 3' terminus |
| omeU-Sup | 2'-Ome w/3' OH at 3' terminus |
| dAs-Sup | DNA w/3' thiophosphate at 3' terminus |
| dCs-Sup | DNA w/3' thiophosphate at 3' terminus |
| dGs-Sup | DNA w/3' thiophosphate at 3' terminus |
| dTs-Sup | DNA w/3' thiophosphate at 3' terminus |
| dA-Sup | DNA w/3' OH at 3' terminus |
| dC-Sup | DNA w/3' OH at 3' terminus |
| dG-Sup | DNA w/3' OH at 3' terminus |
| dT-Sup | DNA w/3' OH at 3' terminus |

TABLE 3

Formatted oligonucleotide sequences made for testing showing nucleotide modifications.

| Oligo Name | Base Sequence | RaNA Sequence | SeqID |
|---|---|---|---|
| MECP2-01 m01 | CGACGTCGCGCCCG | InaCs;omeGs;InaAs;omeCs;InaGs;omeUs;InaCs;omeGs;InaCs;omeCs;InaCs;omeCs;InaG-Sup | 1438 |
| MECP2-02 m01 | CCGACGTCGCGCCCC | InaCs;omeCs;InaGs;omeAs;InaCs;omeGs;InaTs;omeCs;InaGs;omeCs;InaGs;omeCs;InaCs;omeCs;InaC-Sup | 1439 |
| MECP2-03 m01 | CCATTTTCCGGACGG | InaCs;omeCs;InaAs;omeUs;InaTs;omeUs;InaTs;omeCs;InaCs;omeGs;InaGs;omeAs;InaCs;omeGs;InaG-Sup | 1521 |
| MECP2-04 m01 | GCCATTTTCCGGACG | InaGs;omeCs;InaCs;omeAs;InaTs;omeUs;InaTs;omeUs;InaCs;omeCs;InaGs;InaAs;omeCs;InaG-Sup | 1522 |
| MECP2-05 m01 | GCGGCCATTTTCCGG | InaGs;omeCs;InaGs;omeGs;InaCs;omeCs;InaAs;omeUs;InaTs;omeUs;InaTs;omeCs;InaCs;omeGs;InaG-Sup | 1525 |
| MECP2-06 m01 | GGCGGCCATTTTCCG | InaGs;omeGs;InaCs;omeGs;InaGs;omeCs;InaCs;omeAs;InaTs;omeUs;InaTs;omeUs;InaTs;omeCs;InaCs;omeG | 1526 |
| MECP2-07 m01 | GCCAGCCGTGTCGTC | InaGs;omeCs;InaCs;omeAs;InaGs;omeCs;InaCs;omeGs;InaTs;omeGs;InaTs;omeCs;InaGs;omeUs;InaC-Sup | 1683 |
| MECP2-08 m01 | ATCCGCCAGCCGTGT | InaAs;omeUs;InaCs;omeCs;InaGs;omeCs;InaCs;omeAs;InaGs;omeCs;InaCs;omeGs;InaTs;omeGs;InaT-Sup | 1687 |
| MECP2-09 m01 | GATCGCCGGCGAAGG | InaGs;omeAs;InaTs;omeCs;InaGs;omeCs;InaCs;omeGs;InaGs;omeCs;InaGs;omeAs;InaAs;omeGs;InaG-Sup | 2463 |
| MECP2-10 m01 | GATCCCGAGCGCTCC | InaGs;omeAs;InaTs;omeCs;InaCs;omeCs;InaGs;omeAs;InaGs;omeCs;InaGs;omeCs;InaTs;omeCs;InaC-Sup | 2532 |
| MECP2-11 m01 | TGTGGCGACCAAGTA | InaTs;omeGs;InaTs;omeGs;InaGs;omeCs;InaGs;omeAs;InaCs;omeCs;InaAs;omeAs;InaGs;omeUs;InaA-Sup | 7070 |
| MECP2-12 m01 | AGATCACCAGTTCCG | InaAs;omeGs;InaAs;omeUs;InaCs;omeAs;InaCs;omeCs;InaAs;omeGs;InaTs;omeUs;InaCs;omeCs;InaG-Sup | 7117 |
| MECP2-13 m01 | TTGTACCTATACGCA | InaTs;omeUs;InaGs;omeUs;InaAs;omeCs;InaCs;omeUs;InaAs;omeUs;InaAs;omeCs;InaGs;omeCs;InaA-Sup | 14460 |
| MECP2-14 m01 | TTTGTACCTATACGC | InaTs;omeUs;InaTs;omeGs;InaTs;omeAs;InaCs;omeCs;InaTs;omeAs;InaTs;omeAs;InaCs;omeGs;InaC-Sup | 14461 |
| MECP2-15 m01 | CCCAAACAGCGGCGC | InaCs;omeCs;InaCs;omeAs;InaAs;omeAs;InaCs;omeAs;InaGs;omeCs;InaGs;omeGs;InaCs;omeGs;InaC-Sup | 65064 |
| MECP2-16 m01 | CCAAACAGCGGCGCT | InaCs;omeCs;InaAs;omeAs;InaAs;omeCs;InaAs;omeGs;InaCs;omeGs;InaGs;omeCs;InaGs;omeCs;InaT-Sup | 65065 |
| MECP2-17 m01 | CAAACAGCGGCGCTC | InaCs;omeAs;InaAs;omeAs;InaCs;omeAs;InaGs;omeCs;InaGs;omeGs;InaCs;omeGs;InaCs;omeUs;InaC-Sup | 65066 |
| MECP2-18 m01 | AAACAGCGGCGCTCC | InaAs;omeAs;InaAs;omeCs;InaAs;omeGs;InaCs;omeGs;InaGs;omeCs;InaGs;omeCs;InaTs;omeCs;InaC-Sup | 65067 |
| MECP2-19 m01 | AACAGCGGCGCTCCA | InaAs;omeAs;InaCs;omeAs;InaGs;omeCs;InaGs;omeGs;InaCs;omeGs;InaCs;omeUs;omeCs;InaA-Sup | 65068 |
| MECP2-20 m01 | TCCATCATCCGTGAC | InaTs;omeCs;InaCs;omeAs;InaTs;omeCs;InaAs;omeUs;InaCs;omeCs;InaGs;omeUs;InaGs;omeAs;InaC-Sup | 65079 |
| MECP2-21 m01 | GGACCCATGTATGAT | InaGs;omeGs;InaAs;omeCs;InaCs;omeCs;InaAs;omeUs;InaGs;omeUs;InaAs;omeUs;InaGs;omeAs;InaT-Sup | 65097 |
| MECP2-22 m01 | CTTTCGCTCTAAAGT | InaCs;omeUs;InaTs;omeUs;InaCs;omeGs;InaCs;omeUs;InaCs;omeUs;InaAs;omeAs;InaGs;InaT-Sup | 65972 |
| MECP2-23 m01 | TCGCTCTAAAGTGGA | InaTs;omeCs;InaGs;omeCs;InaTs;omeCs;InaTs;omeAs;InaAs;omeAs;InaGs;omeUs;InaGs;omeGs;InaA-Sup | 65975 |
| MECP2-24 m01 | GACTTCACGGTAACT | InaGs;omeAs;InaCs;omeUs;InaTs;omeCs;InaAs;omeCs;InaGs;omeGs;InaTs;omeAs;InaAs;omeCs;InaT-Sup | 66045 |
| MECP2-25 m01 | CTTCACGGTAACTGG | InaCs;omeUs;InaTs;omeCs;InaAs;omeCs;InaGs;omeGs;InaTs;omeAs;InaAs;omeCs;InaTs;omeGs;InaG-Sup | 66047 |

TABLE 3-continued

Formatted oligonucleotide sequences made for testing showing nucleotide modifications.

| Oligo Name | Base Sequence | RaNA Sequence | SeqID |
|---|---|---|---|
| MECP2-26 m01 | CAAACGCCCCGGCAG | InaCs;omeAs;InaAs;omeAs;InaCs;omeGs;InaCs;omeCs;InaCs;omeCs;InaGs;omeGs;InaCs;omeAs;InaG-Sup | 66323 |
| MECP2-27 m01 | GAAGCGAAAAGCTGA | InaGs;omeAs;InaAs;omeGs;omeGs;InaAs;omeAs;InaAs;omeAs;InaGs;omeCs;InaTs;omeGs;InaA-Sup | 66338 |
| MECP2-28 m01 | AAGAAAGCCGTGAAG | InaAs;omeAs;InaGs;omeAs;omeAs;InaGs;omeCs;InaCs;omeGs;InaTs;omeGs;InaAs;omeAs;InaG-Sup | 66432 |
| MECP2-29 m01 | CATCAAGAAGCGCAA | InaCs;omeAs;InaTs;omeCs;InaAs;omeAs;InaGs;omeAs;InaGs;omeCs;InaGs;omeCs;omeAs;InaA-Sup | 66485 |
| MECP2-30 m01 | CAATGTCTTTGCGCT | InaCs;omeAs;InaAs;omeUs;InaGs;omeUs;InaCs;omeUs;InaTs;omeUs;InaGs;omeCs;InaGs;omeCs;InaT-Sup | 27322 |
| MECP2-31 m01 | GGCGTCCGGCTGTCC | InaGs;omeGs;InaCs;omeGs;InaTs;omeCs;InaCs;omeGs;InaGs;omeCs;InaTs;omeGs;InaTs;omeCs;InaC-Sup | 27377 |
| MECP2-32 m01 | TTTGCAATCCGCTCC | InaTs;omeUs;InaTs;omeGs;InaCs;omeAs;InaAs;omeUs;InaCs;omeCs;InaGs;omeCs;InaTs;omeCs;InaC-Sup | 27422 |
| MECP2-33 m01 | GCCACGAAACTCTAA | InaGs;omeCs;InaCs;omeAs;InaCs;omeGs;InaAs;omeAs;InaAs;omeCs;InaTs;omeCs;InaTs;omeAs;InaA-Sup | 27548 |
| MECP2-34 m01 | AGCGCAGGTATATAT | InaAs;omeGs;InaCs;omeGs;InaCs;omeAs;InaGs;omeGs;InaTs;omeAs;InaTs;omeAs;InaTs;omeAs;InaT-Sup | 28519 |
| MECP2-35 m01 | TTCGGAGCTTCGTGG | InaTs;omeUs;InaCs;omeGs;InaGs;omeAs;InaGs;omeCs;InaTs;omeUs;InaCs;omeGs;InaTs;omeGs;InaG-Sup | 28565 |
| MECP2-36 m01 | GACAAACACGGTTTT | InaGs;omeAs;InaCs;omeAs;InaAs;omeAs;InaCs;omeAs;InaCs;omeGs;InaGs;omeUs;InaTs;omeUs;InaT-Sup | 29761 |
| MECP2-37 m01 | TTGCTACCACGGCCT | InaTs;omeUs;InaGs;omeCs;InaTs;omeAs;InaCs;omeCs;InaAs;omeCs;InaGs;omeGs;InaCs;omeCs;InaT-Sup | 72740 |
| MECP2-38 m01 | TGCTACCACGGCCTC | InaTs;omeUs;InaCs;omeUs;InaAs;omeCs;InaCs;omeAs;InaCs;omeGs;InaGs;omeCs;InaCs;omeUs;InaC-Sup | 72741 |
| MECP2-39 m01 | ATCAATAACAGCCGC | InaAs;omeUs;InaCs;omeAs;InaAs;omeUs;InaAs;omeAs;InaCs;omeAs;InaGs;omeCs;InaCs;omeGs;InaC-Sup | 72783 |
| MECP2-40 m01 | CAATAACAGCCGCTC | InaCs;omeAs;InaAs;omeUs;InaAs;omeAs;InaCs;omeAs;InaGs;omeCs;InaCs;omeGs;InaCs;omeUs;InaC-Sup | 72785 |
| MECP2-41 m01 | ACTCAATGTGTGCCG | InaAs;omeCs;InaTs;omeCs;InaAs;omeAs;InaTs;omeGs;InaTs;omeGs;InaTs;omeGs;InaCs;omeCs;InaG-Sup | 72848 |
| MECP2-42 m01 | CAATGTGTGCCGAGC | InaCs;omeAs;InaAs;omeUs;InaGs;omeUs;InaGs;omeUs;InaGs;omeCs;InaCs;omeGs;InaAs;omeGs;InaC-Sup | 72851 |
| MECP2-43 m01 | CAAACGCGTCACTTA | InaCs;omeAs;InaAs;omeAs;InaCs;omeGs;InaCs;omeGs;InaTs;omeCs;InaAs;omeCs;InaTs;omeUs;InaA-Sup | 36117 |
| MECP2-44 m01 | ATCGAGAATGCTAAC | InaAs;omeUs;InaCs;omeGs;InaAs;omeGs;InaAs;omeAs;InaTs;omeGs;InaCs;omeUs;InaAs;omeAs;InaC-Sup | 36165 |
| MECP2-45 m01 | CGCACGAGGCCGGCT | InaCs;omeGs;InaCs;omeAs;InaCs;omeGs;InaAs;omeGs;InaGs;omeCs;InaCs;omeGs;InaGs;omeCs;InaT-Sup | 76153 |
| MECP2-46 m01 | GAGTCAGTGTCCGCG | InaGs;omeAs;InaGs;omeUs;InaCs;omeAs;InaGs;Uomes;InaGs;omeUs;InaCs;omeCs;InaGs;omeCs;InaG-Sup | 76180 |
| MECP2-47 m01 | GTGTCCGCGGACCCG | InaGs;omeUs;InaGs;omeUs;InaCs;omeCs;InaGs;omeCs;InaGs;omeAs;InaAs;omeCs;InaCs;omeCs;InaG-Sup | 76186 |
| MECP2-48 m01 | AGCACTTCTTGTACG | InaAs;omeGs;InaCs;omeAs;InaCs;omeUs;InaTs;omeCs;InaTs;omeUs;InaGs;omeUs;InaAs;omeCs;InaG-Sup | 76316 |
| MECP2-49 m01 | TTCTTGTACGAGGTG | InaTs;omeUs;InaCs;omeUs;InaTs;omeGs;InaTs;omeAs;InaCs;omeGs;InaAs;omeGs;InaGs;omeUs;InaG-Sup | 76321 |

TABLE 3-continued

Formatted oligonucleotide sequences made for testing showing nucleotide modifications.

| Oligo Name | Base Sequence | RaNA Sequence | SeqID |
|---|---|---|---|
| MECP2-50 m01 | TGTGCCGCTTCTACA | InaTs;omeGs;InaTs;omeGs;InaCs;omeCs;InaGs;omeCs;InaTs;omeUs;InaCs;omeUs;InaAs;omeCs;InaA-Sup | 76349 |
| MECP2-51 m01 | CCGCCGACTGGTGCC | InaCs;omeCs;InaGs;omeCs;InaGs;InaAs;omeCs;InaTs;omeGs;InaGs;omeUs;InaGs;omeCs;InaC-Sup | 76385 |
| MECP2-52 m01 | TGGTGCCAGTTCGGT | InaTs;omeGs;InaGs;omeUs;InaGs;omeCs;InaCs;omeAs;InaGs;omeUs;InaTs;omeCs;InaGs;omeGs;InaT-Sup | 76393 |
| MECP2-53 m01 | TGATCGTGCGCGACC | InaTs;omeGs;InaAs;omeUs;InaCs;omeGs;InaTs;omeGs;InaCs;omeGs;InaCs;omeGs;InaAs;omeCs;InaC-Sup | 76490 |
| MECP2-54 m01 | GATCGTGCGCGACCA | InaGs;omeAs;InaTs;omeCs;InaGs;omeUs;InaGs;omeCs;InaGs;omeCs;InaGs;omeAs;InaCs;omeCs;InaA-Sup | 76491 |
| MECP2-55 m01 | TCGTGCGCGACCAGA | InaTs;omeCs;InaGs;omeUs;InaGs;omeCs;InaGs;omeCs;InaGs;omeAs;InaCs;omeCs;InaAs;omeGs;InaA-Sup | 76493 |
| MECP2-56 m01 | GCGGCTGTGCGAGCG | InaGs;omeCs;InaGs;omeGs;InaCs;omeUs;InaGs;omeUs;InaGs;omeCs;InaGs;omeAs;InaGs;omeCs;InaG-Sup | 76515 |
| MECP2-57 m01 | GGATCAACCGCAACGome | InaGs;omeGs;InaAs;omeUs;InaCs;omeAs;InaAs;Cs;InaCs;omeGs;InaCs;omeAs;InaAs;omeCs;InaG-Sup | 76565 |
| MECP2-58 m01 | GATCAACCGCAACGC | InaGs;omeAs;InaTs;omeCs;InaAs;omeAs;InaCs;omeCs;InaGs;omeCs;InaAs;omeAs;InaCs;omeGs;InaC-Sup | 76566 |
| MECP2-59 m01 | CGACTGGACATCCTT | InaCs;omeGs;InaAs;omeCs;InaTs;omeGs;InaGs;omeAs;InaCs;omeAs;InaTs;omeCs;InaCs;omeUs;InaT-Sup | 78887 |
| MECP2-60 m01 | CCCGAGGAGTACATC | InaCs;omeCs;InaCs;omeGs;InaAs;omeGs;InaGs;omeAs;InaGs;omeUs;InaAs;omeCs;InaAs;omeUs;InaC-Sup | 79422 |

BRIEF DESCRIPTION OF THE SEQUENCE LISTING

| SEQ ID | Chrom | Gene | Chr. Start | Chr. End | Strand |
|---|---|---|---|---|---|
| 1 | chrX | MECP2 | 153275263 | 153375188 | − |
| 2 | chrX | MECP2 | 153275263 | 153375188 | + |
| 3 | chrX | Mecp2 | 71260160 | 71342932 | − |
| 4 | chrX | Mecp2 | 71260160 | 71342932 | + |
| 5 | chrX | MECP2 | 153278064 | 153278111 | − |
| 6 | chrX | MECP2 | 153278111 | 153278156 | − |
| 7 | chrX | MECP2 | 153278706 | 153278747 | − |
| 8 | chrX | MECP2 | 153279512 | 153279556 | − |
| 9 | chrX | MECP2 | 153279613 | 153279658 | − |
| 10 | chrX | MECP2 | 153281486 | 153281531 | − |
| 11 | chrX | MECP2 | 153283707 | 153283737 | − |
| 12 | chrX | MECP2 | 153284059 | 153284105 | − |
| 13 | chrX | MECP2 | 153287944 | 153287992 | − |
| 14 | chrX | MECP2 | 153288681 | 153288722 | − |
| 15 | chrX | MECP2 | 153290087 | 153290134 | − |
| 16 | chrX | MECP2 | 153290216 | 153290263 | − |
| 17 | chrX | MECP2 | 153290364 | 153290414 | − |
| 18 | chrX | MECP2 | 153291585 | 153291633 | − |
| 19 | chrX | MECP2 | 153292312 | 153292362 | − |
| 20 | chrX | MECP2 | 153292731 | 153292774 | − |
| 21 | chrX | MECP2 | 153293138 | 153293185 | − |
| 22 | chrX | MECP2 | 153293331 | 153293377 | − |
| 23 | chrX | MECP2 | 153293427 | 153293469 | − |
| 24 | chrX | MECP2 | 153293568 | 153293614 | − |
| 25 | chrX | MECP2 | 153293715 | 153293764 | − |
| 26 | chrX | MECP2 | 153293792 | 153293878 | − |
| 27 | chrX | MECP2 | 153293901 | 153293948 | − |
| 28 | chrX | MECP2 | 153294420 | 153294467 | − |
| 29 | chrX | MECP2 | 153297927 | 153297972 | − |
| 30 | chrX | MECP2 | 153315466 | 153315571 | − |
| 31 | chrX | MECP2 | 153343401 | 153343447 | − |
| 32 | chrX | MECP2 | 153344298 | 153344339 | − |
| 33 | chrX | MECP2 | 153348654 | 153348702 | − |
| 34 | chrX | MECP2 | 153348997 | 153349021 | − |
| 35 | chrX | MECP2 | 153349179 | 153349222 | − |
| 36 | chrX | MECP2 | 153349694 | 153349734 | − |
| 37 | chrX | MECP2 | 153350493 | 153350518 | − |
| 38 | chrX | MECP2 | 153356667 | 153356713 | − |
| 39 | chrX | MECP2 | 153356742 | 153356795 | − |
| 40 | chrX | MECP2 | 153357047 | 153357106 | − |
| 41 | chrX | MECP2 | 153357161 | 153357204 | − |
| 42 | chrX | MECP2 | 153361085 | 153361163 | − |
| 43 | chrX | MECP2 | 153361423 | 153361467 | − |
| 44 | chrX | MECP2 | 153362464 | 153362527 | − |
| 45 | chrX | MECP2 | 153276064 | 153280111 | − |
| 46 | chrX | MECP2 | 153276111 | 153280156 | − |
| 47 | chrX | MECP2 | 153276706 | 153280747 | − |
| 48 | chrX | MECP2 | 153277512 | 153281556 | − |
| 49 | chrX | MECP2 | 153277613 | 153281658 | − |
| 50 | chrX | MECP2 | 153279486 | 153283531 | − |
| 51 | chrX | MECP2 | 153281707 | 153285737 | − |
| 52 | chrX | MECP2 | 153282059 | 153286105 | − |
| 53 | chrX | MECP2 | 153285944 | 153289992 | − |
| 54 | chrX | MECP2 | 153286681 | 153290722 | − |
| 55 | chrX | MECP2 | 153288087 | 153292134 | − |
| 56 | chrX | MECP2 | 153288216 | 153292263 | − |
| 57 | chrX | MECP2 | 153288364 | 153292414 | − |
| 58 | chrX | MECP2 | 153289585 | 153293633 | − |
| 59 | chrX | MECP2 | 153290312 | 153294362 | − |
| 60 | chrX | MECP2 | 153290731 | 153294774 | − |
| 61 | chrX | MECP2 | 153291138 | 153295185 | − |
| 62 | chrX | MECP2 | 153291331 | 153295377 | − |
| 63 | chrX | MECP2 | 153291427 | 153295469 | − |
| 64 | chrX | MECP2 | 153291568 | 153295614 | − |
| 65 | chrX | MECP2 | 153291715 | 153295764 | − |

BRIEF DESCRIPTION OF THE SEQUENCE LISTING

| SEQ ID | Chrom | Gene | Chr. Start | Chr. End | Strand |
|---|---|---|---|---|---|
| 66 | chrX | MECP2 | 153291792 | 153295878 | − |
| 67 | chrX | MECP2 | 153291901 | 153295948 | − |
| 68 | chrX | MECP2 | 153292420 | 153296467 | − |
| 69 | chrX | MECP2 | 153295927 | 153299972 | − |
| 70 | chrX | MECP2 | 153313466 | 153317571 | − |
| 71 | chrX | MECP2 | 153341401 | 153345447 | − |
| 72 | chrX | MECP2 | 153342298 | 153346339 | − |
| 73 | chrX | MECP2 | 153346654 | 153350702 | − |
| 74 | chrX | MECP2 | 153346997 | 153351021 | − |
| 75 | chrX | MECP2 | 153347179 | 153351222 | − |
| 76 | chrX | MECP2 | 153347694 | 153351734 | − |
| 77 | chrX | MECP2 | 153348493 | 153352518 | − |
| 78 | chrX | MECP2 | 153354667 | 153358713 | − |
| 79 | chrX | MECP2 | 153354742 | 153358795 | − |
| 80 | chrX | MECP2 | 153355047 | 153359106 | − |
| 81 | chrX | MECP2 | 153355161 | 153359204 | − |
| 82 | chrX | MECP2 | 153359085 | 153363163 | − |
| 83 | chrX | MECP2 | 153359423 | 153363467 | − |
| 84 | chrX | MECP2 | 153360464 | 153364527 | − |
| 85 | chrX | MECP2 | 153279614 | 153279660 | + |
| 86 | chrX | MECP2 | 153281662 | 153281720 | + |
| 87 | chrX | MECP2 | 153281946 | 153281988 | + |
| 88 | chrX | MECP2 | 153284367 | 153284448 | + |
| 89 | chrX | MECP2 | 153284489 | 153284534 | + |
| 90 | chrX | MECP2 | 153288786 | 153288832 | + |
| 91 | chrX | MECP2 | 153289895 | 153289940 | + |
| 92 | chrX | MECP2 | 153292315 | 153292365 | + |
| 93 | chrX | MECP2 | 153292496 | 153292548 | + |
| 94 | chrX | MECP2 | 153297642 | 153297688 | + |
| 95 | chrX | MECP2 | 153297723 | 153297765 | + |
| 96 | chrX | MECP2 | 153300816 | 153300879 | + |
| 97 | chrX | MECP2 | 153315579 | 153315621 | + |
| 98 | chrX | MECP2 | 153316595 | 153316640 | + |
| 99 | chrX | MECP2 | 153348783 | 153348830 | + |
| 100 | chrX | MECP2 | 153349199 | 153349250 | + |
| 101 | chrX | MECP2 | 153358221 | 153358285 | + |
| 102 | chrX | MECP2 | 153277614 | 153281660 | + |
| 103 | chrX | MECP2 | 153279662 | 153283720 | + |
| 104 | chrX | MECP2 | 153279946 | 153283988 | + |
| 105 | chrX | MECP2 | 153282367 | 153286448 | + |
| 106 | chrX | MECP2 | 153282489 | 153286534 | + |
| 107 | chrX | MECP2 | 153286786 | 153290832 | + |
| 108 | chrX | MECP2 | 153287895 | 153291940 | + |
| 109 | chrX | MECP2 | 153290315 | 153294365 | + |
| 110 | chrX | MECP2 | 153290496 | 153294548 | + |
| 111 | chrX | MECP2 | 153295642 | 153299688 | + |
| 112 | chrX | MECP2 | 153295723 | 153299765 | + |
| 113 | chrX | MECP2 | 153298816 | 153302879 | + |
| 114 | chrX | MECP2 | 153313579 | 153317621 | + |
| 115 | chrX | MECP2 | 153314595 | 153318640 | + |
| 116 | chrX | MECP2 | 153346783 | 153350830 | + |
| 117 | chrX | MECP2 | 153347199 | 153351250 | + |
| 118 | chrX | MECP2 | 153356221 | 153360285 | + |

Single Strand Oligonucleotides (Antisense Strand of Target Gene)
SeqID range: 119-47653
SeqIDs w/o G Runs:
119-142, 157-202, 217-263, 279-293, 307-350, 364-544, 559-609, 623-677, 691-711, 726-787, 803-839, 854-915, 930-1055, 1070-1081, 1095-1103, 1118-1149, 1163, 1186-1189, 1204-1236, 1259-1301, 1343-1452, 1466-1476, 1490-1610, 1624-1658, 1672-1694, 1730-1740, 1769-1790, 1804-1814, 1843, 1881-1910, 1924-1947, 1978-1980, 2038-2052, 2066-2092, 2108-2114, 2142-2147, 2175-2192, 2207-2261, 2275-2294, 2308-2336, 2350-2379, 2394-2431, 2463-2515, 2529-2631, 2645-2771, 2786-2994, 3009-3291, 3305-3395, 3409-3463, 3477-3515, 3529-3566, 3581-3599, 3613-3686, 3701-3718, 3732-3830, 3844-3861, 3875-3970, 3984-4133, 4157-4235, 4251-4254, 4268-4474, 4488-4575, 4589-4608, 4627-4739, 4745-4756, 4780-4812, 4826-5007, 5034-5123, 5137-5239, 5253-5345, 5353-5371, 5384-5401, 5406-5477, 5503-5517, 5531-5635, 5649-5867, 5881-6171, 6185-6214, 6228-6231, 6245-6265, 6280-6406, 6420-6490, 6505-6661, 6684-6784, 6799-6964, 6979-7024, 7045-7174, 7188-7310, 7337-7388, 7402-7410, 7424-7474, 7489-7729, 7756-7797, 7811-7974, 7988-8049, 8063-8448, 8462-8671, 8686-8728, 8742-8854, 8869-8872, 8893-9071, 9076-9363, 9384-9399, 9423-9613, 9619-9706, 9715-9810, 9818-9931, 9951-9956, 9970-10101, 10116-10148, 10153-10230, 10244-10288, 10292-10379, 10386-10412, 10426-10639, 10680-10979, 11005-11060, 11072-11159, 11173-11198, 11204-11226, 11240-11566, 11580-11763, 11777-12069, 12083-12178, 12183-12197, 12213-12235, 12247-12257, 12268-12315, 12342-12351, 12373-12387, 12402-12409, 12431-12443, 12457-12466, 12485, 12510-12524, 12547, 12561-12802, 12817-12828, 12843-12854, 12868, 12882-12936, 12956-13001, 13015-13044, 13058-13087, 13106-13116, 13139-13141, 13155-13163, 13178-13612, 13634-13823, 13838-13847, 13857-13866, 13877-14524, 14538-14555, 14569-14754, 14768-14791, 14804-14806, 14820-14830, 14842-14851, 14865-14891, 14895-15008, 15022-15295, 15299-15317, 15332-15643, 15656-15658, 15670-15697, 15701-15748, 15765-15872, 15886-15941, 15964-15985, 15992-16007, 16021-16058, 16062-16084, 16098-16202, 16216-16428, 16439-16487, 16500-16758, 16772-16857, 16871-16875, 16891-16933, 16947-16990, 16999-17030, 17057-17072, 17096-17143, 17149-17150, 17165-17200, 17235-17246, 17260-17466, 17480-17545, 17566-17572, 17586-17592, 17638-17675, 17689-18203, 18217-18417, 18431-18540, 18554-18642, 18656-18669, 18683-18724, 18739-18828, 18842-19079, 19110-19222, 19236-19260, 19275-19321, 19335-19336, 19350-19415, 19430-19530, 19555-19666, 19681, 19695-19717, 19731-19841, 19856-19864, 19878-19905, 19945-20156, 20180-20184, 20218-20297, 20349-20360, 20374-20388, 20402-20409, 20423-20435, 20449-20456, 20470-20505, 20519-20524, 20564-20574, 20589-20605, 20620-20641, 20655-20673, 20687-20717, 20745-20752, 20767-20790, 20804-20808, 20832-20834, 20859-20871, 20885-20922, 20936-20972, 20995-21005, 21020-21075, 21089-21097, 21111-21120, 21134-21161, 21175-21210, 21224-21241, 21256-21263, 21277-21283, 21297-21331, 21345-21417, 21431-21526, 21540-21592, 21606-21693, 21707-21746, 21760-21783, 21808-21870, 21884-21896, 21911-21947, 21961-22177, 22191-22199, 22213, 22229-22539, 22553-22572, 22587-22603, 22617-22680, 22719-22733, 22755-22777, 22791-22804, 22818-22848, 22862-22877, 22891-22909, 22923-22938, 22959-22995, 23009-23017, 23034-23037, 23066-23070, 23084-23108, 23130-23171, 23182-23237, 23261-23263, 23274-23279, 23301-23322, 23336-23365, 23379, 23389-23430, 23441-23450, 23464-23561, 23576-23654, 23668-23725, 23739-23770, 23784-23823, 23837-23851, 23865-23908, 23922-24117, 24132-24246, 24261-24314, 24328-24402, 24416-24489, 24512-24778, 24799-24805, 24837-24862, 24884-25011, 25032-25045, 25069-25256, 25271-25316, 25330-25332, 25346-25349, 25363-25395, 25410-25422, 25438-25460, 25474, 25493-25614, 25628-25641, 25655-25722, 25736-25752, 25766-25878, 25892-26037, 26051-26076, 26090-26250, 26264-26309, 26333-26385, 26406-26431, 26450-26465, 26488-26509, 26524-26534, 26548-26667, 26681-26689, 26704-26719, 26746-26842, 26857-26862, 26876-26903, 26918-26919, 26933-26962, 26976-26989, 27004-27020, 27037-27063, 27088, 27114-27116, 27130-27133, 27167-27194, 27208-27226, 27241-27251, 27265-27377, 27391-27490, 27504-27720, 27756-27790, 27804-27812, 27867-27947, 27965-27972, 27998-28071, 28085-28119, 28133-28399, 28413-28459, 28473-28551, 28565-28619, 28634-28665, 28679-28697, 28711-28723, 28737-28748, 28763-28765, 28779-28793, 28824-28897, 28920-28934, 28952-28960, 28974-28997, 29011-29057, 29071-29153, 29174-29185, 29227-29377, 29391-29548, 29575-29623, 29637-29795, 29810-29887, 29929-29939, 29957-29965, 29980-30040, 30056-30211, 30226-30257, 30291-30358, 30386-30390, 30416-30466, 30482-30484, 30509-30550, 30564-30566, 30580-30585, 30600-30662, 30676-30777, 30791-30815, 30835-30881, 30918-31003, 31017-31024, 31038-31049, 31063-31065, 31081-31098, 31113-31192, 31206-31229, 31244-31254, 31268-31390, 31404-31422, 31437-31454, 31468-31487, 31503-31620, 31635-31736, 31750-31754, 31775-31902, 31918-32203, 32235-32249, 32264-32276, 32290-32323, 32337-32384, 32417-32459, 32482-32502, 32522-32568, 32592-32659, 32692-32724, 32738-32829, 32843-33144, 33158-33168, 33182-33188, 33202-33214, 33228-33303, 33331-33339, 33353-33366, 33380-33400, 33414-33490, 33505-33521, 33536-33554, 33581-33745, 33763-33804, 33818-33824, 33846-33867, 33881-33928, 33946-34050, 34064-34065, 34079-34080, 34099-34101, 34119-34176, 34190-34304, 34337-34362, 34383, 34397-34701, 34721-34727, 34741-34742, 34765-34827, 34841-34850, 34872-34878, 34892-34978, 34996-35092, 35107-35130, 35149-35172, 35201-35238, 35252-35271, 35291-35317, 35331-35342, 35356-35359, 35378-35449, 35465-35474, 35500-35532, 35546-35645, 35659-35886, 35917-36221, 36237-36277, 36291-36354, 36369-36447, 36473-36476, 36492-36513, 36535-36563, 36587-36631, 36658-36756, 36770-36787, 36801-36836, 36850-36884, 36900-36955, 36969-37119, 37134-37223, 37238-37280, 37294-37359, 37373-37525, 37539-37566, 37580-37585, 37611, 37651-37671, 37700-37714, 37749, 37774-37797, 37832-37874, 37945-37964, 38004-38016, 38030-38053, 38075-38146, 38178-38238, 38252-38257, 38271-38350, 38365-38374, 38406-38426, 38470, 38510-38519, 38535-38557, 38572, 38586-38594, 38620-38635, 38649-38693, 38713-38727, 38755-38768, 38783-38793, 38816-38858, 38873-38942, 38957-38965, 38991-38994, 39008-39009, 39028-39032, 39047-39048, 39071-39173, 39199-39206, 39220-39229, 39255-39259, 39273-39279, 39300-39326, 39340-39359, 39403-39498, 39512-39536, 39550-39562, 39576-39578, 39593, 39611-39623, 39638-39648, 39662-39718, 39742-39768, 39801-39889, 39914-39917, 39931-39971, 39984-39999, 40006-40065, 40080-40092, 40094-40095, 40113-40124, 40150-40176, 40191-40233, 40249-40295, 40309-40322, 40336-40337, 40351-40361, 40376-40517, 40567-40600, 40614-40631, 40646-40672, 40686-40712, 40727-40761, 40776-40801, 40815-40820, 40836-40958, 40973-40996, 41010-41021, 41035-41049, 41064-41072, 41086-41096, 41110, 41124-41185, 41200-41275, 41290-41300, 41341-41381, 41408-41425, 41450-41466, 41480-41492, 41513-41582, 41597-41637, 41652-41668, 41682-41792, 41807-41826, 41840-41841, 41855-41905, 41920-41924, 41939-42053, 42068-42090, 42105-42108, 42122-42219, 42245-42250, 42283-42334, 42364-42379, 42394-42413, 42433-42434, 42466-42471, 42485-42530, 42548-42598, 42612-42693, 42707-42721, 42736-42741, 42757-42775, 42789-42800, 42822-42824, 42838-42930, 42939-43001, 43015-43127, 43142-43152, 43166-43231, 43245-43290, 43304-43337, 43351-43372, 43404-43470, 43484-43516, 43530-43545, 43560-43599, 43613-43624, 43639-43642, 43657-43667, 43694-43717, 43733-43761, 43789-43815, 43830-43911, 43925-43949, 43963-43977, 43991-44009, 44035-44054, 44078-44128, 44142-44157, 44180-44204, 44218-44230, 44245-44258, 44272-44286, 44310-44336, 44350-44367, 44398-44445, 44472-44493, 44507-44528, 44559-44602, 44631-44633, 44647-44656, 44682-44724, 44743-44832, 44858-44896, 44915-44928, 44942-44946, 44960-44979, 44997, 45010-45037, 45052-45059, 45073-45121, 45184-45202, 45216, 45231-45246, 45261-45266, 45280-45300, 45314-45368, 45374-45420, 45433-45453, 45487-45495, 45509-45535, 45551-45603, 45617-45652, 45668-45740, 45760-45770, 45784-45814, 45828-45906, 45920-45961, 45976-45990, 46004-46016, 46030-46039, 46053-46070, 46084-46126, 46140-46164, 46178-46221, 46235-46311, 46321-46327, 46341-46418, 46432-46504, 46518-46569, 46582-46600, 46614-46617, 46631-46632, 46646-46648, 46663-46785, 46799-46846, 46862-47025, 47049-47197, 47203-47255, 47269-47274, 47288-47314, 47328-47419, 47426-47461, 47463, 47468-47483, 47485-47551, 47554-47559, 47561-47569, 47577-47608, 47612-47623, 47625-47631, 47633-47638, 47643-47653

SeqIDs w/o miR Seeds:
119, 121-123, 125, 130, 132-133, 137-140, 142, 149, 151-152, 161-164, 166-167, 169, 172-176, 178-181, 183, 186-187, 189, 192, 194-195, 198, 202-203, 210-213, 215-218, 220, 222-223, 225-228, 230-231, 233, 235-236, 238-239, 242-243, 247, 251-252, 254-255, 257-259, 261-263, 265, 267, 272-277, 279-282, 285-287, 290-293, 297-300, 305-306, 308, 310, 313, 316, 318, 324-329, 331-332, 335, 337-339, 341-343, 345, 347-349, 353-359, 361-362, 366, 369-371, 378-381, 384-389, 391, 393-394, 401, 404, 406-407, 409, 411-412, 421-422, 424-425, 427-438, 441, 443-446, 449-451, 454-455, 458-459, 461-462, 464, 467-468, 470-471, 473, 476-478, 483-489, 491, 493-498, 502, 504, 506-510, 512-523, 525, 527, 529-530, 532-534, 536, 539-544, 548, 550, 552, 554-558, 562, 565-566, 569-572, 575, 577, 579-588, 590, 594, 598-600, 602-606, 608-609, 612, 614-615, 617-619, 621-624, 630-633, 636, 639-641, 643-647, 649-651, 653, 655, 658, 660-663, 666-667, 669-670, 676-677, 682, 684-688, 690, 699, 701, 703-708, 710-713, 717-720, 724, 726, 730, 732-735, 739-740, 745-746, 748-749, 755-756, 758, 760-762, 764-768, 773, 776-778, 780, 785-787, 796-797, 802, 805-809, 812, 818-824, 826, 831, 834, 836-840, 846, 848, 851, 853-856, 858-859, 862, 864, 868-870, 876, 878-883, 885-886, 889, 893-895, 897-899, 901, 904, 906, 909-910, 913, 916, 918, 924, 927-928, 930-931, 933-939, 943-944, 949, 951-953, 955, 959, 964-967, 969-974, 976-980, 982, 984, 986-987, 989-1000, 1002, 1005-1017, 1020-1023, 1025, 1027-1028, 1030-1031, 1034-1035, 1038-1048, 1050-1055, 1068-1072, 1074-1077, 1080-1082, 1087-1090, 1092, 1094, 1099-1101, 1103, 1105, 1110, 1112-1113, 1115, 1117-1118, 1121, 1125-1131, 1134, 1136, 1138, 1140-1147, 1149, 1151, 1154, 1157-1158, 1162-1163, 1166, 1168-1169, 1171, 1176, 1178-1181, 1183, 1185-1186, 1188-1189, 1195-1196, 1198-1204, 1206-1208, 1210-1212, 1215-1216, 1218-1220, 1223-1224, 1229, 1231, 1233, 1235-1236, 1238, 1243-1245, 1252-1253, 1255-1263, 1265, 1267-1270, 1272-1289, 1293-1301, 1309, 1314-1315, 1317, 1323-1324, 1332-1334, 1336-1341, 1343, 1346-1349, 1351-1352, 1354-1356, 1361-1362, 1365-1369, 1372, 1375, 1379, 1381-1384, 1386, 1389-1390, 1393, 1396, 1398, 1401-1402, 1404-1407, 1409-1410, 1415-1416, 1418-1422, 1424, 1427, 1429-1432, 1434-1435, 1437-1445, 1447-1452, 1455-1465, 1467, 1471, 1473, 1475, 1477, 1481, 1485-1493, 1495, 1499-1501, 1503-1505, 1507, 1510-1512, 1514, 1516, 1518-1523, 1525-1526, 1528, 1531, 1534, 1537, 1539, 1542, 1546-1547, 1549-1550, 1552, 1555, 1558, 1561, 1563, 1565-1569, 1572, 1574-1575, 1577, 1579, 1584-1585, 1591-1602, 1605-1606, 1608-1610, 1612, 1614-1615, 1618-1620, 1622-1623, 1625-1626, 1628-1629, 1631-1632, 1634, 1638-1639, 1641, 1643-1649, 1651, 1653-1655, 1657, 1659, 1661, 1663-1664, 1666-1668, 1670-1677, 1679-1683, 1685-1686, 1688-1692, 1694-1695, 1697, 1699, 1703-1705, 1709-1711, 1717, 1719-1720, 1722, 1725, 1728-1737, 1742, 1744, 1746-1760, 1762, 1764-1767, 1769-1776, 1778, 1781-1783, 1786, 1788-1789, 1796, 1798-1801, 1803, 1806-1809, 1811-1815, 1820-1822, 1828-1829, 1831, 1834-1841, 1843-1844, 1846-1848, 1850-1851, 1854-1855, 1857-1858, 1861-1862, 1865-1866, 1871-1873, 1878-1879, 1881-1887, 1890, 1892-1895, 1898-1901, 1903, 1905, 1907, 1914, 1918-1919, 1921-1922, 1924-1925, 1927, 1929, 1932-1934, 1936, 1939-1946, 1952-1953, 1955-1957, 1959-1960, 1962, 1964-1965, 1967, 1970, 1972-1977, 1979-1980, 1982, 1987, 1991, 1995, 1997-1999, 2007-2008, 2010-2011, 2013-2015, 2017-2023, 2030-2033, 2037, 2040-2042, 2045, 2048-2051, 2055, 2057-2062, 2064-2065, 2067, 2069, 2071-2072, 2074, 2076, 2084, 2087, 2089-2092, 2094, 2096, 2099-2100, 2102, 2104-2109, 2111, 2113, 2121, 2127-2129, 2132, 2139-2140, 2144, 2146, 2148, 2157-2158, 2160-2161, 2166, 2168-2178, 2183-2186, 2191, 2193, 2198-2202, 2204, 2206, 2209, 2211-2213, 2215-2218, 2222-2227, 2229-2230, 2234, 2236-2239, 2241, 2245-2247, 2249-2252, 2254-2255, 2258-2259, 2261, 2267-2269, 2271-2274, 2276-2280, 2283, 2285-2291, 2293-2295, 2297-2300, 2302, 2306-2310, 2312, 2314-2315, 2317-2319, 2322, 2324-2325, 2327-2328, 2332, 2334-2336, 2338-2344, 2346-2349, 2351-2352, 2355-2357, 2359, 2361, 2363-2364, 2366-2375, 2377-2378, 2380-2381, 2389, 2392-2393, 2396-2397, 2399-2400, 2403-2405, 2409-2410, 2413-2416, 2419-2424, 2426, 2429, 2431, 2433-2436, 2439-2440, 2443-2445, 2447-2449, 2452, 2455-2457, 2459-2465, 2473-2475, 2478-2482, 2484, 2487, 2491-2506, 2509-2511, 2513-2515, 2521, 2523-2526, 2528, 2531-2533, 2535-2542, 2545, 2547-2550, 2552-2557, 2559-2565, 2567-2573, 2575, 2580-2581, 2583-2584, 2586-2589, 2592-2593, 2595-2603, 2608-2610, 2613, 2615-2621, 2623-2633, 2635-2638, 2640-2641, 2643-2646, 2650, 2652-2653, 2657, 2661-2663, 2666-2667, 2672, 2674, 2676, 2678-2682, 2684, 2694-2698, 2700-2705, 2707-2715, 2717, 2719-2722, 2724-2726, 2729-2730, 2737, 2740, 2742-2743, 2745-2749, 2751-2760, 2764, 2766-2773, 2775-2778, 2780-2782, 2785-2787, 2789, 2791, 2793-2797, 2800-2803, 2805, 2809-2824, 2826-2833, 2835-2837, 2839-2842, 2844-2846, 2848-2854, 2856-2857, 2861-2865, 2867, 2870-2871, 2873-2876, 2878-2879, 2881-2884, 2886-2889, 2891-2893, 2896-2899, 2901, 2903-2904, 2906, 2909-2911, 2913-2925, 2927, 2929, 2937, 2939-2940, 2942-2945, 2947, 2949, 2952-2954, 2957-2959, 2963, 2965-2970, 2974, 2976, 2979, 2982-2989, 2991-2997, 3001-3002, 3004, 3010-3024, 3031-3039, 3041-3044, 3050, 3054-3055, 3058-3059, 3063-3067, 3069-3072, 3077-3078, 3080, 3084-3091, 3093, 3095-3097, 3100, 3102-3107, 3109-3110, 3112-3113, 3115-3116, 3119, 3121-3125, 3129-3130, 3132-3134, 3136-3138, 3140-3149, 3151, 3153-3161, 3163-3164, 3170-3188, 3193, 3198, 3200, 3202-3204, 3207-3209, 3211, 3214-3215, 3218-3222, 3224-3230, 3234-3235, 3237-3238, 3242-3245, 3247-3250, 3252, 3254-3257, 3260-3267, 3269-3270, 3272-3273, 3276-3278, 3282-3283, 3285-3286, 3289, 3291, 3294, 3297-3299, 3301-3303, 3311-3313, 3316, 3320-3330, 3332-3333, 3335, 3337, 3342-3344, 3350-3351, 3353-3354, 3357-3358, 3360-3366, 3368-3370, 3372-3377, 3381, 3384, 3386-3388, 3390, 3392-3395, 3397, 3400-3403, 3405, 3407-3408, 3410, 3413, 3416-3419, 3423, 3425, 3427-3428, 3430, 3432-3436, 3439, 3441-3442, 3444, 3448, 3453, 3455-3457, 3459-3465, 3467-3468, 3470-3474, 3476, 3478-3480, 3482, 3484-3486, 3489-3496, 3498-3500, 3502-3504, 3506-3510, 3512, 3515-3517, 3519, 3522-3526, 3530, 3534-3542, 3548-3549, 3555-3556, 3558, 3561, 3563-3565, 3568, 3577, 3580-3587, 3589, 3592, 3595-3600, 3604, 3606-3610, 3612, 3614, 3621, 3623-3625, 3627-3634, 3636-3644, 3646, 3649-3650, 3653, 3655, 3660-3667, 3670-3671, 3673-3676, 3679, 3682, 3684-3686, 3688, 3692-3693, 3695-3700, 3702-3707, 3709-3716, 3718, 3724-3727, 3732, 3735, 3738-3739, 3742, 3749-3751, 3754-3755, 3758, 3764, 3766-3770, 3776-3779, 3781, 3783-3786, 3791-3793, 3797-3801, 3805-3806, 3808-3810, 3812-3813, 3817-3820, 3825-3828, 3834-3835, 3837, 3841-3842, 3844, 3848, 3850-3852, 3854-3862, 3865-3867, 3870-3872, 3874-3884, 3886, 3890-3891, 3895-3896, 3898-3899, 3901, 3906-3912, 3915-3916, 3918-3924, 3931, 3934, 3936-3938, 3940, 3943, 3948-3951, 3953-3954, 3956, 3958, 3960-3961, 3964-3965, 3967, 3969-3975, 3977-3981, 3984, 3986-3987, 3989, 3991, 3993, 4001-4008, 4010-4021, 4024-4030, 4034, 4036-4047, 4049-4051, 4054, 4057, 4059, 4065, 4067, 4069-4071, 4073-4075, 4077-4078, 4080-4085, 4088-4092, 4094-4100, 4103, 4105-4106, 4109-4111, 4113, 4115-4117, 4120-4121, 4123, 4125, 4130-4133, 4136, 4138, 4143, 4152, 4155-4158, 4160-4161, 4163, 4165-4166, 4170-4172, 4174-4177, 4179, 4181-4183, 4185, 4188-4193, 4195-4197, 4202-4210, 4212, 4214-4217, 4219-4225, 4227-4234, 4236, 4238-4239, 4242, 4244, 4246-4247, 4249, 4251, 4253, 4258-4259, 4262-4264, 4266-4267, 4269-4276, 4278-4280, 4282-4283, 4285, 4287, 4289-4292, 4294, 4296-4304, 4308-4309, 4311-4312, 4315-4319, 4321-4325, 4328-4329, 4331-4335, 4337, 4339-4341, 4345, 4347, 4351-4353, 4357-4358, 4360-4364, 4367-4371, 4374, 4379-4381, 4383, 4385-4386, 4390, 4392-4393, 4395, 4399, 4401-4406, 4409-4414, 4417-4425, 4429-4431, 4436-4447, 4449-4456, 4459, 4462-4465, 4469-4471, 4473, 4477, 4479-4481, 4483-4484, 4487-4489, 4491, 4493, 4495-4496, 4498-4502, 4505, 4507-4510, 4512-4513, 4515-4516, 4518-4520, 4522, 4525-4527, 4529, 4531-4533, 4535-4536, 4538, 4541-4542, 4545-4546, 4549-4555, 4558, 4562, 4564-4567, 4569-4571, 4575, 4580, 4582, 4584, 4586-4589, 4593-4594, 4597-4598, 4602-4607, 4618, 4621, 4623, 4625-4627, 4629-4631, 4636, 4638, 4640, 4643, 4645-4646, 4649, 4651-4655, 4658, 4664-4683, 4685-4687, 4690-4691, 4693-4694, 4697-4698, 4700-4706, 4708, 4710, 4712-4715, 4719-4720, 4724, 4726-4727, 4734-4737, 4742, 4744, 4746-4748, 4752, 4757-4764, 4766, 4770-4774, 4776-4780, 4782-4783, 4785-4786, 4789-4790, 4792-4794, 4796, 4800-4804, 4806-4808, 4810-4811, 4815, 4817-4819, 4821, 4823-4824, 4826-4829, 4831-4833, 4835-4841, 4843-4844, 4847-4848, 4850, 4852-4853, 4855-4860, 4862-4866, 4869-4870, 4872, 4875-4876, 4880-4881, 4883, 4885, 4890, 4893, 4896-4899, 4901-4903, 4905, 4907, 4909-4912, 4914, 4916-4917, 4919, 4922, 4924-4926, 4931-4932, 4934-4935, 4937-4942, 4945-4948, 4950-4965, 4968-4970, 4973, 4976-4977, 4981-4985, 4987-4992, 4994, 4996-4997, 4999-5000, 5003, 5006-5008, 5016, 5022, 5027-5031, 5033, 5035-5036, 5039, 5042, 5044-5045, 5047-5054, 5057-5062, 5064, 5066, 5069-5070, 5073-5076, 5078, 5080-5081, 5084, 5086, 5092, 5094-5095, 5097, 5100, 5102-5103, 5106, 5110, 5112-5114, 5116-5118, 5120, 5122-5124, 5126-5127, 5129-5133, 5136-5140, 5143-5146, 5152-5154, 5160, 5162, 5164, 5166, 5169-5171, 5173-5176, 5178-5180, 5182-5189, 5191, 5193, 5195-5199, 5201-5202, 5204-5207, 5209-5214, 5216-5218, 5220-5221, 5225-5226, 5230-5232, 5234, 5237-5239, 5243, 5245-5253, 5255-5256, 5258-5260, 5264, 5266, 5268, 5272, 5274-5275, 5277-5279, 5281-5285, 5287-5290, 5292-5297, 5299, 5303-5304, 5306, 5309-5310, 5313, 5315-5318, 5320-5322, 5324-5326, 5328-5332, 5334-5335, 5339, 5345, 5347, 5353, 5357-5358, 5361, 5363-5364, 5368-5369, 5371, 5373-5374, 5376, 5379-5382, 5384-5388, 5393, 5396, 5399, 5404, 5406-5407, 5411, 5413-5418, 5425-5428, 5431, 5433-5446, 5448-5449, 5452-5457, 5459-5460, 5466-5468, 5471, 5474-5475, 5477, 5479, 5482-5483, 5485-5487, 5494, 5496-5498, 5501-5502, 5505-5507, 5513-5514, 5516-5517, 5519, 5521, 5526, 5528-5529, 5531-5533, 5535-5538, 5540-5541, 5543-5550, 5552-5555, 5557-5566, 5569, 5571-5574, 5576-5577, 5579-5580, 5583-5587, 5589, 5592-5593, 5596-5598, 5603-5604, 5606-5609, 5611-5612, 5614, 5616-5623, 5625-5632, 5636-5638, 5642-5643, 5645-5648, 5651-5652, 5656, 5669-5670, 5672, 5676-5677, 5679-5680, 5682, 5685-5688, 5692, 5694-5695, 5699-5704, 5707-5708, 5710-5713, 5715-5719, 5721, 5723-5725, 5727-5728, 5730-5735, 5737, 5739, 5741-5746, 5748-5752, 5754-5755, 5757, 5759-5760, 5762, 5764-5766, 5768-5769, 5773-5778, 5780, 5784, 5789-5792, 5794, 5796-5803, 5805, 5807-5808, 5810-5813, 5816, 5819, 5822-5825, 5827-5828, 5830-5831, 5835-5838, 5841-5842, 5844, 5846-5849, 5851-5854, 5856, 5858-5864, 5866-5867, 5869, 5871, 5874, 5877-5879, 5882, 5885-5888, 5891-5898, 5900-5901, 5903, 5905-5907, 5909-5911, 5913-5914, 5916, 5918-5921, 5923, 5925-5926, 5929, 5932, 5935-5939, 5942-5953, 5955-5957, 5959-5963, 5965-5967, 5972, 5974-5982, 5984-5986, 5989-5995, 5997-6003, 6005, 6007-6008, 6010-6011, 6013-6016, 6018-6023, 6026-6028, 6031-6032, 6034-6037, 6040, 6042-6044, 6046-6049, 6051-6054, 6056, 6058, 6061-6065, 6067-6068, 6070-6074, 6076, 6078-6082, 6085-6098, 6102-6118, 6121, 6124-6127, 6131-6138, 6140, 6142-6145, 6147, 6151, 6154-6155, 6158-6160, 6162-6165, 6167, 6171-6173, 6177, 6180, 6182, 6184, 6186-6194, 6196-6200, 6202-6207, 6209, 6211-6213, 6216, 6223, 6228-6229, 6231, 6236-6239, 6249-6251, 6254-6255, 6259, 6261-6263, 6265, 6271-6272, 6274-6276, 6278-6279, 6281-6282, 6284-6285, 6287, 6290, 6292, 6295-6299, 6301, 6303, 6307-6310, 6312-6313, 6317-6319, 6323-6326, 6329, 6333-6334, 6336, 6340, 6342-6348, 6354-6355, 6359, 6366-6367, 6369-6373, 6375-6377, 6379-6385, 6387-6389, 6391, 6393, 6395-6399, 6401-6404, 6413-6415, 6418, 6420-6427, 6429-6437, 6439-6444, 6446, 6448, 6450-6456, 6458-6459, 6463-6469, 6471-6472, 6474-6476, 6479, 6483-6489, 6491-6492, 6494, 6496-6497, 6499-6500, 6502-6505, 6507, 6510-6512, 6515-6519, 6522, 6524-6525, 6527-6534, 6536-6539, 6541-6546, 6548-6550, 6552, 6554-6557, 6559, 6562, 6564-6565, 6567-6568, 6570-6573, 6575, 6578-6584, 6587, 6590-6594, 6596-6598, 6600, 6602-6603, 6605-6614, 6616, 6618-6620, 6622-6623, 6625-6628, 6630-6632, 6634, 6637-6642, 6644, 6646-6650, 6655-6663, 6666, 6668, 6670-6671, 6677-6678, 6680-6690, 6692, 6695-6696, 6698-6701, 6705-6707, 6709-6711, 6713-6719, 6721-6723, 6725-6726, 6728-6731, 6733-6734, 6737, 6739-6747, 6750-6751, 6754, 6756, 6758, 6760-6761, 6766, 6769-6771, 6773, 6775-6779, 6782-6783, 6786, 6791, 6793, 6795, 6797-6798, 6803-6808, 6810, 6813, 6816, 6819-6822, 6824-6826, 6828-6829, 6833-6838, 6841-6842, 6844-6846, 6848-6850, 6854-6855, 6857-6864, 6867, 6871-6885, 6887-6888, 6893, 6896-6897, 6900-6902, 6905-6907, 6909-6926, 6929, 6931-6943, 6945-6947, 6949-6954, 6956-6961, 6963-6967, 6970, 6972-6974, 6976-6980, 6983-6985, 6988, 6990-6992, 6994-6996, 6998, 7000-7002, 7004-7006, 7008, 7010-7017, 7019-7020, 7022-7023, 7025, 7037, 7039-7042, 7046-7048, 7050, 7053-7054, 7056, 7058-7059, 7061, 7064-7067, 7069-7070, 7072-7079, 7081, 7083-7084, 7087-7088, 7091-7095, 7098-7102, 7105-7107, 7109-7110, 7112-7113, 7116-7117, 7119-7120, 7122, 7124, 7128, 7130-7131, 7133-7135, 7141, 7143, 7145, 7149-7150, 7152-7153, 7155-7164, 7166-7168, 7178-7181, 7183-7187, 7194, 7196, 7198, 7200, 7202-7207, 7209, 7211-7212, 7215-7216, 7219-7222, 7224, 7227-7229, 7232, 7234-7238, 7241-7249, 7251-7254, 7258-7262, 7264, 7267-7268, 7271-7275, 7279, 7281-7282, 7284, 7286-7292, 7294, 7296-7303, 7305-7311, 7315-7318, 7320-7321, 7324, 7326-7328, 7331-7332, 7334, 7336-7338, 7346, 7350-7351, 7354, 7356, 7358-7362, 7364-7366, 7368, 7371-7372, 7375-7378, 7381-7383, 7387, 7392-7404, 7407-7412, 7414, 7417-7420, 7422, 7427-7430, 7432-7435, 7438, 7440-7441, 7444-7446, 7449, 7451-7455, 7457, 7460, 7462-7463, 7465-7467, 7469-7470, 7472, 7475, 7477, 7480-7481, 7483-7487, 7489-7496, 7498, 7503, 7505, 7509-7515, 7521, 7523, 7526, 7528, 7537-7543, 7545-7550, 7552, 7554, 7556, 7559, 7561-7562, 7564-7566, 7568, 7570-7571, 7573-7575, 7577-7578, 7580-7583, 7587-7588, 7590-7591, 7594, 7596, 7599-7601, 7604, 7607-7610, 7612-7617, 7621, 7624, 7627, 7630-7632, 7634, 7636-7637, 7639-7641, 7644-7645, 7647-7651, 7653-7656, 7659, 7662-7664, 7667-7668, 7670-7672, 7674-7679, 7681-7682, 7684, 7686, 7689, 7691, 7695-7701, 7703-7709, 7713, 7716-7724, 7729, 7732-7733, 7738-7741, 7745, 7748-7753, 7755-7758, 7762-7763, 7766-7779, 7781-7783, 7785, 7788, 7790-7794, 7796-7798, 7801, 7803, 7805-7810, 7813-7814, 7819, 7821-7825, 7827-7828, 7830, 7832-7837, 7839-7840, 7842, 7844-7847, 7849, 7851-7855, 7858, 7860, 7862, 7868-7875, 7877-7879, 7881, 7883-7888, 7890-7895, 7898-7899, 7902-7903, 7906-7907, 7909-7911, 7914-7915, 7917-7918, 7921-7922, 7924, 7926, 7928-7930, 7932-7933, 7935, 7937-7939, 7941-7942, 7945-7949, 7951-7952, 7954, 7956, 7958-7963, 7970, 7972-7975, 7979, 7981, 7983, 7985-7986, 7988-7989, 7991, 7996-7997, 7999, 8001, 8003, 8005-8006, 8009-8016, 8018-8021, 8023, 8025-8028, 8030, 8034-8036, 8038-8040, 8042-8043, 8047-8049, 8055, 8057-8060, 8062-8063, 8065-8068, 8071-8072, 8074-8075, 8077, 8079-8083, 8085-8090, 8095, 8099-8103, 8105-8108, 8110, 8112-8115, 8118, 8120-8122, 8125-8127, 8133-8138, 8140-8144, 8146-8148, 8150-8152, 8157-8158, 8160, 8162-8163, 8165-8169, 8172-8175, 8178-8179, 8182-8183, 8185-8187, 8189-8192, 8196, 8198, 8200, 8202-8204, 8207, 8209, 8211, 8214-8218, 8220-8221, 8224-8227, 8233-8235, 8239-8253, 8255-8263, 8266-8269, 8271, 8274, 8276-8278, 8280, 8284, 8287, 8290, 8293-8301, 8303, 8305, 8307-8308, 8312-8313, 8315-8317, 8319-8320, 8322, 8324, 8326-8328, 8330-8331, 8334-8340, 8343-8361, 8364, 8366-8368, 8370-8375, 8377-8380, 8382-8386, 8388-8392, 8395-8400, 8402-8403, 8410-8411, 8413, 8415-8419, 8425-8426, 8428-8430, 8433-8436, 8438-8440, 8442-8443, 8445-8446, 8448-8453, 8455, 8457, 8459-8467, 8469, 8471-8475, 8478-8481, 8483, 8485-8487, 8490, 8492-8496, 8499-8502, 8504-8506, 8508-8517, 8520-8523, 8526-8527, 8529-8530, 8532-8533, 8535-8543, 8548-8554, 8556-8563, 8565-8566, 8569-8574, 8577-8579, 8581-8582, 8584, 8587, 8591, 8593-8596, 8598-8601, 8605, 8607, 8609-8610, 8615, 8617-8618, 8620-8623, 8625, 8627-8629, 8631-8634, 8636, 8638, 8641-8642, 8644-8646, 8648-8650, 8660-8662, 8665-8670, 8672, 8677-8678, 8680-8681, 8683, 8685-8692, 8694-8695, 8697, 8701-8702, 8706, 8708-8714, 8716-8721, 8723-8728, 8734-8743, 8747, 8749-8753, 8755-8758, 8760, 8762-8763, 8765, 8767-8769, 8772-8773, 8776, 8780-8785, 8787-8788, 8792, 8797, 8800-8806, 8809, 8813-8814, 8817, 8820-8822, 8824-8841, 8843-8847, 8849-8851, 8853, 8861-8862, 8864-8866, 8868, 8871, 8877, 8880, 8883, 8885, 8887-8889, 8892, 8896-8897, 8899, 8901-8905, 8907-8908, 8910-8915, 8920-8922, 8924-8925, 8927, 8929-8932, 8934, 8936-8939, 8941, 8943, 8945-8947, 8950, 8952, 8955-8956, 8958-8959, 8961-8963, 8966-8968, 8972, 8974, 8978, 8980-8981, 8983, 8985-8986, 8988, 8990-8991, 8993-8996, 8998-9001, 9003, 9007-9008, 9010, 9017-9018, 9022-9025, 9033-9034, 9036-9039, 9041-9044, 9048-9049, 9052, 9054, 9058-9059, 9061, 9067-9070, 9075-9076, 9079-9086, 9089-9096, 9098, 9100-9102, 9106, 9111-9113, 9120, 9123, 9127, 9129, 9131-9132, 9134-9136, 9138, 9140-9141, 9143, 9145, 9147-9149, 9152, 9154, 9157, 9162, 9164, 9166-9168, 9171, 9173-9175, 9177, 9180, 9183-9185, 9187, 9189, 9191-9196, 9198-9207, 9217-9218, 9220-9226, 9228, 9233-9239, 9241, 9243-9246, 9248, 9252-9261, 9263-9265, 9268-9269, 9271-9273, 9276-9279, 9282-9284, 9287-9288, 9291, 9293-9294, 9298, 9301, 9303-9307, 9309, 9314-9316, 9318, 9320-9323, 9325, 9327-9329, 9331-9332, 9334, 9336-9337, 9340-9342, 9344-9346, 9349, 9351, 9354-9360, 9363, 9365, 9368, 9370-9371, 9373, 9376-9378, 9381, 9384, 9386-9394, 9399, 9402-9403, 9405, 9407-9410, 9415, 9418-9425, 9427, 9431-9436, 9438-9441, 9444-9458, 9462-9468, 9472, 9475-9476, 9478-9485, 9487-9488, 9490, 9492-9494, 9496-9497, 9499-9501, 9503-9504, 9506-9510, 9513-9514, 9516-9517, 9519-9522, 9524, 9528, 9530-9535, 9540-9542, 9544-9546, 9549-9558, 9560, 9562-9565, 9568-9571, 9575, 9577, 9579-9581, 9584-9587, 9590-9592, 9594, 9596-9600, 9603-9604, 9607, 9609, 9611-9613, 9618-9620, 9622-9626, 9628, 9631-9632, 9639, 9643-9650, 9656, 9658, 9662-9667, 9670, 9673-9674, 9676-9680, 9682-9685, 9687-9690, 9694-9704, 9706-9707, 9709-9710, 9712-9713, 9715, 9717-9720, 9722-9724, 9727-9732, 9734, 9737-9740, 9743, 9746-9751, 9753-9754, 9757, 9759-9761, 9763, 9765-9766, 9768, 9770, 9773, 9777-9783, 9785-9797, 9799, 9801-9802, 9809-9810, 9813, 9817-9820, 9822-9829, 9831, 9833, 9835, 9837-9842, 9844, 9846-9849, 9851-9853, 9855-9857, 9863, 9865, 9871, 9875, 9877-9881, 9883-9887, 9890-9892, 9894-9896, 9898, 9900, 9902-9905, 9907, 9910-9911, 9916-9926, 9929, 9931-9932, 9934-9935, 9942-9944, 9947-9950, 9952, 9954, 9956-9957, 9962, 9964-9968, 9971, 9974-9975, 9977-9980, 9982-9983, 9985-9986, 9988-9997, 9999-10011, 10013-10016, 10018-10022, 10027, 10029-10030, 10032-10033, 10035, 10040, 10042, 10045-10049, 10051, 10053-10056, 10059-10060, 10062, 10064-10065, 10067-10068, 10070, 10074-10076, 10078-10083, 10085-10086, 10090-10092, 10094, 10096-10099, 10101-10102, 10107-10108, 10110-10111, 10114-10118, 10120-10121, 10125-10140, 10143-10144, 10147-10148, 10153-10155, 10157, 10159-10160, 10163, 10165, 10168-10173, 10175-10177, 10184, 10194, 10197, 10199-10202, 10208-10212, 10214-10219, 10222-10225, 10227, 10230-10235, 10237, 10239-10240, 10242-10243, 10248, 10250-10251, 10254-10260, 10262, 10264, 10266-10269, 10272-10283, 10285-10290, 10292, 10294-10297, 10301, 10305-10312, 10315, 10319, 10321-10323, 10325-10328, 10331, 10334-10340, 10342-10345, 10347-10348, 10351-10355, 10357-10368, 10370-10371, 10373, 10378-10379, 10382-10383, 10385, 10387-10389, 10391, 10393, 10395-10398, 10400, 10403-10407, 10409-10413, 10416, 10421, 10423, 10425-10427, 10429-10431, 10434, 10437, 10439-10440, 10442-10449, 10452, 10458-10460, 10462-10467, 10470-10472, 10474, 10476-10482, 10484, 10486-10492, 10494, 10496, 10498-10506, 10509, 10512-10517, 10519, 10521, 10523-10524, 10526, 10528, 10530, 10532-10533, 10537, 10547-10553, 10557-10560, 10563-10564, 10566, 10572-10578, 10580, 10585, 10587-10588, 10590, 10594-10595, 10598-10603, 10605-10606, 10608, 10610, 10612-10613, 10616, 10618, 10620-10623, 10626-10627, 10629-10633, 10635, 10637-10638, 10641, 10644-10645, 10647, 10650, 10652, 10654, 10656, 10669-10671, 10673-10674, 10678-10679, 10682-10688, 10690-10692, 10694-10697, 10699-10700, 10702, 10704-10709, 10711-10712, 10715, 10718, 10720-10723, 10725-10727, 10729, 10733, 10735-10736, 10739-10743, 10745-10746, 10749, 10752, 10754-10759, 10761, 10764, 10766-10776, 10778-10779, 10782-10784, 10786-10792, 10794-10804, 10807-10811, 10813-10814, 10816, 10818-10821, 10823-10827, 10829-10834, 10838-10843, 10845-10846, 10849-10859, 10863, 10866-10874, 10876-10881, 10883-10885, 10887-10890, 10892-10897, 10899-10901, 10903-10915, 10918-10925, 10927-10931, 10933, 10938-10941, 10946-10953, 10955, 10957-10963, 10966-10967, 10969-10972, 10974, 10977-10980, 10984, 10990-10993, 10995, 10997-10998, 11000, 11005, 11007, 11011-11012, 11014-11015, 11017-11021, 11023-11027, 11029-11030, 11032, 11035, 11039, 11041, 11043, 11045, 11047, 11052, 11054, 11056-11058, 11066, 11069, 11072-11075, 11077-11078, 11081, 11084-11085, 11093-11095, 11097-11099, 11103-11104, 11106, 11112-11114, 11119-11120, 11122, 11124, 11126, 11128, 11130, 11134-11138, 11140, 11143-11152, 11154, 11156-11159, 11161-11162, 11167-11168, 11170, 11173, 11175-11183, 11185-11189, 11199-11202, 11204-11205, 11207-11208, 11210, 11213, 11215-11218, 11220, 11222-11223, 11226-11227, 11229, 11231-11233, 11235-11243, 11245-11246, 11248, 11250-11251, 11254, 11257-11263, 11266-11269, 11271-11272, 11274-11279, 11281-11282, 11284-11298, 11300-11302, 11308-11309, 11312-11313, 11317-11319, 11322-11323, 11327-11329, 11331-11332, 11334-11345, 11348-11349, 11352-11354, 11357-11359, 11361-11366, 11368, 11372-11375, 11377-11380, 11382-11383, 11386-11392, 11394, 11397, 11399, 11401-11407, 11409-11410, 11412-11418, 11423-11425, 11429-11431, 11435-11437, 11439, 11441-11444, 11447-11453, 11455-11457, 11459, 11462, 11465, 11467-11468, 11470, 11474-11475, 11477-11482, 11485-11489, 11494, 11496-11500, 11502-11507, 11510, 11512, 11514, 11516, 11518, 11521-11523, 11525-11526, 11528-11530, 11532, 11534, 11536-11538, 11540-11541, 11543-11548, 11551-11552, 11554-11559, 11563-11565, 11568, 11571, 11574, 11582-11583, 11587, 11589, 11596-11597, 11599, 11602-11603, 11608, 11611, 11613-11615, 11617, 11619-11621, 11624-11628, 11630, 11632, 11639, 11641, 11644-11647, 11649-11653, 11656, 11660-11661, 11664-11665, 11667-11668, 11670, 11674-11675, 11677-11679, 11681, 11685-11692, 11694, 11697-11700, 11704-11712, 11714-11716, 11718-11724, 11726-11728, 11731, 11734-11736, 11741-11742, 11744, 11746, 11754-11759, 11761-11764, 11766-11767, 11773, 11777, 11779-11782, 11785-11787, 11789-11790, 11792-11793, 11795-11797, 11799, 11806-11810, 11812-11813, 11817-11818, 11821-11824, 11826-11827, 11830-11835, 11837-11840, 11842-11845, 11848-11849, 11852-11856, 11861, 11865-11867, 11870-11872, 11875-11882, 11884, 11886-11888, 11890, 11892, 11894-11900, 11902, 11904-11907, 11909-11910, 11912-11915, 11918, 11922, 11924, 11926-11927, 11929-11931, 11933-11934, 11938-11942, 11944-11947, 11949-11950, 11952-11958, 11960-11963, 11966-11969, 11972-11980, 11982-11984, 11986, 11989-11995, 11997-11998, 12003, 12005-12006, 12008-12010, 12012-12017, 12020-12025, 12027-12030, 12033, 12035-12036, 12040-12043, 12045, 12047, 12049-12052, 12054, 12057-12058, 12060-12062, 12064-12066, 12069-12070, 12073, 12076, 12078, 12081-12082, 12084, 12089, 12091-12092, 12094, 12096-12103, 12105-12107, 12109, 12111, 12113, 12121, 12123-12125, 12127-12129, 12131, 12133-12134, 12136-12139, 12142-12144, 12146-12152, 12154-12156, 12158-12160, 12162-12168, 12170-12171, 12176-12177, 12179-12180, 12182, 12184-12186, 12188, 12190-12194, 12196-12199, 12201, 12204-12205, 12207, 12214-12216, 12218, 12220-12221, 12225, 12227, 12230, 12232-12234, 12241, 12244-12246, 12248, 12250-12251, 12258, 12260-12265, 12269, 12272, 12274, 12276-12278, 12280-12285, 12287, 12291, 12293-12296, 12298, 12300-12303, 12305, 12307-12314, 12318-12320, 12322-12327, 12337-12338, 12341-12342, 12344-12345, 12347, 12350-12351, 12358-12360, 12363-12364, 12366, 12372, 12374-12380, 12382-12383, 12388, 12390, 12392-12397, 12401-12410, 12416, 12419, 12423, 12427-12436, 12438, 12444, 12446-12454, 12458, 12460-12463, 12474-12475, 12477, 12484-12485, 12488, 12490, 12493, 12501, 12505, 12510, 12514, 12516-

12518, 12520-12522, 12524-12526, 12528, 12531, 12533-12534, 12540-12542, 12544-12549, 12556-12560, 12562, 12565-12566, 12569-12574, 12576, 12578, 12582-12583, 12586, 12593, 12595-12596, 12600-12601, 12603-12613, 12615, 12618-12624, 12627-12629, 12631-12632, 12636, 12639-12640, 12643, 12647, 12649-12651, 12653, 12657-12661, 12663-12665, 12667-12668, 12670-12672, 12674-12687, 12689-12692, 12694-12695, 12697, 12706-12707, 12709, 12711, 12713-12714, 12716, 12718, 12720-12722, 12725-12727, 12729, 12733-12736, 12738-12745, 12748-12752, 12754, 12757, 12759-12760, 12763-12766, 12769, 12772, 12775-12778, 12780-12784, 12787, 12797, 12799-12802, 12807-12814, 12816-12817, 12824-12827, 12830, 12835-12837, 12841-12842, 12844-12845, 12850, 12852, 12854, 12860-12869, 12871, 12874, 12876-12878, 12886-12887, 12891, 12893-12894, 12896-12898, 12903-12905, 12907, 12915, 12917-12918, 12920-12928, 12930, 12933, 12936, 12944, 12947-12949, 12952, 12960, 12962-12968, 12970, 12972, 12974-12978, 12980-12984, 12986-12990, 12992, 12994, 12996, 12999-13003, 13005, 13007-13008, 13010-13013, 13015-13018, 13021-13022, 13024-13034, 13036-13038, 13041-13042, 13044-13045, 13049-13058, 13060-13067, 13069, 13071, 13073-13078, 13080-13081, 13083-13084, 13087-13088, 13090, 13097-13099, 13101-13104, 13109, 13111-13114, 13117, 13123-13124, 13134-13137, 13139, 13147-13151, 13153-13162, 13164-13165, 13169-13170, 13172-13173, 13176-13177, 13181, 13185, 13187, 13189, 13191-13193, 13195-13200, 13202, 13206-13213, 13215-13216, 13220, 13222-13223, 13225-13227, 13232-13233, 13235, 13239-13245, 13247-13249, 13251-13254, 13257-13258, 13262, 13264-13269, 13271-13275, 13278-13279, 13283, 13286-13287, 13291-13292, 13294-13298, 13300, 13302-13308, 13310, 13312-13314, 13316, 13318, 13321, 13323-13325, 13327-13334, 13338-13339, 13341, 13343-13344, 13347, 13349, 13352-13354, 13356-13358, 13360-13362, 13364-13366, 13368-13372, 13374-13375, 13377, 13379-13380, 13383-13384, 13391, 13393-13395, 13397-13398, 13404, 13406-13411, 13413-13414, 13417-13422, 13426-13428, 13430-13432, 13435-13436, 13438-13441, 13443-13444, 13446, 13452-13453, 13455-13456, 13461-13462, 13464-13470, 13472, 13475, 13477-13481, 13483, 13485, 13487, 13493-13501, 13503, 13506-13507, 13511, 13513, 13515-13518, 13520-13523, 13526, 13529-13531, 13534-13535, 13537-13542, 13544-13545, 13550, 13555, 13558-13560, 13562, 13564, 13566, 13568-13569, 13571-13573, 13578-13582, 13584-13589, 13591, 13593-13594, 13596-13598, 13600, 13602-13605, 13607-13608, 13610-13612, 13617-13619, 13621-13623, 13625-13626, 13629-13630, 13632-13633, 13636, 13641, 13647-13649, 13656-13661, 13664-13670, 13672, 13676, 13678, 13680, 13682-13684, 13687-13692, 13694-13698, 13700-13702, 13704-13705, 13708-13709, 13713-13719, 13722-13724, 13726-13730, 13732-13739, 13741-13742, 13744, 13746-13748, 13750-13753, 13755, 13757-13758, 13760-13765, 13767, 13771, 13775, 13778, 13782-13783, 13785, 13787-13794, 13796, 13799-13801, 13804, 13806-13807, 13809, 13811-13817, 13819-13821, 13823-13824, 13829-13830, 13834, 13838-13843, 13845, 13847-13849, 13851-13857, 13859-13860, 13862-13864, 13866, 13869, 13872, 13874-13878, 13881-13882, 13885-13886, 13890, 13894-13900, 13904, 13909-13911, 13913-13914, 13916-13924, 13926-13931, 13936, 13939-13940, 13942-13957, 13959-13960, 13962-13963, 13969-13971, 13973-13974, 13976-13983, 13985-13987, 13990-13991, 13993, 13996-14010, 14012-14016, 14018-14020, 14023-14030, 14033, 14035-14036, 14038-14041, 14043, 14045-14052, 14055-14057, 14059-14063, 14065-14067, 14069, 14071-14072, 14074-14075, 14078, 14081-14083, 14086, 14088-14094, 14100, 14103, 14105-14107, 14110-14112, 14115-14119, 14121-14127, 14129, 14132-14134, 14136-14140, 14142-14143, 14145-14148, 14151-14157, 14159, 14167-14168, 14170-14173, 14175, 14177-14184, 14190-14192, 14195-14199, 14201-14202, 14204-14205, 14207-14208, 14210, 14212, 14216-14221, 14225, 14227, 14229-14234, 14237-14239, 14242-14243, 14246-14247, 14250-14256, 14258-14263, 14265-14266, 14269-14270, 14272-14274, 14276, 14279-14283, 14286-14289, 14291-14294, 14298-14302, 14304, 14306-14310, 14312, 14314-14315, 14317-14322, 14326, 14328-14330, 14333-14336, 14339-14342, 14345, 14348-14354, 14366-14370, 14372, 14375-14385, 14387-14390, 14392-14398, 14402-14409, 14413-14416, 14418-14421, 14423-14424, 14426-14427, 14429-14433, 14435-14437, 14439-14440, 14443, 14447-14453, 14456-14472, 14476-14479, 14485-14486, 14490-14499, 14503-14505, 14508-14509, 14513, 14515-14517, 14519-14522, 14524, 14532-14533, 14536, 14540, 14544-14545, 14548-14549, 14552-14553, 14555-14556, 14559, 14561-14565, 14567, 14569-14570, 14572-14574, 14576-14588, 14590, 14592-14595, 14600-14607, 14612-14613, 14617-14618, 14620-14628, 14630, 14634-14635, 14637, 14640-14652, 14654-14657, 14660, 14662, 14664, 14667, 14672-14673, 14678-14683, 14685-14686, 14688, 14691-14695, 14697-14701, 14703-14705, 14708-14715, 14717-14720, 14723-14724, 14726, 14729, 14731, 14733, 14735-14739, 14742-14743, 14745-14746, 14748, 14750, 14754-14755, 14758, 14761-14762, 14765-14768, 14771-14783, 14789, 14791-14793, 14795-14799, 14802-14805, 14807, 14809-14815, 14822-14824, 14826, 14829-14830, 14838-14839, 14844-14845, 14847-14850, 14852, 14855-14857, 14861-14872, 14874, 14878-14880, 14882-14883, 14885, 14887-14888, 14890, 14893, 14896, 14899-14900, 14902-14906, 14910, 14913-14917, 14919, 14921-14924, 14926-14928, 14930, 14932-14934, 14936-14939, 14944, 14946-14950, 14952, 14955-14960, 14962, 14966-14968, 14970, 14972, 14974-14975, 14977, 14979-14980, 14985-14986, 14988-14997, 14999-15008, 15011-15014, 15016-15018, 15020-15023, 15025-15029, 15031-15035, 15037, 15039-15041, 15044-15046, 15054-15055, 15059, 15061, 15065, 15067-15074, 15076, 15080-15081, 15085, 15087-15088, 15090-15093, 15095-15099, 15102, 15104-15112, 15114-15116, 15118, 15121-15122, 15126-15127, 15129-15131, 15134, 15136, 15141, 15145-15153, 15157, 15159-15160, 15165-15176, 15181, 15184-15185, 15188-15192, 15195, 15197-15198, 15201, 15204-15205, 15208-15209, 15211-15215, 15217-15230, 15232-15235, 15237-15242, 15244-15245, 15247-15250, 15252, 15257, 15259-15261, 15264-15267, 15271-15272, 15274-15278, 15280, 15283, 15285-15289, 15291, 15294-15295, 15299-15300, 15308-15311, 15314-15316, 15318, 15323-15324, 15326-15328, 15330-15334, 15337-15338, 15341, 15343, 15348-15350, 15353-15354, 15357-15359, 15361-15362, 15366, 15369-15374, 15376-15380, 15383-15384, 15386-15396, 15399, 15401, 15404-15414, 15416-15418, 15420-15423, 15427-15432, 15435-15440, 15443-15451, 15454-15455, 15457, 15461, 15463, 15467-15468, 15470, 15472-15477, 15479-15480, 15482, 15484-15490, 15492, 15494-15497, 15503, 15505-15509, 15511, 15513, 15515-15518, 15521-15522, 15525-15527, 15531, 15533, 15535-15543, 15545-15547, 15549, 15552, 15557, 15559-15560, 15562, 15564, 15566, 15568, 15570-15571, 15573-15584, 15586-15588, 15590-15592, 15594-15596, 15598, 15600, 15603-15604, 15606-15607, 15609, 15611-15612, 15615, 15620-15621, 15625-15626, 15632-15638, 15641, 15643, 15649-15652, 15654-15655, 15657-15658, 15660-15662, 15664, 15666, 15672-15675, 15677-15678, 15681-15682, 15686-15688, 15691-15697, 15700, 15702-15703, 15706, 15708-15713, 15715, 15719, 15721, 15726, 15728-15730, 15732-15733, 15735-15738, 15744-15745, 15747-15749, 15751, 15753-15756, 15761, 15763-15764, 15766, 15768-15769, 15774-15778, 15780-15781, 15785, 15789, 15791-15792, 15794, 15796-15800, 15802, 15808, 15814, 15817-15819, 15821-15822, 15824-15825, 15827, 15831, 15833-15834, 15836-15840, 15842-15843, 15845-15847, 15849, 15852, 15855, 15857, 15860-15862, 15864, 15866-15870, 15876, 15878, 15880, 15884-15886, 15893, 15896, 15898-15901, 15903-15904, 15906-15907, 15911, 15914, 15916-15920, 15922-15924, 15926-15930, 15932-15934, 15936, 15938-15939, 15945, 15947, 15949-15950, 15959-15962, 15968-15969, 15972-15978, 15980-15982, 15984-15985, 15988, 15991-15992, 15994, 15997-15998, 16001, 16003, 16005-16007, 16009-16010, 16013-16014, 16016-16018, 16022-16026, 16028, 16030-16032, 16034-16038, 16040-16043, 16049, 16051, 16053-16057, 16061, 16063, 16065, 16067-16073, 16075, 16078-16080, 16085, 16091-16092, 16096-16100, 16102-16103, 16105, 16107, 16109-16110, 16113-16117, 16119, 16121-16124, 16127-16128, 16130-16135, 16138-16139, 16144, 16149, 16151-16156, 16158, 16160-16162, 16164-16165, 16172-16173, 16175-16182, 16184, 16186-16189, 16191-16193, 16197-16199, 16202, 16208-16211, 16213-16214, 16216-16219, 16221-16230, 16232, 16234-16236, 16238-16240, 16242, 16244-16245, 16247-16248, 16250, 16252, 16255-16256, 16262-16263, 16267, 16271, 16273-16277, 16279, 16281, 16286-16287, 16290, 16295, 16297-16298, 16300-16301, 16310, 16312, 16316, 16321-16322, 16324-16326, 16328-16329, 16333-16336, 16339, 16342, 16347, 16349-16358, 16360, 16362-16363, 16372-16373, 16376-16377, 16379-16381, 16388-16389, 16391-16400, 16402, 16407, 16409-16414, 16416, 16418, 16420-16421, 16423-16424, 16427-16428, 16430-16431, 16434, 16436, 16439, 16441-16443, 16445, 16450, 16453, 16455-16456, 16468, 16473-16479, 16481-16482, 16485, 16487-16489, 16495, 16497, 16499, 16501-16503, 16505-16507, 16510-16513, 16515-16517, 16519-16533, 16535-16536, 16538-16539, 16543-16544, 16546, 16548-16552, 16554, 16556, 16558-16561, 16563-16564, 16566, 16568-16570, 16572-16573, 16575-16578, 16580-16586, 16589-16590, 16592-16594, 16596, 16599-16608, 16610, 16612-16614, 16617-16619, 16623-16624, 16626-16629, 16631, 16633-16634, 16636, 16640-16649, 16651-16655, 16657-16664, 16666-16675, 16679-16680, 16682-16690, 16693, 16696-16697, 16701-16704, 16706, 16708, 16711-16718, 16720-16721, 16725, 16728, 16731-16732, 16734, 16736, 16738-16739, 16742, 16745, 16750-16753, 16755-16756, 16760, 16762-16765, 16767-16768, 16771, 16773-16774, 16776-16778, 16782-16787, 16789-16792, 16795-16796, 16799-16800, 16803-16806, 16810-16815, 16818-16823, 16826, 16828-16829, 16831-16833, 16835-16840, 16842, 16845-16848, 16850-16852, 16854-16858, 16862-16863, 16866-16869, 16873-16875, 16884-16886, 16889-16894, 16897-16901, 16904, 16906-16907, 16909, 16911, 16915-16921, 16923, 16925-16927, 16930, 16937-16938, 16940-16941, 16943-16944, 16946, 16951-16953, 16955-16957, 16959, 16961-16966, 16970, 16972-16973, 16975-16976, 16978, 16981, 16983-16985, 16987-16990, 16992, 16994-16997, 16999-17004, 17006-17007, 17010, 17013-17014, 17016-17024, 17026, 17028-17030, 17033-17034, 17037-17043, 17045, 17050-17056, 17060, 17062-17066, 17069-17071, 17075, 17079-17083, 17087, 17089, 17091-17092, 17094-17101, 17103-17106, 17108-17109, 17111-17113, 17117-17124, 17126, 17133, 17136-17139, 17141-17145, 17147, 17149-17151, 17158, 17163, 17166-17170, 17178-17182, 17184, 17186-17188, 17190, 17192, 17194-17197, 17201, 17205, 17207, 17210, 17217-17220, 17223, 17227, 17230-17231, 17233, 17236-17237, 17240-17241, 17243-17244, 17249, 17252, 17255, 17257-17258, 17260, 17262-17266, 17270-17278, 17280, 17283, 17285, 17292-17293, 17295, 17302, 17305-17307, 17309-17311, 17313, 17318-17321, 17323, 17325, 17327-17328, 17330, 17332-17334, 17338-17339, 17341, 17343-17346, 17349-17353, 17356, 17360, 17363, 17368, 17370, 17372, 17374, 17377-17379, 17381-17396, 17398-17400, 17402-17403, 17406-17407, 17409-17410, 17414-17419, 17421, 17423-17427, 17432-17439, 17443, 17445, 17447-17449, 17451-17454, 17457-17459, 17462-17463, 17465-17467, 17469-17470, 17472-17476, 17478-17479, 17481-17483, 17486, 17488-17489, 17491-17500, 17502-17510, 17512-17515, 17518-17521, 17524, 17526, 17529, 17531-17532, 17534, 17537, 17540-17542, 17545-17547, 17549-17557, 17559, 17561-17565, 17571-17573, 17576-17581, 17584-17586, 17589-17590, 17592-17595, 17600, 17602, 17605, 17611-17613, 17615, 17621-17624, 17629, 17631-17633, 17635-17639, 17641-17648, 17650, 17652-17653, 17656-17657, 17659-17661, 17665-17667, 17669-17674, 17680-17689, 17692, 17695-17696, 17698-17702, 17704-17708, 17715, 17718, 17720, 17723, 17725, 17727, 17730-17735, 17737-17739, 17742-17745, 17747-17749, 17752-17754, 17764-17765, 17768, 17770-17773, 17778-17786, 17788-17793, 17795-17798, 17801, 17803-17807, 17809-17815, 17819-17820, 17822, 17824-17826, 17830-17834, 17838, 17840-17841, 17844-17845, 17847-17850, 17854-17858, 17860-17861, 17863, 17865, 17867-17868, 17870, 17872-17874, 17876-17878, 17880-17881, 17884, 17886, 17888, 17890-17891, 17893-17894, 17896-17900, 17905-17933, 17935, 17937-17940, 17943-17945, 17947-17955, 17958-17961, 17963-17964, 17967, 17980, 17982, 17986, 17988-17994, 17997, 17999-18000, 18002-18005, 18007-18014, 18016-18025, 18029, 18031, 18033-18035, 18038, 18041-18043, 18045-18049, 18051, 18053, 18056-18062, 18064-18065, 18067-18076, 18078, 18081-18082, 18084, 18086-18090, 18092-18098, 18100-18102, 18104-18107, 18109, 18112, 18119-18122, 18125-18126, 18128, 18133, 18137-18140, 18142, 18144-18145, 18147, 18149-18150, 18152, 18155, 18157-18160, 18163-18165, 18170-18175, 18177-18178, 18180-18182, 18184-18185, 18188-18193, 18195-18198, 18200, 18203-18204, 18208-18217, 18219, 18222-18229, 18232-18236, 18238-18241, 18243-18249, 18251-18252, 18256-18258, 18261-18262, 18264-18267, 18270, 18272-18277, 18279, 18282, 18284-18287, 18289-18295, 18298-18301, 18304-18306, 18308-18314, 18316-18317, 18319, 18323-18324, 18328-18333, 18335-18336, 18338, 18342-18345, 18350, 18352, 18359, 18362, 18365-18369, 18374-18387, 18389-18395, 18397-18398, 18401, 18403, 18405-18406, 18414-18415, 18417-18418, 18420-18421, 18423-18425, 18427-18430, 18432-18434, 18438-18439, 18441-18442, 18444-18446, 18450-18452, 18455-18460, 18463-18465, 18467-18471, 18474-18483, 18485-18488, 18490-18493, 18496, 18499, 18501, 18503, 18507, 18509, 18513-18515, 18518-18520, 18523-18525, 18528-18529, 18531, 18533, 18536, 18539-18541, 18549-18551, 18553-18557, 18559-18567, 18570-18573, 18575-18578, 18582-18586, 18588-18599, 18601-18603, 18605, 18609, 18611-18612, 18620, 18622, 18624, 18626, 18628-18629, 18631, 18633, 18635-18642, 18646-18649, 18651, 18654-18657, 18664, 18666-18668, 18671-18672, 18674-18675, 18678, 18681-18686, 18689-18690, 18692-18693, 18695, 18697, 18699-18700, 18702-18704, 18706, 18709, 18711-18712, 18714-18715, 18717, 18720, 18733, 18735-18736, 18739-18742, 18744-18747, 18749-18750, 18754, 18756-18758, 18760, 18762-18766, 18768, 18771-18773, 18775-18778, 18781-18782, 18785-18786, 18788, 18790, 18792-18797, 18799-18802, 18807-18809, 18814, 18816, 18818-18820, 18823, 18825, 18829, 18835, 18839-18840, 18843-18847, 18849-18852, 18857-18861, 18865, 18868-18876, 18878, 18880-18887, 18889-18890, 18892, 18896-18897, 18899-18900, 18903, 18905-18906, 18909-18911, 18913, 18916, 18918-18919, 18921-18922, 18925, 18931, 18934, 18936-18937, 18941-18943, 18948, 18951, 18956, 18958-18960, 18962, 18965-18970, 18972-18975, 18977-18980, 18982-18992, 18995, 18997, 19001, 19008, 19010, 19012-19018, 19020, 19022, 19024-19025, 19028-19033, 19036-19046, 19048-19054, 19057-19058, 19060-19066, 19068-19073, 19075, 19079, 19082-19083, 19089, 19102-19103, 19108, 19111-19115, 19117, 19120-19124, 19126, 19128, 19130-19132, 19137-19139, 19141-19142, 19144-19150, 19152-19156, 19160-19163, 19166-19181, 19183, 19187-19194, 19197, 19199, 19201, 19205, 19208-19209, 19212, 19214, 19216-19218, 19220-19221, 19224, 19228, 19231, 19233-19236, 19240-19241, 19244, 19246-19259, 19266, 19268-19269, 19271, 19274-19275, 19277-19279, 19281, 19286-19288, 19294-19295, 19297-19298, 19301-19305, 19307, 19311, 19313, 19315, 19317-19319, 19321-19323, 19325, 19327-19329, 19331, 19335-19338, 19340-19342, 19345, 19347-19350, 19353-19355, 19357, 19360-19364, 19366, 19368-19369, 19373, 19375, 19377-19378, 19382-19386, 19388-19390, 19395-19401, 19403-19404, 19407-19408, 19410, 19412-19414, 19419, 19421-19423, 19425-19429, 19431-19432, 19434, 19436-19437, 19439, 19441-19442, 19448-19452, 19454, 19456, 19458-19468, 19470, 19472, 19474, 19478, 19481-19483, 19485, 19487-19488, 19492, 19496-19498, 19501, 19504, 19507-19514, 19516-19522, 19524-19526, 19528, 19530-19531, 19535, 19538, 19541, 19543, 19548-19549, 19556-19558, 19560-19563, 19565, 19567-19570, 19573-19574, 19576, 19579-19581, 19583, 19585, 19593-19601, 19603-19616, 19618-19621, 19624-19625, 19627-19628, 19630, 19632-19636, 19639-19644, 19646, 19649, 19653-19657, 19659, 19661-19664, 19666-19668, 19673-19676, 19680-19683, 19687, 19689-19690, 19692-19696, 19698-19699, 19701, 19703, 19706-19707, 19709, 19712-19718, 19725-19726, 19728-19730, 19732-19735, 19738, 19740, 19742-19745, 19748-19749, 19751, 19753-19758, 19760, 19762-19764, 19766, 19768, 19770-19771, 19773-19782, 19784, 19787, 19789-19794, 19797, 19799, 19802-19804, 19806, 19809-19815, 19817-19827, 19829-19833, 19836-19837, 19839-19841, 19846, 19849, 19852, 19857, 19859, 19863, 19866, 19869-19871, 19873, 19881, 19885-19886, 19890-19893, 19895-19896, 19898-19902, 19904, 19915, 19919, 19926, 19928-19930, 19933, 19943-19944, 19947-19949, 19951-19952, 19954-19955, 19960-19961, 19963-19965, 19967-19968, 19970-19975, 19977-19979, 19982-19983, 19986-19987, 19989-19991, 19993, 19995-19997, 20002, 20004, 20006-20009, 20013-20027, 20029-20030, 20032, 20036-20041, 20043-20044, 20047-20051, 20053-20066, 20070-20077, 20079-20080, 20083-20094, 20096-20098, 20100-20101, 20104-20108, 20110-20112, 20115, 20117-20121, 20125-20126, 20128-20130, 20134-20136, 20138, 20140, 20143, 20148-20149, 20152-20153, 20155, 20157, 20161-20162, 20164-20165, 20168, 20175, 20177, 20183-20184, 20186, 20188-20189, 20192-20195, 20200-20202, 20207-20210, 20214, 20218, 20221-20226, 20228-20234, 20237-20240, 20242, 20244, 20246, 20248-20253, 20257, 20259-20260, 20265, 20267-20268, 20270-20274, 20276, 20279-20287, 20289-20292, 20294-20295, 20298-20299, 20301, 20303, 20305, 20309-20311, 20314, 20316, 20318, 20320, 20322, 20324, 20329, 20332-20333, 20338, 20342, 20351-20358, 20360-20361, 20366, 20368-20374, 20376-20381, 20383, 20385-20391, 20393-20394, 20396-20400, 20402, 20404-20407, 20409, 20412, 20416-20417, 20419-20423, 20425, 20430-20438, 20441-20443, 20445, 20448, 20451-20453, 20456, 20458, 20460-20462, 20464, 20466, 20468-20472, 20474, 20477-20479, 20484, 20486, 20488-20491, 20493-20494, 20504, 20506-20508, 20511-20513, 20515-20519, 20521, 20523-20524, 20528-20529, 20532, 20535-20537, 20541, 20543-20545, 20547, 20551-20560, 20564-20565, 20567-20568, 20570, 20572, 20577, 20581-20583, 20585-20586, 20588, 20594-20596, 20599, 20601-20602, 20604-20606, 20608, 20613-20615, 20617-20618, 20625, 20627-20630, 20632-20640, 20642, 20651, 20658-20659, 20661, 20663-20666, 20668, 20670-20671, 20680-20682, 20685, 20687-20688, 20690-20692, 20694, 20699, 20703, 20707-20710, 20712-20717, 20721-20722, 20726-20727, 20730-20731, 20734, 20740-20741, 20745, 20747, 20749, 20751, 20756-20762, 20768, 20772-20783, 20785, 20789-20791, 20794-20797, 20799-20801, 20803-20808, 20814, 20816, 20818, 20827, 20829-20830, 20833, 20835-20836, 20842, 20850, 20852-20854, 20856, 20858, 20860, 20862, 20864, 20868-20872, 20880-20881, 20884-20887, 20891-20893, 20901, 20903, 20905-20906, 20913-20916, 20918, 20920, 20923, 20926-20927, 20931, 20936, 20941-20943, 20945, 20947-20948, 20950-20953, 20956, 20959-20960, 20963-20964, 20968-20974, 20978-20980, 20984-20985, 20987, 20990-20998, 21000-21002, 21011-21012, 21021-21030, 21032-21033, 21035-21036, 21039, 21043-21044, 21047-21049, 21053, 21055-21056, 21058, 21060, 21062-21068, 21070-21071, 21073, 21075, 21077, 21080, 21083-21087, 21093, 21102-21103, 21106-21108, 21110, 21112-21113, 21118-21120, 21123-21127, 21129-21136, 21138, 21141-21149, 21151, 21153, 21156-21158, 21161, 21165-21166, 21168, 21170-21171, 21173, 21175-21182, 21184, 21187, 21191, 21194-21196, 21198, 21200-21204, 21210, 21213, 21216, 21218-21220, 21223-21224, 21226, 21228, 21230, 21234, 21236-21237, 21239-21240, 21242, 21246, 21249, 21252, 21256-21260, 21263, 21268, 21272, 21274, 21277-21278, 21281, 21283-21292, 21294-21300, 21302-21308, 21311, 21314-21317, 21319-21325, 21327, 21330, 21338-21342, 21344-21346, 21352-21353, 21355-21356, 21363-21365, 21369, 21372-21373, 21375, 21378, 21380-21392, 21394-21395, 21397-21400, 21403, 21406, 21409, 21413-21416, 21422-21424, 21427-21428, 21431, 21433, 21442, 21445-21447, 21449, 21451-21452, 21454, 21456, 21459-21460, 21462, 21467, 21469, 21471-21472, 21478-21479, 21484-21486, 21488-21489, 21491-21494, 21496, 21498, 21500, 21502-21504, 21506-21507, 21512, 21514, 21516, 21519, 21527, 21530-21531, 21533, 21535-21536, 21541, 21543-21545, 21547-21553, 21555-21559, 21561, 21565, 21569-21571, 21573-21575, 21577-21578, 21580, 21582, 21584, 21586, 21589-21590, 21592-21593, 21596-21597, 21599-21600, 21603, 21605, 21607, 21611, 21613-21615, 21617, 21619, 21621, 21623-21625, 21627-21634, 21636-21637, 21643-21646, 21648-21649, 21651, 21655-21656, 21658-21660, 21662, 21665-21666, 21668-21670, 21674, 21676-21682, 21684-21685, 21687, 21690-21693, 21698, 21700-21702, 21704, 21706, 21711-21712, 21714-21718, 21721-21722, 21724-21734, 21739-21740, 21742-21744, 21746, 21748, 21751, 21758-21760, 21762-21766, 21770-21773, 21777-21779, 21781, 21783-21788, 21790-21792, 21797-21799, 21801-21805, 21807-21808, 21811-21814, 21818, 21820, 21822, 21826, 21828, 21832, 21834, 21836, 21838-21839, 21842, 21844, 21846-21847, 21849, 21851-21853, 21856-21863, 21869-21871, 21876, 21878, 21880-21882, 21884-21894, 21896-21897, 21899, 21902-21904, 21908-21914, 21916-21920, 21923, 21925, 21927-21933, 21935, 21937-21942, 21944-21951, 21954, 21957, 21960-21961, 21964, 21968-21969, 21972-21973, 21976-21980, 21982, 21985, 21987, 21990, 21998, 22000, 22003-22004, 22006-22008, 22011, 22014, 22019, 22021-22024, 22028, 22031-22032, 22034, 22036-22042, 22047-22048, 22050-22051, 22054, 22057-22059, 22062, 22065, 22069-22071, 22082, 22084-22085, 22089-22091, 22097-22101, 22107-22114, 22116-22117, 22119-22121, 22129, 22137, 22139, 22141, 22143-22145, 22147-22149, 22151-22153, 22155-22156, 22159-22160, 22162-22164, 22167, 22169-22171, 22176-22177, 22179, 22181-22182, 22184-22187, 22189-22192, 22194-22197, 22200-22201, 22203-22210, 22212-22213, 22220-22221, 22223, 22225-22230, 22232-22233, 22237-22239, 22241-22244, 22246, 22249-22264, 22268, 22270-22272, 22274, 22278-22279, 22281-22285, 22287-22289, 22291-22295, 22297-22303, 22305, 22308-22311, 22317-22320, 22322-22323, 22325-22331, 22334, 22337-22338, 22342-22348, 22350-22355, 22357, 22361-22362, 22364-22365, 22369-22370, 22372-22375, 22377-22381, 22385-22388, 22390-22398, 22400-22402, 22404-22409, 22411-22423, 22425-22426, 22428, 22436, 22449, 22452, 22455, 22457-22458, 22463, 22467, 22472, 22478, 22481-22482, 22485, 22488-22492, 22494-22495, 22499-22500, 22502, 22504-22506, 22508, 22510-22513, 22515, 22517-22521, 22523-22524, 22527-22529, 22532, 22535, 22537-22540, 22546-22550, 22552-22555, 22560-22563, 22565-22567, 22569-22572, 22574, 22576-22577, 22579-22580, 22582, 22585, 22588-22593, 22595, 22601, 22607-22609, 22612-22613, 22616, 22618, 22620-22622, 22624, 22626-22630, 22634, 22636-22643, 22645-22646, 22648-22656, 22658-22659, 22661-22662, 22664, 22668, 22672, 22674-22681, 22684-22685, 22687-22691, 22693-22696, 22698-22699, 22701-22705, 22709, 22712, 22717-22719, 22722-22727, 22729, 22732, 22740-22742, 22744, 22751-22753, 22761-22765, 22768-22773, 22780-22781, 22783-22786, 22788-22789, 22794, 22797-22798, 22800, 22803, 22805, 22810-22814, 22816, 22819, 22821-22827, 22829, 22832, 22836-22840, 22842, 22850, 22852, 22856, 22858-22862, 22866, 22872, 22874, 22876-22877, 22879-22881, 22886-22887, 22889, 22892-22896, 22898-22906, 22908, 22910, 22913-22918, 22928, 22930-22933, 22935-22937, 22941, 22944, 22950-22951, 22953-22958, 22963-22965, 22968-22972, 22974-22976, 22979-22984, 22986, 22988-22989, 22991-22999, 23001, 23003, 23006-23011, 23015-23016, 23024-23028, 23030-23032, 23034-23035, 23037-23039, 23042, 23051, 23054, 23057, 23061-23063, 23065-23068, 23073-23074, 23076-23081, 23083-23086, 23088-23099, 23101-23107, 23110, 23113-23117, 23119-23120, 23122, 23128-23130, 23132, 23137, 23140-23141, 23143, 23146, 23150, 23152, 23156, 23163-23164, 23166-23167, 23177, 23180-23184, 23186-23187, 23190-23191, 23193, 23196-23199, 23201-23203, 23206, 23208, 23212-23215, 23217, 23220, 23222, 23225-23226, 23229, 23231-23236, 23239, 23243, 23246-23247, 23249-23251, 23253, 23256, 23258, 23261-23263, 23265, 23272, 23274-23277, 23282-23283, 23285, 23288, 23292-23296, 23299-23301, 23303-23304, 23310-23315, 23318-23325, 23331, 23335-23337, 23339, 23341-23342, 23344-23345, 23349-23354, 23356-23357, 23359-23360, 23362-23363, 23365, 23368-23369, 23371, 23373, 23375-23376, 23378-23380, 23382, 23385, 23389-23391, 23393, 23397-23398, 23400, 23404-23405, 23409, 23411-23416, 23418, 23420-23423, 23427, 23429-23431, 23436-23444, 23446-23447, 23450-23451, 23454-23457, 23461, 23463-23465, 23468-23475, 23477-23482, 23485-23487, 23490-23495, 23499-23500, 23502-23507, 23513, 23515-23520, 23522-23527, 23529-23532, 23534-23538, 23540, 23543-23545, 23548-23549, 23551-23561, 23563, 23565, 23567-23568, 23570-23572, 23575-23578, 23580-23584, 23586, 23592-23595, 23597-23599, 23601, 23603, 23606-23607, 23610-23611, 23615-23616, 23621, 23625-23634, 23638-23639, 23642, 23645, 23652-23654, 23660-23663, 23665-23667, 23670, 23673-23674, 23676-23678, 23681-23684, 23687, 23689, 23693-23695, 23701-23702, 23705-23712, 23716-23717, 23720, 23724-23725, 23735, 23737-23738, 23740-23741, 23745-23746, 23748, 23751-23761, 23764-23765, 23769, 23775, 23777-23779, 23781-23789, 23791-23793, 23795, 23799-23800, 23802-23803, 23805-23810, 23812, 23814, 23817-23820, 23823-23824, 23829-23830, 23834-23838, 23841, 23843-23850, 23852, 23856, 23860, 23862, 23868, 23870, 23872-23874, 23876, 23879, 23881-23883, 23887-23890, 23892, 23895, 23899-23902, 23904-23907, 23910, 23914-23917, 23920, 23923, 23926-23929, 23932-23936, 23938-23939, 23941-23942, 23944-23946, 23948-23949, 23951, 23953-23954, 23956-23962, 23965, 23969-23973, 23976-23983, 23985, 23987, 23992, 23994, 23996-23998, 24001, 24005-24006, 24008-24009, 24013-24018, 24020-24021, 24027-24029, 24034-24035, 24037, 24039, 24041, 24045-24052, 24054-24055, 24057, 24059-24060, 24065, 24067, 24069, 24073, 24077-24083, 24085, 24087-24089, 24093, 24095-24096, 24099, 24104-24107, 24109-24110, 24112, 24114, 24116, 24122-24124, 24127, 24129-24130, 24132-24134, 24136, 24138, 24140, 24144-24145, 24148-24149, 24151, 24153, 24155-24164, 24166, 24168-24169, 24171, 24173-24177, 24179-24180, 24182, 24184, 24188-24190, 24192-24194, 24198, 24200-24204, 24206, 24208, 24211-24215, 24217-24218, 24221, 24224, 24226-24232, 24234, 24237, 24239-24247, 24253-24254, 24256, 24259-24260, 24262-24264, 24266, 24268, 24271-24273, 24278-24279, 24281-24282, 24285-24287, 24289, 24291-24294, 24296-24302, 24304-24308, 24310, 24312-24313, 24322, 24324-24327, 24329-24333, 24335, 24337, 24341-24342, 24347, 24349-24353, 24355, 24357, 24359, 24361-24372, 24375, 24379, 24381-24384, 24387, 24390-24392, 24395-24396, 24399, 24401-24402, 24407-24408, 24411-24413, 24415-24416, 24419-24423, 24426-24427, 24429-24430, 24434, 24437-24439, 24441, 24446-24449, 24452-24457, 24459, 24461-24469, 24471, 24473, 24476-24477, 24479, 24481-24483, 24486-24487, 24490-24491, 24493, 24498-24500, 24502-24504, 24506-24511, 24513, 24519-24522, 24525, 24528, 24530-24532, 24534, 24538-24541, 24544-24545, 24547-24550, 24553-24557, 24561-24563, 24566, 24569, 24571-24572, 24574-24578, 24582, 24584-24585, 24589-24590, 24593-24605, 24607, 24611, 24613, 24615-24624, 24626-24629, 24634, 24637-24638, 24642-24645, 24647-24648, 24651, 24655, 24658-24669, 24673-24678, 24680, 24684, 24688-24689, 24692-24693, 24696-24698, 24700, 24703, 24705-24708, 24711, 24713-24715, 24717-24720, 24722-24723, 24727-24729, 24731, 24733, 24735-24737, 24740-24743, 24746-24752, 24754, 24756-24761, 24764-24768, 24771-24772, 24774-24778, 24782, 24786, 24788-24790, 24792, 24796, 24800, 24802-24803, 24805-24806, 24809, 24811, 24820-24823, 24828, 24830, 24834, 24836, 24838-24845, 24847-24848, 24850-24852, 24854-24855, 24858-24863, 24871, 24873, 24875, 24879-24881, 24883-24885, 24888-24889, 24891, 24894-24902, 24904-24907, 24912-24915, 24917-24919, 24921, 24924-24927, 24929, 24932-24933, 24935, 24937-24938, 24942, 24944, 24948-24949, 24951, 24957-24959, 24961-24962, 24964, 24966-24967, 24969-24970, 24972-24978, 24982, 24985, 24988-24989, 24993-24994, 24998, 25000-25002, 25004, 25007-25008, 25010-25011, 25015, 25017-25018, 25022-25023, 25025-25029, 25031-25042, 25044-25045, 25051, 25053-25054, 25058, 25060-25063, 25065, 25068, 25072, 25077, 25080, 25082-25083, 25085, 25087-25089, 25091-25094, 25098-25102, 25105-25107, 25113, 25115, 25120-

25123, 25125, 25127-25128, 25133, 25138-25140, 25142, 25146, 25149, 25151-25152, 25154, 25156-25158, 25164, 25166, 25168-25169, 25171-25175, 25181, 25183-25190, 25194-25195, 25197-25202, 25209, 25214-25215, 25217-25219, 25221-25222, 25227-25230, 25232, 25234-25237, 25240, 25247, 25249-25250, 25252, 25255-25256, 25260, 25264-25278, 25280, 25282-25294, 25296, 25300-25302, 25305, 25308-25309, 25312-25316, 25319-25321, 25323, 25325, 25329-25330, 25332-25333, 25338-25339, 25345, 25348, 25352, 25354, 25356-25358, 25360-25361, 25366-25370, 25372, 25375, 25378, 25380, 25384-25385, 25387, 25389-25390, 25394, 25397, 25400-25410, 25412, 25414, 25416-25418, 25420, 25429-25437, 25439, 25441-25442, 25445, 25450-25456, 25459-25460, 25462-25465, 25468-25469, 25472-25476, 25482-25483, 25488-25490, 25494-25495, 25498, 25501-25504, 25506, 25508, 25510, 25512-25515, 25517-25522, 25525-25531, 25534, 25537-25541, 25543-25544, 25547, 25549, 25552-25555, 25557-25564, 25566-25568, 25570-25572, 25574-25576, 25579, 25581-25586, 25588, 25596, 25599, 25605, 25607-25608, 25611, 25614-25615, 25617, 25620-25622, 25625-25626, 25629, 25631-25640, 25642-25644, 25650, 25653-25654, 25656-25661, 25664-25672, 25674-25675, 25677, 25683-25686, 25688, 25691, 25693-25697, 25701, 25704-25707, 25709-25710, 25712, 25714-25719, 25721-25722, 25730-25731, 25734-25739, 25742-25744, 25747-25748, 25750, 25753, 25757, 25760, 25762, 25765, 25768, 25772, 25774, 25776-25779, 25782, 25784, 25786, 25788-25789, 25791-25794, 25796-25797, 25799-25800, 25803-25805, 25807, 25810, 25812-25814, 25817, 25819-25821, 25823-25824, 25826-25831, 25833-25835, 25837, 25839-25841, 25843-25845, 25847, 25852-25856, 25858, 25861-25863, 25866, 25870-25874, 25878-25879, 25883-25884, 25886-25892, 25894-25896, 25900-25904, 25907-25910, 25912, 25915, 25923-25925, 25927-25932, 25936-25939, 25942-25943, 25945, 25947, 25949-25951, 25953, 25956-25958, 25961-25963, 25966, 25968-25969, 25971, 25975-25976, 25979, 25982-25983, 25985, 25987, 25991, 25994-26000, 26003, 26006-26011, 26013-26015, 26017, 26020, 26025-26027, 26029, 26031-26032, 26037-26038, 26046-26049, 26051, 26054, 26059-26061, 26066, 26069, 26072-26076, 26078, 26080, 26083-26087, 26090, 26092, 26095-26097, 26100, 26102-26108, 26111-26112, 26117-26118, 26121, 26129, 26131-26132, 26134-26135, 26137-26142, 26146, 26149-26151, 26153-26154, 26157-26158, 26161-26162, 26164-26166, 26168-26170, 26172, 26175, 26183, 26185, 26192-26196, 26198-26199, 26203-26206, 26208-26223, 26228, 26230-26232, 26234, 26236-26238, 26240-26242, 26245-26248, 26251, 26256-26259, 26261-26267, 26270, 26272-26273, 26276-26277, 26279, 26281, 26284-26285, 26287-26290, 26292-26293, 26298, 26301-26311, 26316, 26318, 26329-26330, 26333-26334, 26337-26342, 26344-26348, 26350, 26352-26356, 26358-26364, 26366-26373, 26375-26376, 26378-26382, 26384-26385, 26388, 26391, 26393-26394, 26396, 26398-26400, 26402, 26406-26408, 26410, 26412-26419, 26421-26423, 26426, 26428-26429, 26431-26432, 26437, 26439-26445, 26447, 26452-26454, 26458-26459, 26461-26463, 26466, 26469-26470, 26472-26473, 26476, 26479, 26481-26482, 26485-26486, 26491, 26493-26494, 26498-26499, 26503-26504, 26506-26510, 26515, 26518, 26521-26530, 26532-26535, 26537-26538, 26542-26543, 26545-26546, 26549-26552, 26555-26557, 26559, 26561-26562, 26564-26565, 26567-26568, 26571-26574, 26577, 26580, 26584-26586, 26588-26589, 26594-26596, 26598, 26603, 26605-26606, 26608, 26610-26614, 26617-26624, 26626-26630, 26634, 26636-26638, 26642, 26644-26649, 26651-26652, 26656, 26659-26662, 26664, 26671, 26676-26680, 26682-26687, 26689-26690, 26694-26697, 26699, 26701, 26703, 26705-26708, 26710-26715, 26719-26721, 26723, 26727-26730, 26735, 26738, 26740-26747, 26750-26752, 26755-26757, 26759-26761, 26763-26765, 26767-26769, 26772, 26774-26778, 26780-26781, 26783, 26786-26787, 26789-26792, 26794-26798, 26801-26805, 26808-26812, 26814, 26816-26818, 26820-26821, 26823-26825, 26827-26829, 26831-26832, 26835-26841, 26843-26844, 26848-26851, 26856-26861, 26863, 26865-26866, 26868-26869, 26871-26872, 26874-26876, 26878, 26881-26887, 26889-26891, 26893-26897, 26899, 26901, 26903-26904, 26908, 26915-26917, 26922-26925, 26927-26928, 26931, 26933, 26935-26940, 26943-26946, 26948-26955, 26958, 26960-26962, 26969-26971, 26974-26976, 26978-26980, 26983, 26985-26986, 26989, 27000-27002, 27004-27005, 27007-27008, 27010-27014, 27022, 27024, 27029, 27033-27034, 27036-27037, 27039-27040, 27042-27043, 27045-27052, 27054-27055, 27064, 27069, 27072-27073, 27075, 27078-27079, 27082, 27096-27097, 27106, 27110, 27112, 27114, 27119, 27121-27122, 27124-27125, 27128-27129, 27131-27132, 27134-27135, 27140, 27149, 27160-27163, 27165-27166, 27169-27170, 27172-27177, 27180, 27182-27183, 27186-27187, 27191, 27193-27195, 27197, 27201-27203, 27205-27206, 27208-27209, 27216-27220, 27222-27226, 27235, 27237-27238, 27241-27245, 27247, 27252, 27254, 27256-27261, 27263, 27265-27266, 27268-27269, 27273, 27276-27280, 27282, 27284-27286, 27288-27295, 27297-27300, 27302-27305, 27307, 27310-27315, 27317-27319, 27322-27326, 27328-27330, 27338, 27342, 27345-27353, 27355, 27357-27358, 27360-27361, 27364-27369, 27372-27378, 27381-27389, 27391-27393, 27396-27398, 27400-27402, 27405-27411, 27413-27415, 27417-27420, 27422, 27424-27429, 27433-27437, 27439-27448, 27451-27452, 27456, 27458-27460, 27464, 27466-27470, 27473-27474, 27479, 27481-27488, 27490, 27493, 27495, 27497-27498, 27500, 27502-27503, 27506-27517, 27519-27525, 27527, 27531-27540, 27543, 27545-27549, 27551, 27554, 27559, 27563-27566, 27568-27570, 27572-27579, 27581-27586, 27588-27590, 27592-27594, 27596-27598, 27600, 27606, 27609-27610, 27613-27614, 27616-27620, 27623-27624, 27626, 27632-27633, 27635, 27638-27640, 27643, 27650-27659, 27661, 27668-27669, 27671-27673, 27676-27678, 27684, 27686-27690, 27695, 27698-27699, 27701, 27703, 27705-27707, 27711, 27714, 27718-27719, 27724, 27726, 27728-27729, 27731, 27733-27735, 27738, 27741, 27747, 27750, 27752-27759, 27762, 27764-27765, 27767-27773, 27777-27781, 27783, 27785, 27789, 27792-27793, 27795, 27799-27803, 27805, 27807-27808, 27810-27814, 27817-27818, 27820-27822, 27825, 27834, 27844, 27852, 27855, 27860, 27862-27868, 27870-27871, 27876-27877, 27879, 27883-27886, 27888, 27891-27892, 27894, 27896-27904, 27907, 27910, 27914, 27916-27922, 27924-27925, 27928-27929, 27936-27937, 27942-27948, 27954-27961, 27963-27969, 27971-27973, 27975, 27981, 27989, 27991-27992, 27994-27995, 27997, 27999-28000, 28003, 28006-28011, 28013, 28017-28018, 28020, 28022, 28024, 28026-28028, 28032-28033, 28036, 28040, 28043-28044, 28046, 28048, 28050-28051, 28053-28057, 28059-28060, 28062, 28065-28072, 28074, 28076, 28079, 28081, 28086, 28088-28092, 28094, 28096-28098, 28101-28104, 28107-28108, 28110, 28113, 28115-28116, 28118-28119, 28128, 28130-28131, 28133-28134, 28136-28139, 28143-28144, 28146-28147, 28149-28151, 28154-28159, 28163-28164, 28166-28167, 28169-28177, 28179, 28182-28185, 28188-28195, 28197, 28201, 28203-28204, 28207, 28210, 28214-28215, 28217, 28222-28225, 28227-28229, 28231-28234, 28237, 28240, 28243-28250, 28253, 28255-28256, 28258-28262, 28264-28267, 28277, 28281-28282, 28284-28285, 28287-28291, 28293-28295, 28299-28301, 28303-28304, 28306-28309, 28311, 28313-28316, 28318, 28322, 28324-28328, 28330, 28339-28340, 28342, 28344-28345, 28347-28349, 28351-28352, 28354, 28356-28357, 28360-28364, 28366, 28368-28370, 28372, 28374-28376, 28378-28379, 28384-28388, 28390-28391, 28393, 28395-28400, 28402, 28404-28405, 28408-28410, 28412-28423, 28426, 28428-28430, 28432-28435, 28437-28438, 28440-28442, 28446-28449, 28451-28459, 28462, 28466-28472, 28474, 28476-28478, 28480-28483, 28485, 28487, 28489, 28491, 28494, 28496, 28498-28500, 28502, 28505, 28509-28510, 28512-28514, 28516, 28518-28520, 28522-28529, 28531-28533, 28535-28536, 28538-28539, 28542, 28545-28547, 28549, 28551-28552, 28554, 28556, 28558-28561, 28564-28567, 28569-28572, 28574, 28576-28577, 28579-28581, 28586, 28589, 28591, 28594-28602, 28604-28605, 28608-28610, 28612-28613, 28616-28617, 28621, 28623, 28629, 28631, 28633, 28635, 28639-28641, 28643-28646, 28648, 28650-28651, 28655, 28658-28660, 28662-28663, 28665-28666, 28690-28692, 28694, 28696-28697, 28700, 28706-28707, 28714-28715, 28717-28723, 28725-28727, 28730, 28732, 28737-28742, 28745-28746, 28748, 28755-28756, 28758-28759, 28762, 28765, 28769-28774, 28785, 28788-28790, 28801-28806, 28808, 28810, 28817-28819, 28821, 28826-28829, 28831, 28834, 28837, 28839-28844, 28846-28847, 28849, 28853, 28856-28857, 28859, 28861, 28863, 28865-28868, 28870-28871, 28874-28877, 28880-28881, 28883, 28886, 28888, 28890, 28892-28898, 28904-28906, 28913-28921, 28923-28930, 28933-28934, 28937, 28941-28942, 28944-28946, 28948-28955, 28957-28964, 28967-28968, 28970-28973, 28979-28981, 28983-28984, 28986, 28989, 28991, 28993-28994, 28996-28997, 29000, 29002, 29004, 29006-29010, 29012-29016, 29018, 29021, 29025-29027, 29036-29039, 29042, 29044, 29047, 29049-29056, 29058, 29061, 29063, 29065, 29072, 29075, 29081-29084, 29089-29093, 29102, 29104, 29111, 29114-29119, 29121, 29124-29125, 29128, 29132-29141, 29143-29146, 29149, 29151, 29153, 29155, 29159, 29161, 29163-29165, 29167-29168, 29170-29171, 29174, 29176-29182, 29185, 29195, 29203, 29211-29213, 29218-29223, 29225, 29229-29231, 29234-29236, 29239, 29241, 29243-29244, 29248, 29250-29251, 29254-29260, 29262, 29269, 29271, 29274-29276, 29280-29282, 29285-29288, 29290-29291, 29293, 29297-29298, 29301-29303, 29306-29308, 29310, 29312-29314, 29316-29320, 29322, 29325-29330, 29332, 29334-29336, 29338-29341, 29345-29348, 29350, 29353-29356, 29358-29364, 29368-29371, 29373-29374, 29377-29378, 29381-29383, 29385-29391, 29394, 29397-29399, 29404-29405, 29407, 29409-29412, 29414-29417, 29421-29423, 29425, 29429-29431, 29433-29434, 29438-29440, 29442-29443, 29445, 29447-29457, 29459, 29462, 29465-29466, 29468, 29470-29474, 29476-29478, 29480-29483, 29486-29487, 29490, 29492-29493, 29495-29496, 29498, 29500-29502, 29504-29506, 29508-29512, 29514, 29516-29519, 29521-29524, 29527, 29529, 29534-29539, 29544-29548, 29552, 29554, 29559-29563, 29565-29566, 29571-29573, 29579, 29581-29583, 29587, 29589, 29591-29592, 29594-29595, 29597, 29599-29600, 29603, 29605-29606, 29610-29613, 29617-29621, 29623-29626, 29631, 29635-29647, 29649-29652, 29654-29655, 29657-29659, 29661-29662, 29664-29665, 29667-29668, 29670-29672, 29674-29676, 29678, 29681, 29683, 29685, 29689, 29691-29692, 29695, 29698, 29702, 29704-29706, 29708-29711, 29715, 29719-29723, 29725-29733, 29735, 29737-29743, 29745-29756, 29758-29763, 29765-29767, 29769-29770, 29773-29775, 29777-29780, 29782-29785, 29787-29789, 29791-29795, 29797, 29800-29803, 29805-29809, 29812-29813, 29816, 29820-29829, 29831-29833, 29835, 29838-29840, 29842, 29844, 29847, 29849-29850, 29852, 29855-29860, 29863-29865, 29867, 29869-29874, 29879, 29881-29882, 29884-29887, 29889, 29891-29893, 29895-29896, 29899-29900, 29902-29904, 29907, 29909, 29911, 29914, 29916, 29918, 29925, 29933, 29937-29941, 29943, 29949, 29951, 29953-29955, 29957-29961, 29964-29965, 29974, 29976, 29979, 29981, 29983-29984, 29986-29987, 29992, 29995, 29997-29998, 30000, 30003-30004, 30009, 30011-30012, 30014-30017, 30023, 30027, 30029-30030, 30048-30051, 30053, 30056-30061, 30063, 30072-30075, 30078-30079, 30082, 30084-30087, 30090, 30092-30093, 30095-30098, 30100-30101, 30103-30104, 30106-30109, 30111, 30115, 30117, 30119, 30123-30124, 30126, 30128-30134, 30136, 30138-30141, 30144-30148, 30150, 30153, 30155-30159, 30163-30177, 30179, 30181-30183, 30185, 30187-30189, 30192, 30194-30200, 30206-30207, 30210-30211, 30216-30221, 30223, 30225-30229, 30231-30232, 30235-30236, 30238, 30242-30246, 30248-30250, 30252, 30255-30258, 30263, 30265, 30267, 30269, 30273-30276, 30278-30279, 30281-30289, 30291-30294, 30302-30303, 30305-30306, 30308, 30310, 30312-30322, 30324, 30326-30329, 30331-30333, 30335, 30337-30344, 30346, 30348, 30350, 30352-30358, 30361, 30365, 30370, 30379-30381, 30385-30389, 30392-30393, 30399-30400, 30402-30403, 30414-30418, 30424-30425, 30428, 30431, 30436, 30439, 30441-30443, 30448, 30450-30452, 30454, 30457, 30460-30462, 30464, 30466, 30473, 30475-30476, 30482-30484, 30489-30493, 30495-30496, 30498, 30500, 30503-30504, 30506-30511, 30513-30514, 30518-30519, 30521, 30527, 30533-30534, 30537, 30539, 30541-30544, 30546-30550, 30562, 30564, 30567, 30574, 30577-30579, 30581, 30583, 30590, 30596-30601, 30603-30604, 30607, 30609-30610, 30612, 30615, 30618-30619, 30621, 30623, 30629-30631, 30633, 30636, 30640-30642, 30644-30646, 30648, 30650, 30653, 30655-30657, 30659-30660, 30662, 30664, 30667, 30672, 30674-30677, 30680-30684, 30687-30689, 30691-30694, 30697-30699, 30701-30705, 30709-30711, 30713-30719, 30721-30724, 30727, 30730-30731, 30733, 30737, 30739-30740, 30743-30744, 30747-30749, 30751-30752, 30758-30766, 30768, 30771-30772, 30776-30779, 30781-30785, 30788-30792, 30794-30802, 30806, 30811, 30813, 30817, 30824-30826, 30828-30831, 30835-30839, 30842-30843, 30845-30847, 30854, 30856, 30858-30862, 30864-30865, 30869-30880, 30892, 30894, 30897-30898, 30900, 30902-30904, 30906, 30913, 30919, 30921-30927, 30929-30930, 30932-30933, 30936, 30941-30949, 30951-30955, 30957, 30959-30962, 30965-30967, 30972-30976, 30979-30983, 30985, 30993-30995, 30998, 31001-31002, 31010-31012, 31015-31016, 31018, 31021-31025, 31027-31028, 31030, 31032-31038, 31042, 31046-31048, 31050, 31053, 31055-31062, 31065, 31072, 31074-31075, 31078, 31080-31084, 31086-31091, 31093-31095, 31097-31101, 31105, 31107-31108, 31113, 31115-31118, 31122-31126, 31129, 31131-31132, 31136-31149, 31151-31152, 31154-31158, 31161, 31164-31165, 31167-31168, 31171-31173, 31175-31180, 31182-31184, 31186-31187, 31193, 31195, 31197-31199, 31201-31204, 31206, 31210, 31212-31214, 31216, 31218, 31220-31221, 31226-31227, 31229, 31235, 31237-31241, 31243-31244, 31248-31250, 31255, 31257, 31260, 31263-31269, 31273, 31275-31278, 31282-31290, 31293-31297, 31299-31302, 31304-31305, 31311-31312, 31314, 31316, 31318, 31320-31328, 31331-31338, 31340-31341, 31343, 31345-31346, 31348-31352, 31355-31356, 31358, 31360, 31366-31372, 31374-31379, 31381-31385, 31387-31391, 31400, 31402-31403, 31406-31409, 31411, 31414-31418, 31420-31423, 31426-31427, 31429-

31432, 31434, 31437-31440, 31445-31450, 31452-31455, 31458, 31462, 31464-31467, 31469-31472, 31477-31479, 31481-31482, 31485-31486, 31488-31489, 31493-31494, 31496-31500, 31502-31505, 31510-31512, 31520-31522, 31527, 31530-31531, 31534-31536, 31538-31541, 31544-31545, 31547-31549, 31556-31559, 31561-31563, 31566-31569, 31572, 31574-31575, 31578-31579, 31581-31582, 31584, 31586-31587, 31589-31591, 31593-31595, 31597-31599, 31601-31603, 31606-31610, 31613-31614, 31616, 31618-31622, 31626, 31628-31635, 31638-31639, 31641-31642, 31644-31646, 31648, 31650, 31652, 31657, 31659-31662, 31664, 31666-31669, 31671-31672, 31674, 31677-31680, 31682, 31684, 31689-31691, 31693-31694, 31696-31698, 31700-31701, 31708, 31710-31713, 31715-31716, 31721, 31723-31727, 31730, 31733-31735, 31739-31740, 31742-31743, 31747-31748, 31750, 31753, 31766-31767, 31769, 31771-31772, 31774, 31777-31783, 31787-31788, 31791, 31795-31798, 31800-31802, 31805, 31809-31810, 31812-31813, 31815, 31819, 31823-31828, 31831-31832, 31835, 31837-31839, 31841-31844, 31847, 31849-31857, 31861-31866, 31869-31872, 31874, 31878-31895, 31897, 31899, 31913, 31915-31918, 31921, 31925, 31928-31934, 31937-31938, 31940-31945, 31950-31952, 31954, 31957-31959, 31962-31963, 31965-31970, 31973, 31975-31980, 31982-31989, 31992, 31994-31995, 32000-32002, 32005, 32008-32018, 32021, 32024, 32026, 32028, 32030-32036, 32041-32045, 32047, 32051-32052, 32058, 32060-32070, 32072, 32081, 32083, 32085-32088, 32095, 32097-32098, 32100, 32107, 32111, 32115, 32120-32121, 32123-32129, 32131-32132, 32134-32135, 32138-32139, 32141-32143, 32145-32147, 32149-32152, 32154, 32158-32160, 32162, 32164, 32166, 32168-32172, 32174, 32176-32182, 32184-32185, 32187-32189, 32191-32192, 32195-32199, 32201, 32204, 32209-32210, 32212-32213, 32216-32218, 32224, 32226, 32229-32230, 32235-32236, 32238-32244, 32247, 32249, 32256-32262, 32264-32265, 32267, 32269, 32272-32276, 32280, 32286-32289, 32292, 32295, 32300-32301, 32303, 32306, 32308-32310, 32312, 32314, 32318, 32325-32326, 32328, 32331, 32339, 32341-32344, 32346-32349, 32352-32354, 32356-32357, 32360-32361, 32364-32365, 32368-32369, 32372, 32375-32378, 32393, 32395, 32398, 32403, 32408-32410, 32412, 32416-32418, 32423-32425, 32428, 32430, 32432, 32436-32437, 32441-32443, 32445-32446, 32449, 32452, 32454-32456, 32458-32459, 32461, 32463, 32467, 32471-32472, 32474-32476, 32478-32479, 32483-32489, 32491-32494, 32499, 32501, 32508, 32512, 32514, 32516, 32519-32521, 32524-32526, 32530-32531, 32535, 32537, 32543, 32545, 32547, 32549, 32553, 32555-32562, 32564-32565, 32567-32568, 32570, 32575-32576, 32580, 32585-32589, 32592-32593, 32597-32601, 32603-32604, 32607, 32612-32613, 32617-32618, 32622-32623, 32628, 32630, 32632, 32634-32635, 32638-32646, 32648, 32650, 32652-32655, 32662, 32664, 32669-32671, 32676-32677, 32679, 32683, 32685-32687, 32689-32691, 32694, 32697, 32699-32700, 32702, 32706-32713, 32724-32726, 32728, 32730, 32732-32733, 32736, 32741-32744, 32746-32750, 32752, 32754, 32756-32758, 32761-32765, 32768, 32770, 32773-32775, 32778, 32783, 32785-32786, 32789-32795, 32797-32798, 32802, 32804-32808, 32810, 32815, 32817-32820, 32822, 32825-32832, 32834-32836, 32838, 32840-32846, 32849-32852, 32854-32856, 32859, 32863-32871, 32877, 32881, 32883, 32885, 32887-32889, 32891-32892, 32894, 32897, 32900-32905, 32907-32914, 32920-32922, 32924-32925, 32927, 32929-32930, 32934, 32936, 32940, 32942-32949, 32951-32952, 32954-32956, 32959, 32961-32962, 32964, 32966, 32968-32971, 32973-32976, 32978-32979, 32981-32984, 32986-32987, 32991-32993, 32996, 32998, 33000-33002, 33004, 33008, 33013-33045, 33048, 33052, 33056-33060, 33062-33063, 33066-33069, 33073, 33075, 33078-33085, 33089-33090, 33096-33100, 33102, 33104, 33106, 33110-33113, 33117-33120, 33125-33126, 33129-33130, 33132-33133, 33136-33137, 33141-33144, 33146, 33148, 33152, 33161, 33163-33165, 33167, 33170-33171, 33173, 33175-33178, 33181, 33183-33184, 33187-33188, 33196-33198, 33200-33201, 33203-33204, 33207-33208, 33211-33213, 33215, 33219, 33221-33224, 33229-33231, 33233-33234, 33236, 33238-33249, 33252, 33258-33260, 33262, 33269, 33271, 33273-33275, 33277-33279, 33284-33285, 33291-33297, 33300-33302, 33305, 33310-33311, 33315, 33320, 33322-33328, 33330-33331, 33333, 33337, 33339, 33343-33344, 33347-33349, 33351-33352, 33354-33355, 33358, 33364, 33373, 33376-33378, 33380, 33383-33384, 33386-33389, 33391-33392, 33394-33396, 33403, 33405, 33410, 33412-33416, 33420, 33425, 33428-33430, 33432-33435, 33438-33441, 33447, 33451, 33454-33461, 33463, 33466-33468, 33472-33473, 33475, 33477-33486, 33490, 33492, 33497, 33499-33503, 33506, 33508-33510, 33521, 33525, 33527, 33529, 33533-33536, 33538-33539, 33541-33543, 33547, 33549-33557, 33559, 33561-33562, 33567, 33572, 33575-33579, 33581-33584, 33586, 33588, 33590, 33592, 33594, 33596-33598, 33600, 33602-33604, 33608-33612, 33614-33615, 33617, 33619-33622, 33624-33625, 33628-33629, 33631-33635, 33637-33642, 33644-33646, 33649-33650, 33652-33656, 33658, 33660-33667, 33669, 33672, 33674, 33676-33679, 33681-33684, 33686-33689, 33691, 33694-33702, 33708-33709, 33711-33713, 33715, 33717-33718, 33720-33721, 33723, 33725-33731, 33733, 33738-33741, 33743, 33745, 33750, 33759, 33761-33763, 33765-33768, 33771-33772, 33774-33775, 33779-33780, 33782, 33784, 33786-33797, 33801-33805, 33808-33809, 33814, 33817, 33817-33821, 33823-33825, 33827-33832, 33836, 33838, 33840-33842, 33845-33846, 33848, 33853-33855, 33857, 33859, 33863, 33865-33867, 33874, 33877-33878, 33880-33881, 33885, 33888, 33890-33895, 33897-33899, 33902-33903, 33905-33907, 33909-33911, 33914-33918, 33921, 33923-33924, 33926, 33928-33929, 33931, 33936, 33943, 33945-33946, 33949, 33951, 33954-33957, 33959, 33961-33964, 33966, 33969, 33971, 33974-33978, 33980, 33982-33986, 33988-33994, 33996-33997, 33999, 34001-34005, 34008-34012, 34014-34015, 34018-34022, 34024-34028, 34030-34034, 34036, 34038-34043, 34045-34051, 34055-34057, 34059-34062, 34064, 34067-34069, 34071-34077, 34079-34080, 34088-34089, 34091-34094, 34096-34102, 34108-34109, 34111-34113, 34116-34117, 34119, 34121-34125, 34127-34130, 34134-34136, 34140, 34143, 34145, 34147-34150, 34152-34155, 34157, 34159, 34162, 34166-34168, 34170, 34181, 34185-34187, 34189, 34191-34193, 34198, 34200-34202, 34205, 34207-34208, 34211-34213, 34215, 34219-34220, 34222-34233, 34235-34241, 34246, 34249-34258, 34260, 34262, 34264, 34266-34267, 34270, 34272-34273, 34275, 34277-34278, 34280, 34282-34283, 34285, 34287, 34290-34292, 34294-34296, 34298-34302, 34305, 34308-34309, 34312-34317, 34320-34322, 34326, 34328, 34330-34334, 34338, 34340, 34342, 34344-34352, 34355-34360, 34362, 34366, 34372, 34377, 34380, 34382-34383, 34385, 34387-34392, 34394-34396, 34399-34407, 34410-34417, 34419, 34421, 34423-34425, 34428-34430, 34434, 34436, 34438, 34442, 34444-34447, 34450-34457, 34459-34461, 34463, 34465-34466, 34469-34471, 34476-34477, 34479, 34482-34483, 34485-34486, 34488, 34490, 34492-34493, 34495, 34497-34504, 34507-34509, 34513, 34515-34516, 34520-34523, 34525-34528, 34530-34535, 34543, 34545-34547, 34549-34550, 34552-34554, 34556-34562, 34565, 34568-34571, 34573, 34575-34579, 34581-34587, 34590-34593, 34595-34599, 34601-34605, 34611-34619, 34621, 34624-34625, 34627, 34631-34634, 34636-34646, 34648-34656, 34658, 34660, 34662-34666, 34668, 34670-34671, 34673, 34675, 34677, 34679-34681, 34683-34686, 34688-34695, 34697-34699, 34701-34703, 34705-34706, 34710, 34714-34718, 34721-34722, 34725-34728, 34731-34732, 34734-34738, 34741-34743, 34750-34752, 34756, 34760, 34762-34764, 34767-34769, 34771-34776, 34778-34779, 34781, 34783, 34785, 34787-34789, 34791, 34794, 34796-34797, 34799, 34802-34803, 34805, 34808-34809, 34811, 34813, 34816, 34819, 34822, 34824-34827, 34829, 34832-34833, 34837-34839, 34841-34845, 34849-34850, 34854, 34856, 34862-34865, 34867-34873, 34876-34878, 34881, 34883, 34885-34886, 34888-34890, 34892-34895, 34897-34899, 34901-34908, 34910-34911, 34915-34916, 34918-34926, 34933-34938, 34940, 34942, 34944-34946, 34948-34949, 34951-34956, 34958-34960, 34962-34963, 34965, 34968-34972, 34976-34978, 34986, 34988, 34990, 34992, 34995-35000, 35002-35006, 35009, 35012-35017, 35021, 35025-35026, 35028-35031, 35034-35036, 35041-35043, 35045, 35048-35050, 35055, 35057-35058, 35061-35062, 35067-35070, 35072-35074, 35076-35078, 35080-35082, 35085, 35089-35090, 35092-35094, 35097-35099, 35101-35103, 35106-35107, 35111-35113, 35115, 35119, 35122, 35124-35128, 35130, 35140, 35146, 35152-35154, 35156, 35159, 35162-35164, 35168-35169, 35171-35173, 35180-35182, 35185, 35190, 35196-35197, 35199-35203, 35206, 35208-35210, 35213, 35215-35216, 35219-35222, 35228-35229, 35231, 35233, 35235, 35237, 35239-35246, 35248-35249, 35251-35254, 35256-35264, 35268-35272, 35275, 35280-35281, 35288-35296, 35298, 35302, 35304, 35306, 35308-35310, 35313, 35316-35318, 35320-35321, 35323-35329, 35331-35334, 35338, 35340-35341, 35347-35348, 35350-35351, 35353, 35355-35358, 35365, 35369, 35374, 35376-35377, 35381, 35383-35386, 35388-35389, 35392-35393, 35395, 35398, 35400, 35402, 35404-35407, 35409-35411, 35414-35415, 35417-35418, 35421-35422, 35424-35425, 35430-35431, 35433-35437, 35439-35440, 35442, 35445-35447, 35450, 35456, 35459, 35462-35465, 35467, 35469-35471, 35473-35474, 35478-35484, 35493, 35499, 35501-35504, 35506-35510, 35512, 35514-35518, 35521-35524, 35526-35527, 35530-35531, 35533, 35535-35540, 35542, 35546, 35549-35551, 35555, 35557-35558, 35564, 35566-35568, 35570, 35572, 35575, 35577-35578, 35581-35583, 35586, 35588, 35590, 35592, 35597-35598, 35600-35601, 35609, 35614-35616, 35618, 35621, 35624-35627, 35633-35635, 35637, 35639-35640, 35642-35644, 35650, 35652-35657, 35659, 35662-35663, 35667, 35669, 35674, 35677-35679, 35681, 35683, 35685, 35687-35692, 35694, 35698-35705, 35707-35713, 35715-35724, 35726, 35729-35734, 35736, 35738, 35740-35742, 35744, 35747, 35751-35752, 35754, 35756-35765, 35768-35769, 35773, 35776-35780, 35782, 35785, 35787-35788, 35790, 35792, 35800, 35803-35817, 35819, 35821-35833, 35835-35836, 35838-35839, 35842, 35844, 35848-35851, 35854, 35856, 35859, 35862, 35864-35868, 35871, 35873-35882, 35884-35886, 35890, 35898, 35901, 35903, 35905-35906, 35908, 35910-35911, 35914-35916, 35918-35921, 35925, 35927-35929, 35931, 35933-35935, 35937, 35939-35944, 35947-35949, 35952-35962, 35965-35966, 35970, 35973-35975, 35979-35981, 35983-35989, 35991, 35997-36008, 36011-36018, 36020-36029, 36031, 36033-36038, 36040-36041, 36044, 36046, 36048-36049, 36051, 36053, 36056, 36058, 36060-36062, 36065-36068, 36070-36074, 36077, 36079, 36081-36088, 36090, 36092, 36097-36098, 36100, 36104-36107, 36109-36110, 36112-36115, 36117-36119, 36122-36123, 36126-36128, 36131-36136, 36138, 36140, 36143-36147, 36149-36151, 36154-36157, 36160-36172, 36174-36176, 36179, 36181, 36183-36186, 36188, 36191-36193, 36195-36204, 36206-36209, 36211-36213, 36217, 36220, 36222, 36228, 36230, 36232, 36234-36236, 36239-36242, 36244, 36246-36249, 36254-36255, 36257-36258, 36263-36271, 36273, 36276, 36278-36280, 36283, 36285, 36288, 36290-36294, 36302, 36304-36305, 36308, 36310, 36314-36322, 36327, 36329-36330, 36338-36342, 36346, 36349, 36351-36352, 36355, 36357, 36363, 36365-36367, 36371, 36373-36375, 36378-36380, 36383, 36386, 36392, 36399-36400, 36402-36406, 36408-36410, 36412-36414, 36416, 36424-36430, 36432-36433, 36436, 36439-36441, 36443-36444, 36446, 36456-36457, 36459, 36462-36471, 36473, 36475-36478, 36480, 36483-36489, 36492-36494, 36496, 36499-36500, 36502, 36505, 36507-36512, 36514, 36517, 36523, 36526, 36531-36535, 36537, 36545-36546, 36548, 36552-36558, 36563-36565, 36567, 36570-36573, 36575, 36578, 36581, 36585, 36587, 36591-36599, 36603-36605, 36608, 36612, 36621, 36623-36626, 36628-36629, 36631, 36633-36636, 36639, 36641, 36643, 36645, 36649, 36651-36652, 36657, 36659, 36663-36665, 36667-36671, 36677, 36679, 36683, 36686, 36688, 36692-36698, 36703, 36706, 36708, 36710-36716, 36719-36722, 36724-36728, 36732, 36734, 36736, 36740, 36742-36743, 36746-36752, 36754, 36756-36765, 36768, 36773, 36778-36780, 36782, 36784-36788, 36796-36798, 36801, 36803-36807, 36809-36811, 36813, 36818-36821, 36823-36825, 36827-36831, 36833, 36841-36853, 36855-36857, 36863-36864, 36867, 36870, 36872-36873, 36875, 36877-36879, 36881, 36884-36886, 36890-36896, 36898-36900, 36903-36905, 36907-36908, 36910-36911, 36916-36917, 36919, 36922, 36924-36927, 36930, 36932-36939, 36943, 36945-36952, 36954-36958, 36960-36962, 36964, 36967-36968, 36970-36972, 36975-36990, 36992-36994, 36999-37003, 37005, 37007, 37009, 37013, 37018-37023, 37025, 37028, 37032, 37034, 37038, 37042-37044, 37046, 37050, 37054, 37056-37060, 37065-37069, 37073, 37075-37081, 37083, 37086-37088, 37090-37091, 37095, 37097-37098, 37100-37101, 37103, 37107-37111, 37113-37114, 37120, 37123, 37126-37130, 37132, 37134, 37136-37137, 37139-37140, 37142, 37144, 37147-37148, 37152, 37155, 37157, 37162, 37166, 37168, 37170-37171, 37178, 37185-37192, 37194-37196, 37198-37200, 37203-37204, 37206, 37208, 37212-37214, 37216-37217, 37219-37221, 37223, 37229-37230, 37232, 37238, 37240-37242, 37245, 37248, 37250-37257, 37261, 37263, 37265-37273, 37275-37281, 37283, 37290-37294, 37296-37298, 37301-37306, 37310, 37313, 37315, 37318-37323, 37328-37329, 37333, 37335-37337, 37340-37347, 37353, 37356, 37358-37359, 37361-37364, 37367, 37369, 37371, 37373, 37375, 37379-37381, 37383, 37385-37386, 37388-37397, 37403-37414, 37417, 37419-37424, 37426-37430, 37432, 37434-37435, 37440, 37443-37445, 37447-37450, 37452-37453, 37455-37456, 37458-37466, 37469-37470, 37475, 37477, 37479-37481, 37483-37484, 37486, 37489-37496, 37500-37501, 37504, 37509, 37511, 37520-37525, 37533, 37535, 37537-37538, 37540-37541, 37544, 37546-37547, 37551, 37554-37560, 37562, 37566, 37568, 37575, 37578-37583, 37586, 37588-37590, 37592-37593, 37595-37596, 37598-37599, 37602, 37604-37606, 37609, 37611, 37614-37615, 37617, 37622, 37625, 37633, 37636-37638, 37644-37654, 37656-37657, 37659-37664, 37668, 37678, 37680, 37682-37687, 37689-37690, 37692-37695, 37699-37702, 37706-37711, 37714-37715, 37720-37723, 37726-37728, 37730, 37735, 37739-37741, 37744, 37746-37749, 37755-37756, 37758, 37760-37764, 37766-37768, 37770-37771, 37773-37777, 37779, 37783-37792, 37794-37795, 37800-37801, 37803-37806, 37809-37810, 37817, 37819, 37824-37835, 37837-37839, 37842-37844, 37846-37851, 37853, 37855-37858, 37861-37862, 37865-37866, 37868-37872, 37874-37879, 37881-37883, 37885, 37890, 37892, 37894, 37901, 37903-37904, 37906-37907, 37912-37913, 37918, 37920-37923, 37925, 37929-37931, 37933-37938, 37940-37941, 37943-37945, 37949-37951, 37953-37955, 37957-37958, 37960, 37962-37964, 37967-37968, 37971-37975, 37977, 37979, 37981, 37987-37989, 37996-37997, 38001-38011, 38013, 38015-38016, 38018, 38024-38028, 38031-38040, 38042-38046, 38048-38054, 38059, 38061-38062, 38064, 38067, 38069-38073, 38077, 38081-38082, 38084-38086, 38088-38093, 38095-38096, 38101, 38103-38105, 38107-38108, 38110-38111, 38113-38116, 38121-38122, 38132-38133, 38135, 38137-38140, 38143-38147, 38155, 38159, 38161, 38163-38164, 38166, 38170, 38172-38182, 38184-38185, 38187-38189, 38191-38192, 38194-38208, 38210-38211, 38213-38215, 38217-38220, 38222, 38224-38226, 38229-38233, 38236-38239, 38244, 38246, 38248-38249, 38251-38258, 38261-38262, 38264-38268, 38270-38271, 38273-38280, 38282, 38288-38291, 38293, 38298, 38305-38307, 38309-38312, 38314, 38316-38317, 38319, 38322-38324, 38326, 38331, 38334-38338, 38340, 38343, 38345, 38347-38352, 38356, 38358-38363, 38365-38366, 38369-38372, 38377, 38380, 38382-38384, 38395-38396, 38398, 38402, 38404-38406-38407, 38411-38412, 38414, 38416, 38420-38422, 38424, 38426-38427, 38435-38440, 38442-38443, 38445, 38450-38451, 38454-38455, 38465-38467, 38475-38478, 38484, 38486-38487, 38489-38490, 38492, 38497-38499, 38502, 38505-38506, 38511-38512, 38517, 38519-38520, 38525, 38528-38531, 38534, 38536, 38543, 38548, 38550, 38557, 38559, 38565-38569, 38571, 38575-38576, 38578-38586, 38588, 38591-38599, 38601-38602, 38604, 38606, 38612, 38616-38617, 38619-38620, 38622-38624, 38628-38632, 38634, 38639, 38648, 38651, 38654, 38657, 38661-38664, 38668, 38670-38672, 38675, 38677-38682, 38685-38686, 38699, 38702-38703, 38706, 38714, 38717, 38719, 38721-38723, 38727, 38733-38734, 38740-38741, 38746-38750, 38755, 38757, 38759, 38762-38763, 38767, 38776, 38779-38780, 38782-38784, 38788-38795, 38797-38798, 38811-38812, 38814-38818, 38820-38822, 38824, 38826, 38830, 38832-38836, 38839-38840, 38842, 38844-38847, 38849-38850, 38852-38854, 38856-38857, 38864-38865, 38868-38869, 38871-38873, 38875, 38877, 38879-38880, 38882-38883, 38886-38887, 38889-38893, 38896-38898, 38900-38901, 38905, 38907-38908, 38910, 38913, 38915-38918, 38920-38923, 38929, 38932-38933, 38937, 38942, 38944, 38949, 38951-38952, 38954-38955, 38961-38965, 38968, 38971-38972, 38978, 38985-38987, 38989-38993, 38995-38997, 38999, 39005-39006, 39009-39010, 39012, 39015, 39019, 39021-39023, 39033, 39035, 39038, 39041, 39047-39048, 39051-39052, 39055-39059, 39061, 39063-39065, 39068, 39070-39074, 39076, 39078, 39080-39082, 39084-39092, 39094, 39096-39097, 39099-39100, 39102, 39104-39107, 39109-39115, 39117-39126, 39128, 39131, 39134-39140, 39142, 39145, 39147, 39149, 39153-39154, 39156-39157, 39159-39160, 39162, 39164, 39167-39168, 39170, 39172-39173, 39175-39177, 39183, 39185, 39187, 39189, 39191, 39193, 39196-39200, 39202, 39204-39208, 39210, 39214-39215, 39217, 39219, 39223, 39227, 39230, 39236, 39238-39240, 39250-39251, 39254, 39258-39260, 39265-39272, 39274-39276, 39278, 39282, 39286, 39288, 39291-39299, 39301-39303, 39307-39308, 39310-39317, 39323, 39325-39327, 39329, 39331-39333, 39335, 39339-39346, 39349, 39351, 39353, 39355-39359, 39362-39364, 39366-39367, 39386, 39388-39389, 39391-39393, 39396, 39401, 39404, 39406-39417, 39421, 39423-39424, 39426-39427, 39430, 39432, 39434, 39436, 39438, 39440, 39442, 39446-39453, 39455-39459, 39461, 39464, 39466, 39472, 39474-39475, 39477, 39479, 39481-39490, 39494, 39496, 39501, 39503-39504, 39509, 39512-39514, 39516-39519, 39521, 39523-39526, 39528-39533, 39536, 39541-39548, 39550, 39552-39553, 39563, 39565-39566, 39568-39578, 39581, 39593, 39596, 39601-39603, 39606-39608, 39611-39615, 39617, 39619-39622, 39627, 39629-39640, 39642-39650, 39652-39655, 39658-39665, 39668, 39675-39676, 39680-39681, 39683-39684, 39687-39692, 39694-39696, 39699, 39706-39709, 39711-39713, 39721-39722, 39725-39727, 39734, 39736, 39739, 39741-39742, 39744, 39747, 39752, 39756-39758, 39760, 39762-39763, 39765, 39767, 39769, 39771-39780, 39783, 39787-39792, 39794-39795, 39800, 39802-39804, 39806-39807, 39809, 39813, 39816-39823, 39825, 39827-39829, 39833-39834, 39837-39839, 39842-39843, 39847-39849, 39853-39854, 39856-39857, 39859, 39863, 39866, 39870-39871, 39875, 39878, 39884, 39888, 39896, 39898-39900, 39902-39906, 39908-39909, 39912, 39916-39917, 39922, 39924-39926, 39929-39935, 39938-39942, 39944-39945, 39947-39949, 39951-39952, 39954, 39957-39962, 39964, 39968, 39970, 39973-39974, 39977-39979, 39982, 39984-39987, 39995-39997, 39999, 40002, 40004-40007, 40009-40011, 40017-40020, 40024, 40027, 40029, 40031, 40033, 40038, 40042-40045, 40052-40053, 40055-40056, 40058-40063, 40065-40067, 40074-40076, 40078, 40080-40082, 40085, 40087, 40090, 40094-40095, 40097, 40099-40106, 40108-40109, 40111-40117, 40119, 40121-40122, 40124-40125, 40127, 40131, 40134-40135, 40137, 40139, 40141-40143, 40145-40146, 40149-40156, 40161, 40163, 40165, 40169-40170, 40172, 40174-40175, 40177, 40181, 40183-40185, 40187-40189, 40191-40192, 40194-40199, 40202-40205, 40208, 40213-40215, 40217-40219, 40223, 40225-40229, 40231, 40236, 40240, 40243, 40253-40256, 40259-40260, 40262-40264, 40266, 40268, 40270-40278, 40280-40282, 40284, 40288, 40290, 40292-40296, 40298, 40300-40303, 40305, 40307, 40310-40311, 40313-40314, 40316, 40319-40322, 40329, 40331-40338, 40343, 40347-40360, 40362-40363, 40372-40373, 40375-40376, 40378-40380, 40382-40384, 40387-40388, 40391-40394, 40396-40398, 40402, 40404, 40409-40411, 40418, 40421, 40423-40424, 40427-40428, 40430, 40432-40433, 40438, 40441-40442, 40444-40445, 40447-40449, 40453-40457, 40462-40463, 40468-40473, 40475-40480, 40482, 40485, 40487-40491, 40493, 40495-40497, 40499, 40501-40507, 40512-40516, 40521-40526, 40531-40533, 40535, 40537, 40543, 40546-40547, 40550, 40553, 40556, 40559, 40561-40564, 40566, 40570, 40573, 40576, 40578-40581, 40584-40585, 40592-40594, 40597-40599, 40603-40604, 40606, 40608-40609, 40615, 40618-40621, 40624, 40626, 40628, 40630, 40641-40643, 40648, 40652-40653, 40656-40658, 40660, 40662, 40664, 40666-40668, 40671, 40673, 40676-40677, 40679, 40681, 40685, 40687-40689, 40691-40692, 40695, 40700, 40703-40706, 40710-40711, 40713, 40715, 40718-40722, 40724-40733, 40736-40737, 40739-40741, 40744-40746, 40752, 40755-40757, 40759, 40761, 40765-40774, 40778, 40780, 40782-40783, 40785, 40787-40790, 40793-40794, 40799-40800, 40806-40807, 40811-40814, 40818-40819, 40823, 40830-40831, 40837-40840, 40843, 40849-40853, 40856-40858, 40861-40871, 40874, 40876, 40878, 40880, 40883, 40887, 40891-40896, 40902-40905, 40907, 40909-40916, 40919, 40921-40924, 40926, 40928-40931, 40933-40934, 40936, 40938, 40942-40947, 40950, 40954, 40958, 40960, 40966-40971, 40973-40977, 40980-40981, 40984-40988, 40991-40992, 40994-40995, 40997, 41000, 41002, 41004, 41006-41007, 41010-41011, 41015-41016, 41022, 41024-41025, 41027-41029, 41031-

41036, 41039, 41041-41043, 41045, 41059, 41064-41065, 41067-41073, 41075-41076, 41078-41079, 41082-41084, 41087, 41089, 41091-41100, 41103, 41106-41107, 41109, 41113, 41115-41123, 41125-41127, 41130, 41133-41135, 41139-41140, 41144-41149, 41152-41155, 41157-41158, 41162-41164, 41168, 41170-41175, 41178, 41180-41181, 41186-41187, 41189, 41191, 41194, 41199-41201, 41204-41206, 41209, 41214-41216, 41218, 41222, 41226, 41228-41230, 41232, 41239, 41242-41243, 41246, 41248, 41252-41254, 41263, 41265-41267, 41269-41271, 41273-41274, 41276, 41285-41288, 41291, 41295-41296, 41307, 41311-41312, 41314-41315, 41320, 41329-41331, 41335-41337, 41340, 41342, 41344-41345, 41347-41350, 41352, 41354-41359, 41361, 41363, 41365, 41367, 41369-41370, 41372-41373, 41376, 41378-41380, 41383-41384, 41386, 41388, 41390, 41392, 41398, 41400-41404, 41408, 41410-41411, 41414, 41418-41421, 41428-41430, 41432-41433, 41435-41437, 41440-41441, 41443-41444, 41448-41449, 41455, 41457, 41459, 41464-41466, 41473, 41475, 41478-41479, 41485, 41487-41490, 41492, 41494, 41497-41499, 41504-41507, 41510, 41513-41515, 41517-41518, 41520-41521, 41525-41526, 41529, 41531, 41533, 41535-41536, 41540-41541, 41545-41546, 41548, 41550-41556, 41558-41560, 41562, 41566-41568, 41570, 41572-41576, 41578, 41582, 41588, 41590-41594, 41596, 41606-41608, 41611, 41613-41615, 41624, 41629, 41637, 41643-41644, 41647-41648, 41650-41655, 41658-41660, 41662-41664, 41666-41674, 41676-41677, 41679-41680, 41682, 41685, 41689, 41692, 41697, 41700-41702, 41707, 41710-41712, 41714, 41716-41717, 41719, 41724-41731, 41734-41738, 41740-41741, 41746-41747, 41749-41750, 41754-41755, 41758, 41760, 41763-41765, 41771, 41775-41780, 41787-41788, 41790, 41792, 41799, 41801, 41803-41804, 41806-41808, 41811, 41814, 41816-41817, 41819, 41821, 41824-41827, 41835, 41840-41842, 41844-41845, 41847, 41849, 41854, 41858-41861, 41865-41866, 41868-41869, 41872-41879, 41881-41894, 41898, 41903, 41906, 41908, 41910-41913, 41916-41917, 41924, 41927, 41931, 41936-41937, 41940, 41943-41944, 41946, 41948-41949, 41954, 41957-41958, 41960, 41962-41963, 41967, 41971, 41974-41975, 41980, 41982-41986, 41989-41992, 41994, 41999, 42004, 42007, 42010-42016, 42018, 42020, 42022-42023, 42027, 42034-42035, 42038, 42042-42045, 42049, 42051-42054, 42063-42067, 42071, 42079-42086, 42094-42100, 42105-42107, 42111-42112, 42114-42116, 42118, 42120, 42122-42126, 42128, 42130, 42133, 42136, 42138, 42140, 42142-42143, 42145, 42149-42152, 42154, 42156-42157, 42159-42160, 42164-42166, 42169, 42172, 42174-42178, 42180, 42182-42187, 42191-42195, 42198-42200, 42202-42204, 42208-42212, 42214, 42216-42217, 42219-42220, 42226-42230, 42235, 42240-42244, 42246-42250, 42255, 42261-42262, 42264, 42273-42274, 42276-42278, 42281, 42287, 42290-42291, 42293, 42298-42300, 42304-42306, 42309, 42311, 42318-42321, 42324, 42326-42335, 42340-42341, 42343, 42345, 42353-42354, 42358, 42361-42362, 42364-42367, 42370, 42372-42377, 42379-42380, 42382, 42385-42387, 42389, 42392-42394, 42399, 42402, 42404-42410, 42414, 42418-42419, 42422, 42424-42429, 42431-42433, 42435-42436, 42438, 42444-42445, 42455, 42459, 42462-42464, 42466-42470, 42472, 42483, 42485-42486, 42488, 42491, 42494-42495, 42497-42502, 42504-42505, 42508-42513, 42516-42523, 42526-42529, 42531-42532, 42538, 42542-42546, 42554, 42556-42558, 42561, 42565, 42568, 42570, 42573, 42577-42580, 42585, 42587-42590, 42593-42594, 42601-42602, 42605, 42608-42609, 42611, 42613-42615, 42618-42624, 42626, 42628-42634, 42636-42643, 42645-42646, 42648-42651, 42653-42656, 42659-42662, 42664-42666, 42669-42671, 42674-42676, 42679-42680, 42682, 42686-42689, 42691, 42694, 42698-42700, 42703, 42705-42707, 42710, 42719-42721, 42728, 42731, 42734-42736, 42740-42741, 42743, 42749, 42751, 42754-42755, 42757, 42759-42760, 42762, 42765-42766, 42768-42769, 42771, 42775, 42784-42785, 42787-42791, 42793-42794, 42799-42803, 42805-42807, 42817, 42819-42820, 42824-42825, 42830, 42833-42837, 42839-42842, 42844-42848, 42850-42852, 42854-42855, 42857, 42859-42863, 42865-42866, 42869, 42873-42876, 42878, 42882, 42886, 42888-42892, 42895-42897, 42904-42907, 42909-42910, 42912-42920, 42922-42923, 42925, 42929, 42931, 42936, 42939-42942, 42947-42948, 42952, 42954-42961, 42965, 42967-42968, 42971-42975, 42984, 42986-42987, 42989, 42991, 42994-42996, 42999-43002, 43004, 43006-43007, 43014-43019, 43021-43022, 43024-43028, 43030-43037, 43039-43048, 43055, 43057, 43060-43062, 43064, 43068-43070, 43073, 43076-43077, 43082, 43084-43086, 43088-43089, 43091, 43093, 43095-43097, 43101, 43104-43106, 43114-43122, 43125-43128, 43133-43134, 43136-43137, 43139-43145, 43147, 43149-43151, 43153, 43156, 43158-43160, 43162-43165, 43167-43168, 43170-43171, 43173, 43175-43179, 43181-43182, 43184, 43186-43187, 43189, 43195-43196, 43198, 43200-43202, 43205-43206, 43208, 43210-43214, 43216-43218, 43222-43224, 43226, 43228-43233, 43237-43238, 43240-43247, 43250-43251, 43253-43254, 43257-43258, 43260-43262, 43264-43267, 43269-43272, 43277, 43280-43281, 43283, 43286, 43292, 43294, 43299, 43301, 43305-43307, 43310, 43312, 43314-43317, 43320, 43323, 43325-43328, 43332-43333, 43335, 43341-43344, 43346, 43348-43349, 43352, 43354-43356, 43358, 43361, 43368, 43370-43371, 43373-43374, 43380, 43382-43383, 43385, 43393, 43396, 43398, 43401-43402, 43404-43405, 43411, 43417, 43422, 43426, 43429, 43439, 43442, 43445-43449, 43452-43458, 43460, 43467-43468, 43470-43474, 43477-43481, 43484, 43487-43488, 43491, 43494-43495, 43497-43498, 43500-43505, 43508, 43510-43512, 43514-43515, 43519, 43521-43524, 43530, 43536, 43540, 43542, 43544, 43546-43547, 43551-43552, 43554, 43558, 43560, 43565-43569, 43571-43573, 43575, 43579-43580, 43584, 43588-43591, 43593-43594, 43597-43599, 43601, 43603-43610, 43612-43616, 43618, 43620, 43622-43625, 43630, 43632, 43634, 43637, 43639-43641, 43643, 43645, 43647, 43649-43650, 43652, 43659, 43662-43668, 43673, 43676-43680, 43682, 43687, 43690-43693, 43695-43696, 43700-43702, 43704, 43706-43708, 43714-43716, 43723, 43728-43732, 43734, 43737, 43744-43748, 43750-43751, 43755-43763, 43765, 43767, 43771-43777, 43781, 43783-43785, 43789, 43793-43794, 43797-43804, 43807-43810, 43813, 43818, 43820-43821, 43823, 43826-43827, 43831-43837, 43839-43840, 43846-43849, 43853, 43856-43862, 43864-43868, 43870-43871, 43874-43875, 43878, 43882-43883, 43886, 43888-43891, 43894, 43896-43898, 43900, 43902-43903, 43909, 43913, 43916-43917, 43919-43924, 43926, 43928-43932, 43934-43937, 43939, 43941, 43944, 43946, 43948-43950, 43952, 43955, 43960-43961, 43963-43967, 43970, 43973-43974, 43976, 43984, 43986, 43989, 43992-44001, 44004, 44006-44007, 44009, 44014-44016, 44018, 44021, 44023-44024, 44026, 44028-44037, 44039, 44046, 44048, 44050-44051, 44053-44054, 44056-44058, 44061-44063, 44065, 44067, 44069-44070, 44072-44073, 44078, 44080-44081, 44083-44084, 44086-44092, 44096-44099, 44105-44106, 44110, 44113-44115, 44118-44122, 44124-44125, 44127-44128, 44130-44132, 44134-44136, 44138-44144, 44147, 44150, 44152, 44156-44158, 44171, 44174, 44180, 44182, 44184-44185, 44187-44188, 44190, 44194-44195, 44199, 44203, 44210, 44219, 44223, 44226-44227, 44230, 44235, 44240-44244, 44246-44247, 44249, 44253-44254, 44257-44261, 44266-44268, 44271, 44275, 44281-44282, 44284, 44289, 44294, 44299-44304, 44306-44307, 44309, 44311-44314, 44316, 44318-44319, 44321, 44323-44324, 44326-44327, 44329-44331, 44334, 44342-44344, 44346, 44357-44358, 44362, 44364, 44366, 44372, 44374, 44377-44380, 44382-44383, 44385, 44387, 44395-44396, 44399-44403, 44405, 44413-44416, 44419-44422, 44424, 44428-44435, 44437-44438, 44440-44442, 44444, 44446, 44452-44454, 44456-44458, 44460, 44464-44465, 44467-44471, 44473, 44475, 44477-44479, 44482-44483, 44485, 44487-44488, 44492-44494, 44496, 44502, 44504-44506, 44508, 44510, 44513, 44516-44517, 44519-44520, 44522, 44525-44526, 44528, 44533-44534, 44536, 44538-44540, 44553, 44556, 44559-44561, 44569, 44574-44575, 44577-44578, 44580-44581, 44583-44584, 44586-44587, 44590, 44593-44595, 44597, 44599, 44601-44604, 44606, 44609, 44611, 44615, 44617, 44624-44625, 44629, 44636, 44641-44645, 44647-44648, 44650, 44652, 44655, 44661, 44676, 44678-44680, 44684-44688, 44690, 44692-44693, 44695, 44701, 44704, 44707-44713, 44715, 44717-44721, 44723-44724, 44733-44741, 44745, 44747-44748, 44750-44752, 44756-44757, 44760, 44762-44763, 44765, 44771-44774, 44776, 44779, 44782-44783, 44785-44790, 44794-44796, 44798-44802, 44804-44806, 44808-44810, 44812-44818, 44821, 44823-44825, 44827-44828, 44832, 44840-44841, 44843-44845, 44848-44850, 44854, 44857, 44861-44863, 44866-44873, 44878-44881, 44883, 44885, 44887-44890, 44892, 44894-44896, 44898, 44900, 44904, 44906-44909, 44912, 44914-44915, 44922, 44925-44926, 44929, 44933, 44935-44941, 44943-44945, 44947, 44952, 44954-44955, 44960, 44963, 44972-44974, 44978, 44984, 44991, 44996-44997, 44999, 45005-45006, 45008, 45010, 45012-45017, 45020-45021, 45023, 45026, 45028-45029, 45031-45032, 45035, 45037-45038, 45043, 45045, 45047, 45051, 45054, 45056, 45058-45062, 45064-45075, 45078-45080, 45084, 45086, 45088-45092, 45096-45097, 45102, 45104-45105, 45107-45112, 45114-45115, 45117, 45119-45120, 45122, 45128-45130, 45132-45133, 45139, 45141, 45147, 45149, 45151-45153, 45155, 45158, 45161, 45165, 45168, 45175, 45177-45178, 45183-45187, 45189-45190, 45192, 45194, 45199-45200, 45202-45203, 45205, 45207-45208, 45210, 45212, 45216, 45222, 45227-45230, 45232, 45238-45240, 45242, 45245, 45247, 45253, 45256, 45258-45259, 45262, 45273-45274, 45276-45278, 45280, 45284, 45294-45298, 45301, 45304, 45308, 45311-45317, 45319-45320, 45322-45323, 45325-45326, 45329-45331, 45333, 45335, 45338-45339, 45344-45346, 45348-45349, 45351-45359, 45361, 45363-45364, 45366, 45368, 45370, 45372-45379, 45385-45389, 45391-45399, 45403, 45409, 45412-45413, 45415-45420, 45424-45426, 45430-45431, 45433-45438, 45440, 45442, 45444-45451, 45453-45454, 45457, 45461, 45463, 45465, 45467, 45469-45473, 45482-45487, 45490-45495, 45502, 45507-45508, 45510, 45516, 45518-45521, 45524-45527, 45529-45534, 45545, 45549-45552, 45554-45556, 45558-45559, 45563-45564, 45567, 45570-45572, 45574, 45576-45581, 45586, 45588-45589, 45591-45593, 45595, 45599, 45601, 45604, 45606, 45608-45610, 45612-45616, 45618-45620, 45624, 45627, 45630-45632, 45634, 45636, 45638-45643, 45645, 45647-45648, 45652-45653, 45659, 45661, 45663-45665, 45667-45668, 45670-45677, 45681-45683, 45685, 45690-45693, 45697-45700, 45703, 45706, 45708-45709, 45716, 45722-45727, 45735-45736, 45741, 45744-45746, 45749, 45751-45752, 45754-45757, 45759-45760, 45764-45765, 45767, 45769-45771, 45779-45780, 45784, 45786, 45788, 45791-45796, 45798-45802, 45806, 45808, 45811, 45814-45815, 45818, 45827, 45832, 45834-45835, 45838-45839, 45842-45844, 45847-45848, 45852-45853, 45856-45858, 45865, 45868-45870, 45872-45875, 45877-45879, 45881-45887, 45889-45893, 45900, 45903, 45905-45906, 45909-45919, 45921, 45923, 45925-45926, 45930, 45934-45936, 45938-45939, 45942-45943, 45945-45947, 45949-45951, 45953, 45955-45957, 45961, 45965-45966, 45969-45971, 45973, 45975-45976, 45979-45980, 45983-45986, 45990, 45997, 46000, 46002-46003, 46006-46007, 46009, 46012-46013, 46015-46016, 46018-46022, 46024-46025, 46027-46033, 46037, 46040, 46042-46043, 46047-46049, 46051-46053, 46055, 46058-46063, 46068-46069, 46075, 46078-46079, 46081, 46084-46098, 46100-46108, 46110-46113, 46115, 46119-46122, 46126-46127, 46131-46136, 46138-46139, 46142-46143, 46153, 46157-46158, 46160-46165, 46168-46170, 46173, 46176-46177, 46179-46180, 46182-46183, 46188-46196, 46198-46201, 46205, 46207-46210, 46212-46214, 46218-46219, 46221, 46227, 46233-46234, 46236-46240, 46242-46244, 46247, 46249, 46252-46253, 46255-46256, 46258-46267, 46269-46279, 46283, 46285-46288, 46291, 46293-46294, 46296, 46298-46299, 46301-46302, 46308, 46310, 46312-46314, 46316-46319, 46321-46328, 46331, 46334-46335, 46337-46338, 46340-46342, 46344, 46346-46350, 46352-46354, 46356-46358, 46362-46367, 46374-46375, 46377-46379, 46383, 46385-46388, 46390-46393, 46395, 46398, 46403, 46405-46414, 46416-46418, 46420, 46422, 46424, 46428-46429, 46431, 46433-46434, 46436, 46441-46442, 46444, 46446, 46448, 46450, 46452-46453, 46455-46456, 46459-46460, 46462, 46464-46465, 46467-46472, 46475, 46478-46480, 46482-46483, 46485-46488, 46491, 46493-46494, 46496-46497, 46501-46504, 46507, 46511-46513, 46515-46516, 46518-46525, 46528-46529, 46532-46533, 46540-46541, 46543, 46545, 46547-46550, 46552, 46555, 46557, 46560-46561, 46563, 46566, 46569-46570, 46583-46586, 46590-46593, 46595, 46601, 46604, 46608-46609, 46612-46616, 46618, 46621, 46623, 46625-46629, 46631-46633, 46636, 46638, 46641, 46646, 46649, 46653, 46655, 46657, 46660-46661, 46664-46666, 46668-46672, 46674-46679, 46690, 46692, 46696-46697, 46700, 46702-46703, 46710-46713, 46716-46717, 46719-46721, 46723, 46726-46728, 46730, 46732-46733, 46738-46742, 46744-46745, 46747-46752, 46754-46755, 46757-46762, 46764, 46768, 46771-46774, 46776, 46779-46781, 46783, 46785-46786, 46795-46796, 46800, 46806, 46809, 46820, 46823-46825, 46827-46833, 46835-46836, 46838-46839, 46841, 46843, 46845-46846, 46852-46855, 46857-46859, 46861-46864, 46866-46869, 46871-46872, 46874-46875, 46882, 46884, 46886-46887, 46889, 46891-46893, 46895-46905, 46907-46910, 46912-46913, 46915-46916, 46918, 46921-46922, 46927, 46929-46933, 46936, 46939-46940, 46942, 46944-46947, 46950-46951, 46954-46956, 46959-46960, 46963-46965, 46967-46968, 46970-46973, 46978, 46983-46984, 46986-46990, 46992-46993, 47000, 47002-47005, 47008-47009, 47011-47012, 47014-47017, 47019, 47021, 47029, 47031-47032, 47036, 47038, 47040, 47043, 47045-47046, 47048, 47051, 47055-47057, 47059-47062, 47065, 47068-47070, 47072-47073, 47075-47086, 47088, 47090-47093, 47095-47099, 47102-47104, 47108, 47110-47112, 47114, 47117, 47119, 47123, 47128-47131, 47133, 47136-47139, 47141, 47144-47148, 47150-47151, 47153, 47155, 47158, 47162-47164, 47168, 47170-47172, 47174, 47176-47181, 47184, 47188, 47190-47191, 47193-47197, 47199-47201, 47204, 47206-47211, 47213, 47217, 47221-47227, 47231-47232, 47234, 47237, 47239-47240, 47243-47249, 47255-47259, 47265-47271, 47274, 47281-47285, 47287-47292, 47295, 47298, 47300, 47302, 47306-47307, 47311, 47317-47318, 47320-47322, 47326-47330, 47333-47335, 47340, 47342, 47344-47345, 47347-47350, 47353-47358, 47360-47361, 47366-47369, 47371, 47373, 47375-47377, 47379, 47381-47385, 47387-47389, 47393-47398, 47400-47401, 47404-47413, 47418, 47420-47421, 47425-47426, 47428, 47431-47441, 47444, 47446-47447, 47451-47457, 47459, 47461, 47463-47466, 47468-47471, 47473-47482, 47485-47493, 47500, 47508-47509, 47513, 47515, 47517-47518, 47520-47524, 47528, 47532, 47536, 47538-47540, 47542-47551, 47553, 47557, 47560-47562, 47564-47565, 47567, 47570, 47573-47583, 47588-47590, 47592-47596, 47599, 47604-47605, 47607, 47609-47611, 47613-47616, 47618, 47620-47621, 47623-47625, 47627-47628, 47630-47631, 47633-47635, 47639, 47642, 47646, 47648, 47650-47651, 47653

Single Strand Oligonucleotides (Sense Strand of Target Gene)

SeqID range: 47462-83660

SeqIDs w/o G Runs:
47463, 47468-47483, 47485-47551, 47554-47559, 47561-47569, 47577-47608, 47612-47623, 47625-47631, 47633-47638, 47643-47674, 47688-47851, 47866-47986, 48000-48094, 48108-48129, 48143-48269, 48321-48337, 48353-48404, 48418-48478, 48492-48556, 48571-48682, 48696-48755, 48768-48818, 48831-48973, 48897-49046, 49060-49081, 49095-49191, 49205-49278, 49292-49314, 49329-49522, 49536-49641, 49655-49675, 49689-49930, 49944-49988, 50002-50012, 50028-50153, 50176-50367, 50381-50395, 50415-50545, 50560-50602, 50616-50664, 50680-50746, 50760-50783, 50799-51199, 51225-51348, 51374-51408, 51422-51470, 51495-51511, 51534-51721, 51743-51840, 51859-52001, 52016-52040, 52060-52100, 52115-52133, 52147-52382, 52406-52416, 52431-52473, 52487-52509, 52524-52745, 52759-52766, 52780-52823, 52837-52862, 52889-52956, 52971-53167, 53180-53285, 53294-53359, 53373-53428, 53451-53505, 53530-53571, 53585-53604, 53618-53784, 53811-53935, 53949-54341, 54363-54490, 54504-54683, 54697-54730, 54744-54788, 54794-55004, 55018-55204, 55218-55435, 55456-55626, 55640-55644, 55658-55702, 55710-55744, 55758-55909, 55923-55926, 55929-55967, 55980-55991, 55996-56006, 56027-56082, 56096-56108, 56123-56183, 56196-56198, 56214-56228, 56236-56309, 56323-56326, 56340-56392, 56406-56411, 56425-56570, 56584-56627, 56641-56666, 56680-56772, 56786-56823, 56837-57013, 57028-57164, 57178-57215, 57229-57350, 57366-57375, 57390-57466, 57480-57622, 57636-57726, 57740-57847, 57861-58139, 58153-58223, 58239-58267, 58281-58522, 58536-58690, 58704-58874, 58894-58907, 58921-58981, 58995-59009, 59023-59119, 59133-59208, 59222-59264, 59278-59297, 59312-59359, 59373-59460, 59474-59782, 59802-59988, 60002-60175, 60189-60193, 60207-60360, 60374-60437, 60445-60506, 60521-60525, 60530-60552, 60556-60563, 60577-60617, 60627-60844, 60854-60889, 60894-61004, 61019-61074, 61088-61149, 61158-61183, 61197-61221, 61235-61261, 61268-61445, 61459-61480, 61494-61511, 61525-61559, 61573-61746, 61760-61784, 61809-61858, 61870-61884, 61892-61962, 61970-62018, 62029-62113, 62127-62223, 62237-62409, 62423-62449, 62471-62621, 62635-62700, 62722-62823, 62859-62874, 62888-62901, 62915-62965, 62987-63173, 63198-63219, 63233-63278, 63292-63311, 63338, 63353-63569, 63597-63630, 63661-63663, 63681-63708, 63722-63836, 63858-63880, 63894-63931, 63946-63959, 63973-63984, 63999-64067, 64081-64097, 64111-64222, 64237-64280, 64294-64519, 64534-64563, 64577-64598, 64612-64668, 64682-64701, 64716-64737, 64752-64754, 64770-64836, 64850-64867, 64881-64930, 64944-65009, 65023-65082, 65097-65162, 65176-65216, 65244-65272, 65299-65357, 65371-65413, 65428-65455, 65480-65567, 65581-65638, 65652-65686, 65700-65753, 65771-65805, 65820-65950, 65964-66047, 66067-66129, 66157-66181, 66195-66198, 66212-66218, 66232-66257, 66293-66369, 66397-66492, 66506-66563, 66577-66593, 66607-66622, 66637-66926, 66945-67095, 67114-67181, 67199-67203, 67217-67374, 67388-67543, 67557-67613, 67628-67675, 67689-67717, 67744-67814, 67830-67868, 67883, 67908-67921, 67935-68334, 68348-68522, 68557-68693, 68707-68770, 68784-68843, 68866, 68880-68903, 68917-68979, 68994-68997, 69011-69110, 69125-69143, 69158-69168, 69182-69219, 69234-69269, 69285-69330, 69345-69466, 69480-69484, 69498-69590, 69605-69701, 69715-69722, 69736-69763, 69783-69839, 69853-69869, 69883-69945, 69968-69979, 69993-70085, 70115-70138, 70152-70232, 70246-70268, 70282-70290, 70308-70315, 70329-70345, 70359-70456, 70470-70478, 70493-70655, 70670-70707, 70721-70828, 70842-70855, 70870-70983, 70997, 71011-71024, 71038-71094, 71109-71334, 71348-71555, 71569-71653, 71667-71747, 71761-71820, 71834-71837, 71852-71880, 71894-71925, 71939-71965, 71981-71983, 71997-72034, 72048-72064, 72079-72280, 72294-72366, 72380-72395, 72439-72459, 72473-72488, 72509-72546, 72560-72645, 72660-72670, 72685-72866, 72880-72949, 72964, 72978-73070, 73084-73203, 73222-73229, 73244-73466, 73493-73508, 73537-73545, 73559-73560, 73574-73617, 73631-73646, 73660-73694, 73708-73739, 73753-73760, 73776-73885, 73899-73961, 73975-73988, 74002-74092, 74106-74128, 74142-74143, 74174-74227, 74241-74574, 74588-74677, 74691-74744, 74758-74869, 74883-74956, 74975-75006, 75021-75101, 75115-75165, 75179-75213, 75227-75280, 75294-75310, 75324-75355, 75388-75412, 75438-75452, 75473-75525, 75540-75543, 75570-75597, 75624-75632, 75646-75683, 75703-75723, 75737-75792, 75833-75859, 75884-75924, 75938-75956, 75970-75989, 76013-76030, 76051-76053, 76068-76104, 76124-76134, 76148-76159, 76174-76263, 76293-76330, 76344-76395, 76445-76521, 76535-76621, 76635-76647, 76669-76670, 76705, 76719-76740, 76754-76879, 76893-77017, 77031-77116, 77130-77185, 77208-77210, 77225-77229, 77262-77314, 77328-77361, 77376-77396, 77438-77491, 77505-77585, 77599-77610, 77631-77703, 77719-77790, 77806-77813, 77828-77851, 77865-77875, 77889-77897, 77911-78128, 78156-78163, 78177-78235, 78250-78282, 78296-78459, 78473-78487, 78510-78525, 78543-78562, 78585-78605, 78639-78718, 78734-78787, 78801-78891, 78916-78967, 78982-78986, 79022-79030, 79045-79048, 79062-79080, 79111-79142, 79156-79164, 79190-79211, 79225-79234, 79248-79303, 79317-79340, 79354-79389, 79404-79429, 79443-79466, 79481-79530, 79546-79551, 79572-79595, 79609-79665, 79679-79838, 79852-79893, 79916-79946, 79971-80016, 80030-80077, 80091-80099, 80143-80220, 80234-80260, 80274-80321, 80336-80343, 80357-80396, 80410-80476, 80491-80497, 80512-80540, 80554-80617, 80633-80702, 80717-80755, 80777-80901, 80917, 80932-80934, 80949-80953, 80968, 80983-81032, 81047-81070, 81092-81104, 81118-81161, 81175-81182, 81193-81198, 81200-81232, 81255-81258, 81272-81377, 81389-81626, 81640-81679, 81693-81699, 81725-81743, 81757-81789, 81809-81912, 81927-81935, 81957-82023, 82037-82122, 82144-82217, 82248-82256, 82270-82278, 82293-82323, 82351-82418, 82442-82509, 82524-82687, 82701-82706, 82722-82732, 82748-82777, 82799, 82813-82816, 82830-82865, 82879-82981, 83006-83018, 83032-83063, 83085, 83105-83113, 83127-83239, 83254-83308, 83323-83370, 83399-83504, 83518-83606, 83620-83653

SeqIDs w/o miR Seeds:

47463-47466, 47468-47471, 47473-47482, 47485-47493, 47500, 47508-47509, 47513, 47515, 47517-47518, 47520-47524, 47528, 47532, 47536, 47538-47540, 47542-47551, 47553, 47557, 47560-47562, 47564-47565, 47567, 47570, 47573-47583, 47588-47590, 47592-47596, 47599, 47604-47605, 47607, 47609-47611, 47613-47616, 47618, 47620-47621, 47623-47625, 47627-47628, 47630-47631, 47633-47635, 47639, 47642, 47646, 47648, 47650-47651, 47653, 47657, 47660-47662, 47664-47665, 47667-47668, 47670-47678, 47680, 47682, 47687, 47690-47691, 47695-47696, 47698-47700, 47702, 47704-47706, 47710, 47714-47716, 47718, 47722-47730, 47733, 47735, 47737, 47739, 47741, 47747, 47749, 47751-47769, 47774, 47776-47777, 47781, 47783-47785, 47788, 47790-47791, 47793-47794, 47797-47801, 47803, 47807, 47809, 47811-47812, 47815, 47817, 47822-47823, 47826-47830, 47832-47837, 47839, 47841-47844, 47848-47850, 47853, 47856-47860, 47863, 47865-47866, 47869-47873, 47875-47876, 47878, 47882, 47886-47888, 47892, 47894-47895, 47897, 47904, 47909-47911, 47913, 47915, 47917-47922, 47926, 47931-47933, 47935-47936, 47938, 47940-47942, 47946, 47951-47952, 47955, 47957-47959, 47961, 47963-47967, 47969, 47974-47975, 47977-47992, 47994, 47996, 48001, 48003, 48005, 48007, 48009-48016, 48018-48020, 48026-48027, 48029, 48031, 48036-48039, 48041, 48043-48045, 48047, 48049-48050, 48052, 48057-48059, 48061, 48063-48066, 48068, 48070-48071, 48073-48076, 48078-48080, 48088-48095, 48097, 48100-48101, 48104-48105, 48107-48108, 48111-48114, 48117, 48120-48123, 48125-48126, 48128-48130, 48133, 48135-48136, 48138-48139, 48142, 48144-48146, 48149-48151, 48154-48156, 48158, 48160, 48162, 48166-48167, 48169, 48171-48174, 48176, 48178, 48180, 48182, 48184-48188, 48195, 48199-48204, 48207-48211, 48213-48217, 48219, 48221-48226, 48231-48235, 48237, 48239-48241, 48243-48244, 48246-48248, 48251-48253, 48255-48262, 48264-48265, 48268, 48270, 48273-48274, 48276, 48281-48287, 48291, 48297-48299, 48301, 48303-48304, 48308, 48313, 48320, 48322-48323, 48327-48328, 48333-48334, 48338-48340, 48342-48346, 48353-48356, 48359-48366, 48368, 48370-48373, 48376-48377, 48379, 48384, 48386-48393, 48396, 48399-48402, 48405-48407, 48409-48410, 48412, 48414-48415, 48417-48418, 48423-48428, 48431-48435, 48437, 48439-48444, 48447-48450, 48454, 48457-48459, 48461, 48463-48465, 48467-48469, 48473-48476, 48478, 48482-48483, 48485-48486, 48492-48496, 48499, 48501, 48503, 48505, 48507-48508, 48512-48513, 48515-48516, 48519, 48521-48525, 48527-48534, 48537-48538, 48541, 48543, 48545, 48547-48549, 48552-48558, 48560-48561, 48563-48565, 48567, 48571-48575, 48577, 48579, 48581, 48583, 48586-48599, 48602-48603, 48605-48610, 48612-48613, 48616-48619, 48621-48624, 48628-48639, 48641-48643, 48648, 48650, 48652-48658, 48660-48662, 48664, 48667, 48669-48672, 48675-48683, 48685-48690, 48692-48693, 48696-48700, 48702, 48708, 48710-48712, 48714, 48720, 48722, 48726-48732, 48736-48737, 48739-48740, 48742-48764, 48767-48768, 48770, 48772, 48774-48779, 48781-48786, 48788-48789, 48792-48798, 48800, 48802-48811, 48813-48816, 48818, 48820, 48829-48832, 48834-48841, 48843-48846, 48848, 48850, 48852, 48854, 48856-48862, 48864-48865, 48868-48871, 48873-48875, 48877-48882, 48884-48885, 48887-48889, 48891, 48893-48897, 48899, 48903-48904, 48908, 48914-48919, 48921, 48928, 48930-48931, 48933, 48935-48938, 48940-48942, 48944, 48946-48948, 48951-48953, 48958-48959, 48966, 48969-48970, 48972, 48974-48975, 48977-48979, 48981, 48987, 48989, 48991-48992, 48997-49004, 49006-49008, 49011-49016, 49018, 49020-49025, 49027-49035, 49038-49041, 49043-49050, 49052, 49054, 49058, 49060, 49064, 49067-49068, 49070-49071, 49073-49081, 49083, 49085-49088, 49090, 49094-49095, 49097-49101, 49105-49106, 49109, 49112-49113, 49115-49116, 49118-49121, 49124-49125, 49128-49130, 49133-49136, 49138, 49140, 49142, 49144-49148, 49151, 49153, 49159-49160, 49162-49164, 49166-49167, 49170-49173, 49176-49177, 49179, 49181, 49183-49185, 49187, 49190, 49193, 49197, 49199, 49201, 49205-49209, 49211, 49213-49222, 49225, 49229-49231, 49233, 49236-49239, 49241, 49245-49247, 49252-49253, 49255, 49257-49266, 49269-49271, 49274, 49279, 49281-49286, 49288, 49291, 49295-49301, 49304-49305, 49307-49314, 49316, 49319, 49321-49322, 49329, 49331-49336, 49338, 49340-49342, 49344-49346, 49349, 49351, 49353-49354, 49356-49360, 49362-49366, 49368-49370, 49372-49374, 49377-49380, 49383-49386, 49389-49395, 49397-49403, 49405-49406, 49408-49409, 49411-49413, 49415-49419, 49421, 49424, 49426-49431, 49433-49434, 49436-49443, 49445-49450, 49452-49461, 49463-49466, 49469-49472, 49476-49478, 49480-49481, 49484-49485, 49488-49489, 49491-49494, 49501, 49503-49504, 49506-49510, 49512-49513, 49515, 49517-49518, 49524-49525, 49527, 49529, 49531-49533, 49535-49536, 49539-49541, 49545-49546, 49549, 49552-49553, 49559-49561, 49563, 49565, 49567-49573, 49575-49577, 49579-49580, 49582-49585, 49587-49588, 49592-49597, 49599-49602, 49604-49610, 49615, 49617-49619, 49622-49623, 49625-49629, 49631, 49633-49634, 49637-49638, 49640, 49642-49646, 49648, 49653, 49658-49660, 49662, 49664-49669, 49674-49675, 49679-49681, 49683, 49686, 49689, 49691, 49693-49700, 49703-49707, 49709-49710, 49713, 49716-49723, 49725-49726, 49728-49729, 49736-49741, 49743-49744, 49746, 49748-49750, 49752, 49754, 49756-49757, 49760, 49762-49763, 49765-49768, 49771-49773, 49775-49780, 49782-49787, 49789-49794, 49796-49798, 49800, 49802-49808, 49811, 49813-49819, 49821, 49823-49824, 49826-49827, 49830-49833, 49836, 49838-49841, 49843, 49845-49849, 49851-49858, 49860-49866, 49868-49878, 49881-49882, 49885, 49887-49888, 49890-49895, 49898, 49901-49902, 49904-49905, 49907, 49910, 49912-49915, 49917, 49919-49931, 49933-49936, 49938, 49941, 49944, 49946, 49948-49949, 49951, 49953, 49955-49961, 49963-49973, 49975, 49978, 49981-49984, 49986, 49988-49989, 49991, 49993, 49999, 50002-50004, 50008, 50015-50020, 50029, 50031-50035, 50037-50040, 50042-50058, 50060-50062, 50064, 50066-50071, 50073-50074, 50079-50080, 50082, 50085, 50087-50094, 50096, 50099-50100, 50103, 50105-50108, 50110-50120, 50123-50124, 50131-50132, 50135, 50138-50140, 50142-50143, 50145, 50147, 50151, 50154-50155, 50157-50161, 50167-50169, 50178-50184, 50186-50189, 50191-50209, 50211, 50213, 50217-50219, 50222-50243, 50246-50247, 50249, 50254-50256, 50258-50259, 50261-50270, 50274, 50278-50279, 50282, 50285, 50287-50290, 50292-50293, 50296-50298, 50300, 50303-50309, 50315-50317, 50319, 50325-50327, 50331-50332, 50334-50338, 50342, 50344-50347, 50352-50353, 50364-50365, 50370, 50372-50374, 50376-50377, 50379, 50381-50383, 50385, 50387-50402, 50409, 50414-50417, 50420-50422, 50424-50425, 50427-50432, 50434, 50436-50440, 50442, 50444, 50446-50451, 50454-50457, 50459, 50461, 50463-50464, 50467-50471, 50473, 50475-50476, 50478, 50481-50483, 50485-50487, 50489-50490, 50492-50496, 50500-50503, 50505-50509, 50511-50512, 50514-50515, 50520-50524, 50526-50533, 50536-50537, 50539-50547, 50549, 50553-50554, 50557, 50559-50561, 50565-50568, 50572, 50574, 50577, 50580-50581, 50585-50586, 50593-50595, 50600-

50602, 50607-50608, 50610, 50612-50613, 50615-50616, 50618, 50620-50621, 50623, 50625, 50627, 50629, 50632, 50635-50637, 50639, 50642, 50644-50646, 50648, 50656, 50659, 50662-50664, 50666, 50669, 50671-50672, 50674, 50677, 50680-50682, 50684-50693, 50700-50701, 50704-50706, 50708-50709, 50711, 50713-50716, 50718-50721, 50723, 50725, 50727-50728, 50730, 50733, 50736, 50738-50741, 50743-50746, 50748, 50754, 50759, 50764, 50773-50775, 50778-50786, 50789, 50796, 50798, 50800-50802, 50804, 50807-50813, 50815, 50818, 50820-50821, 50824, 50826, 50828-50829, 50832-50833, 50836, 50839, 50841-50842, 50844-50847, 50849, 50851, 50853, 50855, 50857, 50860, 50862, 50864, 50871-50878, 50880-50885, 50889-50891, 50893, 50896, 50898-50902, 50904-50907, 50909-50910, 50912-50913, 50915-50917, 50919, 50921-50922, 50924-50927, 50930-50932, 50934-50953, 50955-50958, 50960-50963, 50965-50970, 50974, 50976, 50978, 50980-50991, 50993, 50995-50996, 50999-51000, 51005, 51007, 51011, 51013-51016, 51019-51020, 51023, 51025-51027, 51030-51031, 51033-51035, 51037-51046, 51048, 51050-51051, 51053-51063, 51066-51072, 51078-51079, 51081-51086, 51089-51093, 51095-51099, 51101-51102, 51104, 51106-51108, 51110-51114, 51116, 51120, 51122-51131, 51133-51141, 51143-51144, 51147, 51153-51155, 51159-51161, 51163-51164, 51169, 51171, 51173, 51175-51176, 51178, 51181-51184, 51186-51192, 51194, 51196, 51198, 51200, 51204-51207, 51210-51216, 51218, 51223, 51227, 51230-51232, 51234-51236, 51240, 51242-51247, 51251, 51259, 51262-51265, 51268, 51271-51274, 51276-51277, 51279-51280, 51282-51283, 51285-51293, 51295-51296, 51299, 51301-51302, 51304-51309, 51314, 51318-51319, 51321-51323, 51326, 51328-51329, 51333-51338, 51341-51342, 51346-51347, 51349-51352, 51354-51356, 51363, 51365, 51374-51375, 51378-51379, 51381-51382, 51386-51387, 51389-51398, 51400-51409, 51411, 51413, 51416, 51420, 51423, 51427-51428, 51430, 51432, 51437-51439, 51441, 51444-51451, 51453-51454, 51456-51459, 51467-51472, 51475, 51478, 51480-51481, 51486, 51488, 51491, 51494-51496, 51498, 51500, 51508-51510, 51512, 51515, 51518, 51520-51522, 51528-51530, 51533-51535, 51537-51541, 51543-51551, 51555-51556, 51558-51559, 51562-51568, 51570, 51577, 51581, 51583, 51585-51586, 51588, 51590-51593, 51595-51598, 51601, 51603, 51605-51606, 51610-51612, 51616-51617, 51619-51620, 51624, 51628-51630, 51633, 51635-51637, 51639, 51641, 51644, 51646-51649, 51651-51657, 51659-51662, 51665-51669, 51672-51673, 51676-51678, 51680, 51684-51689, 51691, 51694, 51697, 51700-51701, 51703-51706, 51708-51709, 51711, 51713, 51715-51716, 51719, 51721-51725, 51730-51732, 51734, 51736, 51742-51745, 51747-51751, 51753-51754, 51757-51761, 51763, 51766-51770, 51772-51776, 51778-51796, 51798-51800, 51803, 51806-51807, 51809-51816, 51818-51819, 51821, 51823, 51825-51827, 51830, 51832-51834, 51836-51837, 51840-51847, 51849-51850, 51852, 51855, 51859-51862, 51864-51865, 51867-51874, 51879-51882, 51884-51887, 51889-51899, 51901-51907, 51910-51912, 51914-51929, 51932-51935, 51937-51938, 51941, 51943, 51945-51946, 51950, 51954-51959, 51961-51962, 51965, 51967, 51973-51974, 51976, 51979, 51981-51984, 51988, 51991, 51993-51994, 51998-51999, 52002, 52004, 52007-52009, 52011, 52015-52016, 52018-52019, 52021-52023, 52025, 52029, 52031-52032, 52034, 52036, 52038-52039, 52041-52042, 52045-52046, 52051-52052, 52055, 52057, 52060, 52063-52064, 52066-52070, 52076-52080, 52083-52097, 52099-52102, 52104-52106, 52109-52111, 52114-52115, 52117, 52121-52123, 52126-52128, 52134, 52137-52139, 52143, 52146-52154, 52156-52157, 52159, 52161, 52166-52170, 52172-52173, 52175-52182, 52184-52188, 52191, 52195-52200, 52202-52207, 52209-52216, 52218, 52221, 52226-52227, 52229, 52232-52234, 52238-52247, 52251, 52253-52257, 52259-52264, 52266-52267, 52269, 52272, 52276-52277, 52279, 52282-52285, 52287, 52289-52291, 52293-52294, 52296, 52299, 52301-52304, 52306-52308, 52310-52312, 52316-52317, 52319-52324, 52328, 52330-52331, 52334-52336, 52339-52341, 52343, 52348-52350, 52352-52353, 52357-52360, 52362-52364, 52366-52372, 52375-52377, 52379-52380, 52382, 52384, 52388-52391, 52396, 52399, 52407-52408, 52410-52414, 52416-52423, 52425, 52427, 52430-52434, 52437-52438, 52443-52447, 52451-52454, 52456, 52458, 52461-52463, 52465, 52467-52468, 52470, 52472-52482, 52489-52496, 52498-52500, 52502-52503, 52505-52506, 52508, 52511-52512, 52514-52520, 52522, 52524-52525, 52528-52530, 52532, 52535-52538, 52541-52542, 52544, 52549-52550, 52555-52557, 52559-52560, 52562-52564, 52566, 52570, 52573-52574, 52577-52582, 52584-52585, 52588, 52590, 52592-52593, 52595-52596, 52598, 52600-52601, 52604-52606, 52611-52613, 52615-52625, 52628, 52630, 52632, 52635, 52639-52640, 52644, 52646-52648, 52650-52653, 52656-52657, 52659-52660, 52662-52666, 52668, 52670, 52672-52676, 52678-52679, 52681-52683, 52685, 52687-52689, 52691-52694, 52697, 52699, 52701-52703, 52708, 52711-52712, 52714, 52716, 52722-52727, 52729-52735, 52739, 52741-52743, 52745-52746, 52748, 52750-52753, 52755, 52760-52764, 52767, 52770, 52772, 52776, 52779, 52781-52791, 52793-52794, 52796-52802, 52805, 52807-52809, 52814, 52817, 52820-52821, 52824, 52828-52830, 52832, 52838, 52840-52842, 52844, 52850, 52854, 52856-52859, 52861-52866, 52868, 52870-52871, 52878-52883, 52890, 52893, 52895, 52897-52903, 52910-52915, 52918, 52920, 52923-52925, 52930-52931, 52935, 52938-52948, 52950-52951, 52953-52955, 52958-52959, 52961, 52965, 52969, 52971-52972, 52974-52975, 52979-52980, 52983-52989, 52993-52994, 52996, 53000-53001, 53003-53006, 53009, 53011, 53017-53018, 53021, 53023, 53025-53027, 53030-53032, 53034, 53039-53041, 53044, 53046, 53049-53051, 53056, 53058, 53060, 53062-53067, 53069, 53072-53079, 53081, 53088-53090, 53094, 53097, 53102, 53104-53123, 53125-53127, 53129-53137, 53140, 53145-53146, 53152-53154, 53156, 53159, 53162-53165, 53170-53173, 53175, 53177, 53180-53182, 53184-53185, 53187, 53189, 53193-53200, 53202-53206, 53210-53212, 53214-53222, 53225-53226, 53228, 53230-53231, 53234-53236, 53238-53239, 53241, 53243-53247, 53249-53251, 53254, 53257-53260, 53262-53265, 53267, 53269-53271, 53275-53277, 53282-53283, 53285-53287, 53292-53294, 53296, 53300, 53302-53305, 53312-53320, 53324-53325, 53328-53329, 53332-53335, 53337, 53339, 53343-53345, 53347-53349, 53351-53352, 53354-53357, 53359, 53361-53363, 53372, 53374-53377, 53383-53387, 53389, 53391, 53393, 53396, 53399, 53401-53407, 53409, 53411, 53413-53418, 53420-53423, 53426, 53428, 53431-53432, 53436-53437, 53441, 53450-53451, 53455, 53458, 53460, 53464-53468, 53472-53475, 53477, 53481-53482, 53485-53486, 53491, 53494-53497, 53500-53502, 53504, 53508, 53511, 53517, 53520-53527, 53529-53531, 53534-53535, 53537, 53540, 53542, 53550-53551, 53553, 53557-53558, 53560-53565, 53569-53574, 53578-53579, 53585, 53587-53588, 53594-53597, 53603, 53605, 53614, 53616, 53619-53621, 53623-53626, 53629-53630, 53632, 53635-53647, 53649-53654, 53656-53673, 53675-53680, 53683-53690, 53692-53697, 53700-53701, 53706, 53708-53712, 53714-53715, 53717-53718, 53720-53722, 53724, 53729, 53731-53733, 53736, 53738-53739, 53741-53745, 53747, 53751, 53753-53754, 53756, 53763, 53767, 53771-53774, 53776, 53779-53780, 53782-53784, 53786-53790, 53800, 53805, 53812-53815, 53817-53820, 53822, 53824-53826, 53828-53830, 53832-53833, 53836, 53839-53840, 53842, 53844-53850, 53852-53853, 53855-53857, 53859-53861, 53863-53864, 53868-53872, 53875-53876, 53878, 53880, 53882-53885, 53889-53891, 53893-53895, 53897, 53900, 53903-53906, 53908, 53913-53914, 53916-53920, 53922, 53924-53929, 53934-53945, 53947-53950, 53952, 53955-53957, 53959-53960, 53962-53963, 53965, 53967, 53970-53971, 53973-53975, 53979-53980, 53982, 53984-53988, 53990-53991, 53993, 53995-53997, 54002, 54004-54005, 54007-54011, 54013-54014, 54016, 54020, 54022-54023, 54026-54027, 54030-54031, 54033-54034, 54036-54037, 54040-54041, 54043-54046, 54052-54053, 54055-54056, 54058, 54060, 54062, 54064-54067, 54074, 54076, 54079, 54082-54084, 54088-54090, 54095-54096, 54098-54099, 54102, 54105-54109, 54111-54119, 54121-54126, 54129, 54131-54132, 54134-54137, 54140-54141, 54144, 54148-54149, 54151, 54154-54155, 54160-54162, 54164, 54168-54169, 54171, 54173, 54175-54176, 54180-54182, 54188-54189, 54191-54193, 54195-54200, 54204-54208, 54210, 54212, 54214-54218, 54220-54222, 54224-54225, 54228-54230, 54232, 54234, 54236-54242, 54244-54249, 54252, 54254, 54256, 54259-54260, 54262-54265, 54267, 54273, 54275-54278, 54280-54281, 54283, 54285, 54287, 54289-54293, 54295-54296, 54298-54299, 54301, 54303, 54305, 54309-54313, 54315, 54317-54321, 54323-54325, 54327-54331, 54333, 54337-54338, 54341, 54343-54349, 54353, 54359, 54361-54362, 54364, 54366, 54368, 54371, 54373-54374, 54376, 54379, 54381, 54384-54386, 54388, 54392-54395, 54397-54402, 54405-54409, 54411-54415, 54417-54420, 54422-54423, 54427, 54431, 54433-54442, 54446, 54448-54449, 54451-54455, 54458, 54461, 54463-54464, 54466, 54468-54472, 54474-54475, 54477-54485, 54489-54493, 54495-54496, 54498, 54504, 54506-54510, 54512, 54514-54523, 54526-54530, 54532, 54534-54536, 54538, 54540, 54544-54548, 54554-54556, 54558-54559, 54561, 54563-54566, 54572, 54575-54576, 54581, 54585-54587, 54589-54592, 54595-54596, 54598-54601, 54603-54607, 54609-54611, 54613-54615, 54617-54622, 54624, 54626-54630, 54633-54637, 54642-54643, 54645-54649, 54651-54652, 54654, 54656-54662, 54664-54673, 54676-54678, 54681, 54683-54688, 54690, 54692-54694, 54698-54701, 54703-54712, 54714-54715, 54718-54719, 54721-54728, 54732-54736, 54738, 54741, 54745, 54747-54748, 54750-54751, 54753-54755, 54758-54760, 54762-54763, 54765-54766, 54770-54772, 54774-54785, 54787, 54796-54798, 54800, 54806, 54808-54809, 54811-54812, 54814, 54816, 54818, 54821, 54823-54824, 54828-54829, 54831, 54834-54836, 54838-54841, 54845, 54849, 54853-54856, 54858-54862, 54864-54865, 54868-54872, 54874-54875, 54877-54878, 54881, 54883-54885, 54887, 54889, 54891, 54893, 54897, 54899-54902, 54905-54912, 54914-54915, 54917, 54920-54921, 54925-54929, 54931-54932, 54936-54940, 54942, 54944, 54946-54948, 54950, 54953-54960, 54962-54969, 54972, 54974, 54976-54993, 54995-55001, 55003-55005, 55007-55008, 55010-55011, 55014, 55017, 55019, 55022-55025, 55027-55030, 55032-55034, 55037, 55039, 55045-55048, 55050-55053, 55057-55060, 55062-55064, 55067-55069, 55072, 55074-55075, 55077-55080, 55083-55084, 55086-55090, 55092-55094, 55096-55098, 55100-55102, 55105, 55107, 55111-55112, 55114, 55116-55121, 55123-55124, 55128, 55130-55134, 55136, 55138, 55140, 55142-55149, 55151-55152, 55156-55162, 55164, 55168-55174, 55176-55178, 55180-55182, 55186-55195, 55197-55202, 55204-55206, 55210-55211, 55213-55215, 55218-55223, 55225, 55228-55231, 55233-55236, 55238-55243, 55247, 55249-55253, 55256-55257, 55259-55266, 55269-55272, 55274-55276, 55280, 55283, 55286-55288, 55291, 55293-55296, 55299, 55301, 55303-55306, 55308-55312, 55316-55320, 55322-55327, 55329-55337, 55339, 55341, 55343-55348, 55350-55351, 55354-55367, 55369, 55371, 55373-55374, 55376, 55378, 55381-55388, 55390-55398, 55400-55402, 55404-55406, 55409, 55411-55412, 55415-55418, 55421, 55425, 55427-55429, 55431-55433, 55435-55436, 55438, 55447, 55450, 55458-55466, 55468-55469, 55473, 55476, 55478, 55480, 55482-55487, 55491-55492, 55494, 55497, 55499, 55502-55503, 55506-55507, 55510, 55513-55515, 55517, 55519-55520, 55522-55524, 55526, 55528, 55530-55533, 55537, 55541-55543, 55545-55546, 55548, 55551-55558, 55560-55566, 55570-55571, 55573-55575, 55578, 55580-55582, 55584-55587, 55590-55598, 55603-55605, 55610-55611, 55613-55617, 55619, 55621, 55623-55624, 55626-55628, 55631, 55633-55637, 55640-55641, 55643-55644, 55646, 55653-55655, 55658, 55660-55661, 55664-55667, 55669, 55671-55676, 55679-55685, 55687, 55691, 55693, 55696, 55699, 55702-55708, 55710-55719, 55721, 55727-55729, 55731-55732, 55737-55738, 55740-55741, 55745, 55747-55748, 55750-55751, 55753, 55757-55759, 55761, 55763, 55765-55769, 55773-55775, 55777-55778, 55780-55784, 55786-55795, 55798-55801, 55803, 55806-55809, 55811-55815, 55817, 55819-55828, 55830-55833, 55835-55840, 55843-55844, 55846-55848, 55852-55859, 55861-55868, 55870-55871, 55873, 55875-55877, 55879-55881, 55883, 55887, 55892-55893, 55895, 55898-55903, 55905, 55909-55915, 55922, 55924, 55926, 55934, 55939-55944, 55952, 55954-55956, 55958-55961, 55963-55964, 55967, 55970-55975, 55979-55986, 55988-55991, 55998, 56000-56002, 56007-56009, 56015, 56018, 56022-56026, 56028-56029, 56031-56036, 56038, 56040, 56042-56044, 56047, 56050-56053, 56055-56056, 56058-56059, 56061-56066, 56068, 56071, 56073-56078, 56080, 56084, 56089, 56091-56092, 56096-56097, 56104-56111, 56113, 56116, 56120, 56123-56124, 56126, 56128, 56130, 56132, 56136, 56138-56139, 56144-56148, 56150-56155, 56158, 56160-56164, 56167, 56170, 56176, 56178-56179, 56186-56187, 56189, 56192, 56195-56196, 56198-56199, 56201-56203, 56212, 56215-56218, 56220-56221, 56223-56227, 56232, 56234-56235, 56237, 56239, 56241, 56244, 56247-56250, 56253-56259, 56262, 56264-56268, 56270-56272, 56274-56275, 56277-56280, 56282-56284, 56286, 56288-56290, 56292-56296, 56298, 56306-56311, 56313-56314, 56321-56324, 56326-56327, 56329, 56332, 56334-56338, 56340-56341, 56343-56348, 56350, 56352-56356, 56358-56359, 56363-56366, 56372, 56380-56381, 56384, 56386-56393, 56395-56401, 56403, 56405-56406, 56413, 56415-56416, 56425-56426, 56428-56430, 56432, 56435-56438, 56440-56445, 56447-56449, 56451, 56457, 56459-56461, 56465-56469, 56471-56476, 56478, 56481-56482, 56484-56487, 56490-56495, 56500-56501, 56504-56513, 56515-56516, 56521, 56526-56528, 56530-56532, 56534, 56536-56544, 56548-56550, 56553-56555, 56557-56561, 56564-56568, 56570, 56572, 56574, 56576, 56578-56579, 56582, 56585-56588, 56590, 56592, 56594, 56597-56601, 56603-56606, 56608-56609, 56611-56613, 56616-56619, 56621, 56623-56627, 56629, 56631-56633, 56635, 56642, 56645, 56647, 56650, 56652-56654, 56657-56660, 56662, 56664-56671, 56673-56675, 56679, 56681-56688, 56691, 56693, 56696, 56698-56699, 56701-56704, 56707, 56710, 56712-56715, 56717-56718, 56720, 56722, 56727-56729, 56731-56732, 56734-56735, 56737-56741, 56743-56744, 56746-56755, 56757-56761, 56766-56768, 56773-56780, 56793, 56795-56799, 56805-56806, 56808, 56811, 56813-56814, 56820-56826, 56836, 56841-56847, 56849, 56851, 56853-56857, 56859-56861, 56864, 56866-56868, 56870-56871, 56874-56879, 56881, 56883-56890, 56892-56894, 56896, 56899, 56901, 56903-56904, 56906-56907, 56910-56914, 56917, 56920-56923, 56925-56926, 56929-56930, 56932-56933, 56935-56937, 56939-56940, 56942-56943, 56945-56946, 56951-56952, 56955-56959, 56961, 56963-56964, 56966, 56970, 56972-56973, 56975-56979, 56981-56982, 56984-56985, 56987-56992, 56994, 56997, 56999, 57001, 57004-57009, 57011-57013, 57015-57020, 57022, 57029-57032, 57034-57037, 57039-57040, 57043-57044, 57046-57049, 57051-57053, 57055-57056, 57058-57060, 57062-57069, 57071-57074, 57076-57078, 57080-57081, 57085-57086, 57090, 57093, 57095-57099, 57101-57108, 57110, 57112-57119, 57121-57122, 57124-57125, 57131, 57133-57137, 57140-57141, 57143-57145, 57147-57149, 57151-57158, 57160-57161, 57164-57168, 57172, 57177, 57180-57184, 57186-57187, 57190-57192, 57196-57197, 57200, 57202-57203, 57205-57206, 57210-57213, 57219, 57221, 57225, 57227, 57229-57236, 57238, 57240-57242, 57244-57246, 57248, 57251-57253, 57255-57256, 57258, 57260, 57263-57264, 57266-57267, 57269, 57271, 57273-57275, 57277, 57281-57282, 57284-57285, 57292-57296, 57298-57299, 57301-57305, 57309, 57312-57313, 57316-57324, 57326-57327, 57329-57334, 57338, 57340, 57342, 57344-57349, 57351-57353, 57358, 57366-57370, 57372-57376, 57378-57381, 57383, 57389-57392, 57394-57396, 57398-57406, 57409-57411, 57413-57414, 57418, 57423-57424, 57426-57433, 57435-57438, 57444, 57447-57449, 57454, 57456, 57458-57461, 57463, 57465, 57467-57469, 57471, 57474-57475, 57480, 57484-57489, 57495-57496, 57498-57499, 57503-57504, 57507-57509, 57514, 57518-57519, 57521, 57524-57527, 57529-57534, 57536, 57538, 57540, 57542-57545, 57550-57554, 57556-57559, 57562-57568, 57571-57578, 57580-57587, 57589, 57594-57595, 57597-57599, 57601, 57605, 57608, 57613, 57616, 57618-57619, 57621-57631, 57636, 57638-57641, 57643-57644, 57648-57649, 57651-57655, 57657, 57659-57661, 57663-57666, 57668-57671, 57673-57676, 57679-57683, 57685-57686, 57689-57694, 57697, 57699-57706, 57708, 57710, 57712, 57715-57720, 57722-57723, 57725, 57727-57731, 57739-57741, 57743-57747, 57749-57761, 57763, 57766-57769, 57771, 57773, 57775-57778, 57780-57781, 57783-57785, 57787-57790, 57792, 57795-57796, 57798-57802, 57805-57806, 57808, 57811, 57813, 57815-57817, 57819-57822, 57824-57826, 57828, 57833, 57835, 57840-57846, 57849, 57854-57855, 57860, 57862-57863, 57865-57866, 57870-57872, 57875, 57877, 57884-57885, 57887, 57891, 57894, 57898, 57901-57904, 57906-57909, 57911-57919, 57921-57922, 57926, 57929-57931, 57935, 57937, 57939, 57945-57946, 57948, 57951, 57953-57954, 57958, 57960, 57962-57968, 57970, 57972-57974, 57976-57978, 57980, 57982, 57987-57989, 57991-57994, 57996-58004, 58006, 58009-58011, 58013-58014, 58016-58017, 58019, 58025, 58029-58031, 58033-58035, 58037, 58039, 58043, 58046-58047, 58050, 58052, 58054, 58056-58057, 58060, 58062-58066, 58069, 58071, 58073, 58075, 58080-58084, 58086-58088, 58092-58093, 58096, 58098-58099, 58101-58102, 58106, 58108-58120, 58122-58124, 58126-58132, 58134-58135, 58137, 58140, 58142, 58145, 58149, 58151-58152, 58154, 58159, 58161-58162, 58165, 58167-58171, 58178-58179, 58182, 58188-58190, 58192-58193, 58195, 58197-58200, 58204-58205, 58207, 58209-58210, 58216-58218, 58220, 58223, 58225-58226, 58229-58231, 58239, 58242, 58244, 58246-58250, 58254, 58259-58266, 58270, 58272, 58274-58275, 58280, 58282-58283, 58285, 58288-58289, 58291, 58293-58295, 58297, 58299, 58301, 58303, 58305-58309, 58317-58319, 58321, 58324-58325, 58327, 58331, 58333-58334, 58340-58342, 58344, 58346-58352, 58355, 58357-58358, 58360, 58365, 58367, 58376-58377, 58379-58380, 58382, 58388, 58392, 58399-58402, 58404, 58406-58415, 58418-58419, 58422, 58427, 58430-58431, 58433, 58439-58440, 58442, 58444-58448, 58450-58453, 58455, 58457, 58459-58462, 58464-58467, 58469, 58471-58476, 58478-58480, 58484-58486, 58488, 58490, 58493-58498, 58500, 58503-58505, 58508, 58510, 58512-58514, 58519-58527, 58535-58536, 58539-58542, 58544-58548, 58550, 58553-58554, 58556-58557, 58561, 58563-58564, 58568-58569, 58571-58574, 58577-58596, 58599-58601, 58604, 58606-58613, 58615-58616, 58619, 58621-58627, 58629, 58632, 58634, 58637-58640, 58643, 58649, 58651, 58654-58659, 58662-58668, 58670-58674, 58676-58677, 58679-58685, 58689-58690, 58692, 58694-58700, 58705, 58708-58710, 58713, 58719-58720, 58722, 58724, 58727-58728, 58731-58733, 58736-58739, 58742-58746, 58748, 58750-58753, 58755-58757, 58759-58761, 58763-58764, 58767-58769, 58771, 58773-58776, 58778-58779, 58781, 58783, 58785-58788, 58793, 58797-58798, 58800, 58802-58804, 58807-58809, 58814-58815, 58817-58818, 58820, 58825, 58829, 58831-58832, 58835-58836, 58838, 58840, 58842-58846, 58849-58850, 58852-58853, 58857-58859, 58863, 58865-58866, 58869-58872, 58875-58877, 58879-58881, 58884, 58888-58889, 58892, 58894-58896, 58898-58899, 58902, 58904-58910, 58912-58917, 58923, 58926-58927, 58929-58933, 58935, 58937, 58939, 58941-58944, 58947, 58951, 58953, 58955, 58957, 58960-58969, 58971, 58973-58974, 58976, 58978, 58981-58989, 58998-58999, 59001, 59003, 59005-59006, 59008-59013, 59016, 59018-59019, 59025-59030, 59033, 59036-59038, 59041-59051, 59053-59054, 59056, 59058-59063, 59067, 59069, 59071-59072, 59074-59075, 59077-59081, 59083-59086, 59088, 59090-59092, 59094, 59096, 59098-59102, 59106, 59109-59110, 59113, 59115, 59117-59118, 59121, 59127, 59135, 59137, 59139, 59141-59142, 59144-59147, 59149, 59152-59153, 59157-59159, 59164, 59169-59171, 59173-59177, 59179, 59182, 59185-59186, 59188-59193, 59195, 59197-59203, 59206-59207, 59209-59219, 59221-59222, 59224, 59227, 59230-59233, 59238, 59241-59242, 59246-59247, 59249-59251, 59253-59254, 59259-59260, 59263-59264, 59277, 59285, 59287-59288, 59290-59292, 59295-59296, 59304-59306, 59312, 59318-59319, 59321-59325, 59327, 59329, 59331, 59335-59337, 59339, 59344, 59350-59351, 59355-59357, 59359-59362, 59365-59366, 59369, 59371-59377, 59385-59386, 59391-59395, 59399, 59402-59405, 59407-59408, 59410, 59416-59419, 59422-59424, 59426, 59428, 59432-59433, 59435-59438, 59443-59444, 59449, 59451-59452, 59454, 59458, 59460-59462, 59464-59466, 59468-59469, 59471-59472, 59474-59475, 59478-59480, 59482-59485, 59487, 59490-59492, 59494-59497, 59500-59512, 59515, 59518-59520, 59522-59528, 59532-59535, 59538, 59540, 59542-59556, 59558-59565, 59570-59573, 59577-59579, 59581, 59583-59584, 59586-59587, 59589, 59591-59592, 59594-59595, 59597-59598, 59600-59602, 59604-59607, 59609-59611, 59613, 59615, 59617-59618, 59620-59622, 59624, 59626-59630, 59632, 59634, 59636-59639, 59641, 59643-59644, 59646, 59648, 59651, 59654-59657, 59661, 59663-59667, 59670, 59673-59675, 59677-59684, 59687-59690, 59692-59697, 59699, 59701-59702, 59704-59705, 59707-59708, 59711-59715, 59717-59720, 59725-59726, 59729-59730, 59733-59737, 59740-59742, 59745-59746, 59748-59749, 59751-59754, 59758, 59760-59766, 59769-59770, 59772-59775, 59778-59780, 59783-59785, 59787-59788, 59792, 59797-59798, 59800, 59802-59812, 59814, 59816, 59818, 59821-59824, 59827-59831, 59834-59838, 59843, 59845, 59847-

59848, 59850-59854, 59856, 59858-59859, 59866, 59872-59873, 59875, 59877-59881, 59887, 59891-59895, 59900, 59904-59906, 59908-59914, 59917-59918, 59922-59926, 59929-59933, 59937-59938, 59941, 59945, 59947-59948, 59951-59953, 59957-59958, 59961, 59963-59965, 59968-59972, 59974, 59976-59977, 59979, 59981, 59983-59985, 59987-59990, 59993, 59995-59996, 59999, 60002, 60004, 60006-60009, 60013, 60016-60018, 60021-60022, 60024, 60026, 60029, 60031-60032, 60034, 60037, 60040-60041, 60043-60044, 60047, 60049-60050, 60052-60055, 60058-60059, 60061-60063, 60065, 60067, 60069-60071, 60073, 60075-60076, 60078-60079, 60081, 60087-60089, 60092, 60096-60098, 60100, 60102-60104, 60106-60115, 60118, 60120, 60123-60124, 60126-60127, 60129-60131, 60133-60137, 60140-60144, 60146-60151, 60153, 60157, 60162, 60166, 60168-60169, 60173-60174, 60176-60177, 60179, 60181-60190, 60197-60201, 60206, 60213-60217, 60219, 60222-60224, 60227, 60229-60230, 60233-60238, 60243-60244, 60246, 60248, 60252, 60254-60261, 60263, 60265-60267, 60269-60270, 60276-60288, 60291, 60296, 60301, 60305-60306, 60310, 60314-60318, 60320, 60322, 60328, 60331, 60335, 60337, 60339-60345, 60347-60352, 60354-60367, 60370, 60375-60377, 60379-60383, 60385-60387, 60389-60391, 60395, 60397-60401, 60412, 60414, 60416-60417, 60420-60422, 60424, 60426-60430, 60432, 60435-60439, 60442, 60445-60449, 60451, 60453, 60455-60456, 60460-60463, 60468-60470, 60474, 60476-60478, 60482-60485, 60487, 60489, 60493-60497, 60499-60503, 60505-60506, 60508, 60510-60511, 60514-60515, 60520-60521, 60524, 60529-60533, 60535-60536, 60540-60544, 60548-60549, 60552-60554, 60556-60558, 60560-60561, 60563, 60566, 60569, 60572, 60579, 60582, 60589-60593, 60595-60602, 60604-60613, 60615, 60617-60621, 60623, 60625-60626, 60628-60629, 60633, 60636, 60638-60645, 60651, 60653, 60655-60656, 60658-60659, 60661-60664, 60666-60668, 60670, 60672-60680, 60683-60684, 60686-60693, 60695, 60699, 60701, 60703, 60705-60706, 60709-60710, 60712-60713, 60715, 60717, 60719, 60721-60722, 60724-60731, 60733-60735, 60738-60739, 60741, 60743-60746, 60750-60751, 60755-60756, 60758-60763, 60765, 60773-60777, 60779, 60781-60782, 60786-60796, 60799, 60801, 60803, 60805, 60807-60809, 60811-60819, 60821, 60826-60828, 60831-60832, 60835-60836, 60840-60844, 60846, 60848-60850, 60853, 60855-60857, 60861-60864, 60868-60876, 60878-60879, 60881, 60883-60886, 60888, 60892-60894, 60896-60898, 60902-60906, 60908-60910, 60912, 60914, 60916-60917, 60921-60924, 60926-60927, 60930-60934, 60936-60938, 60940-60941, 60943-60944, 60946-60950, 60952-60953, 60955-60957, 60959-60967, 60972, 60976, 60978-60979, 60981-60982, 60984, 60986-60987, 60991-60995, 60998-61002, 61004-61008, 61010-61012, 61015, 61018-61019, 61022-61024, 61026-61043, 61047-61049, 61051-61055, 61057-61058, 61060, 61062-61066, 61068-61075, 61077, 61080-61082, 61084, 61088, 61090-61095, 61097, 61099-61104, 61112, 61114-61116, 61118-61126, 61129, 61131-61139, 61142-61143, 61145-61149, 61154, 61157-61159, 61161, 61163-61166, 61168, 61173-61176, 61178, 61182, 61186, 61188-61191, 61196-61198, 61200, 61203-61211, 61213-61214, 61216-61218, 61220-61222, 61224, 61226-61228, 61231, 61234-61238, 61240, 61244-61249, 61251, 61253-61254, 61256-61259, 61262-61263, 61265, 61270, 61272-61276, 61280, 61284-61285, 61287-61292, 61294, 61296-61298, 61300, 61302-61309, 61312, 61314-61315, 61323, 61326-61329, 61331-61332, 61334-61337, 61341, 61343, 61345, 61348-61349, 61351-61353, 61355, 61358, 61360-61361, 61364, 61366, 61369-61371, 61373-61375, 61377-61378, 61382-61384, 61386-61390, 61392-61393, 61395, 61399-61400, 61402, 61404-61405, 61408-61409, 61411, 61413, 61415-61420, 61424, 61426, 61430, 61432, 61436-61443, 61445, 61450, 61458-61460, 61462, 61469, 61472-61474, 61476-61477, 61479, 61485-61490, 61496, 61500-61506, 61509-61512, 61514, 61516-61518, 61521-61522, 61526-61528, 61530-61532, 61534-61535, 61537-61540, 61542-61549, 61551-61552, 61555, 61557, 61559-61561, 61563-61564, 61573-61580, 61582, 61584-61592, 61594, 61599, 61605-61607, 61609-61622, 61624-61627, 61631, 61633, 61637, 61640, 61642, 61648-61649, 61653-61659, 61663, 61666-61669, 61671, 61673-61682, 61685-61688, 61690-61694, 61696-61717, 61719-61747, 61749-61751, 61754-61756, 61759, 61761-61763, 61765, 61770-61775, 61777-61780, 61785-61789, 61791, 61793, 61797-61798, 61800, 61803, 61805, 61811-61815, 61817-61819, 61823-61824, 61827-61829, 61836, 61840-61847, 61850, 61853, 61855, 61857-61866, 61869-61874, 61876, 61879-61888, 61890, 61892, 61898, 61903-61906, 61909, 61912, 61914, 61917-61921, 61924-61927, 61929-61932, 61934-61936, 61940-61941, 61945, 61947-61954, 61956-61967, 61969-61971, 61974-61977, 61979-61980, 61985, 61989-61990, 61993-61999, 62003-62006, 62008, 62010-62015, 62017-62018, 62022-62023, 62028-62029, 62031-62034, 62036-62038, 62041, 62043-62045, 62053-62054, 62056, 62058-62060, 62062-62073, 62075, 62077-62081, 62084, 62086-62091, 62093, 62095-62101, 62103-62111, 62113, 62115-62123, 62126-62127, 62132-62134, 62136, 62139-62140, 62142-62146, 62149-62152, 62154-62160, 62162-62166, 62168, 62170, 62172-62178, 62180-62181, 62186-62187, 62189, 62191, 62193, 62201-62209, 62211-62215, 62218-62220, 62222-62230, 62236, 62238-62242, 62244-62251, 62255, 62257, 62259, 62263-62264, 62266-62271, 62273-62275, 62277-62279, 62281, 62284-62289, 62291-62293, 62295-62298, 62300-62302, 62306-62307, 62309-62310, 62312-62313, 62315-62317, 62319-62324, 62327, 62329-62331, 62333, 62335, 62338, 62342-62345, 62351, 62353-62356, 62359, 62361-62365, 62369-62371, 62373-62374, 62376-62385, 62388, 62390, 62393, 62395-62397, 62399, 62401-62402, 62405, 62407-62408, 62415, 62423-62424, 62426-62437, 62439, 62443, 62447, 62451, 62453-62454, 62456-62457, 62460, 62462-62465, 62467-62468, 62471-62474, 62478, 62480, 62483-62484, 62489-62492, 62494, 62496-62498, 62501, 62504-62505, 62508-62509, 62511-62512, 62514, 62516, 62518-62519, 62522-62526, 62529-62534, 62536-62540, 62542, 62546-62547, 62549, 62553-62555, 62557-62561, 62563-62567, 62570, 62574, 62576-62584, 62586-62593, 62595, 62598-62607, 62609-62610, 62612-62621, 62623, 62627-62628, 62630, 62632, 62635-62636, 62638, 62640, 62643, 62645, 62647-62649, 62651-62654, 62656-62657, 62659, 62661, 62663-62667, 62670-62672, 62674-62677, 62679-62680, 62684-62689, 62696, 62698-62699, 62702-62708, 62710, 62714-62717, 62724, 62730-62734, 62736, 62745-62747, 62749, 62752-62753, 62755, 62757-62762, 62765-62770, 62773-62779, 62784-62785, 62787-62788, 62790-62792, 62795, 62797, 62800, 62803, 62806-62813, 62815, 62817, 62819, 62821, 62823, 62826-62831, 62839, 62848-62850, 62852-62853, 62855, 62857-62864, 62867-62868, 62870, 62872-62875, 62880, 62882, 62885-62886, 62888, 62890, 62894-62896, 62898-62902, 62904, 62907, 62909, 62911, 62917-62921, 62924-62925, 62927-62931, 62933-62936, 62938, 62941-62942, 62945-62946, 62949, 62951, 62953-62962, 62965, 62967, 62970, 62975-62976, 62979, 62981, 62984-62991, 62994, 62996-62997, 63002-63006, 63008-63013, 63016-63017, 63019, 63021-63026, 63028-63029, 63031, 63035-63039, 63043-63047, 63049-63051, 63053-63058, 63063-63064, 63066, 63073, 63075-63082, 63084-63087, 63089-63091, 63093, 63095, 63098, 63101-63108, 63110, 63112-63115, 63119, 63122, 63124, 63126-63129, 63131, 63133, 63136-63140, 63143, 63145-63149, 63151-63152, 63154, 63156, 63158-63159, 63161, 63163-63165, 63169-63172, 63174, 63176-63177, 63180-63181, 63185-63187, 63190-63192, 63195, 63198, 63200-63201, 63204-63208, 63213-63216, 63221, 63225-63227, 63229, 63231, 63236-63237, 63239-63240, 63242-63243, 63245, 63248, 63251-63254, 63258-63259, 63263-63267, 63269, 63273, 63275, 63277, 63280-63283, 63293, 63295-63299, 63301, 63303, 63311-63313, 63316-63317, 63319, 63327, 63329, 63333-63334, 63336, 63338, 63341-63346, 63351-63355, 63357-63358, 63360, 63363-63365, 63367, 63370-63372, 63375-63376, 63378, 63380-63381, 63383-63384, 63386, 63388, 63390-63397, 63400-63402, 63404-63406, 63408, 63410-63413, 63415-63416, 63420-63421, 63423-63424, 63428-63429, 63431, 63434-63443, 63446-63447, 63450-63451, 63458, 63461-63462, 63465-63471, 63473-63474, 63476, 63479-63487, 63489, 63491-63493, 63495, 63498-63503, 63505-63507, 63510-63512, 63514-63515, 63517, 63520-63522, 63525, 63528, 63532, 63538-63544, 63547, 63549-63550, 63553-63555, 63557, 63559-63561, 63563, 63565, 63569-63575, 63577-63578, 63580, 63583-63584, 63586, 63589-63590, 63594, 63597, 63600, 63602-63607, 63611-63612, 63614-63615, 63617-63618, 63620, 63622-63625, 63627-63628, 63631-63634, 63636, 63639-63640, 63642-63647, 63649, 63652-63654, 63660, 63666-63667, 63669-63674, 63679-63681, 63683-63689, 63691, 63693-63696, 63699-63704, 63706-63709, 63711-63716, 63719, 63721-63726, 63729-63731, 63734, 63736-63738, 63742-63743, 63745-63749, 63752, 63754, 63758, 63760-63762, 63765, 63769, 63771, 63776, 63779-63781, 63783-63784, 63790-63791, 63793-63798, 63801, 63803-63808, 63810, 63813, 63816-63817, 63819-63820, 63822-63823, 63825, 63827-63829, 63831-63832, 63834-63837, 63840-63842, 63844, 63855, 63858-63865, 63869-63873, 63876-63880, 63882-63884, 63887-63888, 63890-63891, 63894-63895, 63898, 63900-63906, 63908, 63918-63919, 63921-63927, 63930-63935, 63938-63941, 63947-63950, 63953-63955, 63957, 63960-63964, 63967-63971, 63973, 63975, 63977, 63981-63987, 63995, 64000, 64002-64003, 64005, 64008, 64010, 64017, 64019, 64021-64029, 64032-64033, 64035, 64037-64038, 64040, 64042-64048, 64052-64054, 64057-64061, 64065-64068, 64070, 64072-64075, 64080-64083, 64085-64086, 64088-64089, 64092, 64094, 64096-64099, 64101-64103, 64111, 64113, 64115, 64117, 64120-64121, 64123-64126, 64129, 64133, 64136-64138, 64140-64145, 64147-64150, 64152, 64154, 64157-64159, 64162, 64164-64171, 64173-64176, 64178-64181, 64186-64187, 64189-64190, 64193-64198, 64202, 64205-64209, 64211, 64217-64219, 64222-64223, 64225, 64227-64231, 64235, 64237-64241, 64243-64249, 64252-64255, 64260, 64262, 64264-64273, 64278-64281, 64284-64288, 64290, 64293, 64295-64297, 64299-64302, 64304-64305, 64307-64310, 64312-64314, 64318, 64321, 64328-64329, 64331-64332, 64337-64339, 64341-64342, 64344, 64346, 64348, 64350, 64352, 64355, 64358, 64361-64362, 64364, 64366, 64369-64371, 64374, 64376, 64379-64380, 64382-64384, 64386-64387, 64389-64390, 64392, 64394-64396, 64399-64400, 64404-64406, 64409-64411, 64414-64418, 64423-64425, 64427, 64431, 64434-64436, 64438, 64441-64442, 64444, 64446-64448, 64450-64453, 64455-64459, 64462-64463, 64465, 64471-64478, 64483-64484, 64486-64488, 64491-64492, 64494-64497, 64499-64502, 64505, 64507, 64510, 64512, 64516-64519, 64521-64525, 64527, 64535-64539, 64543, 64548-64551, 64555-64558, 64561-64562, 64565, 64570, 64572-64573, 64579, 64581-64583, 64587-64588, 64590, 64594, 64596-64597, 64599, 64602-64604, 64606, 64608, 64611, 64614-64616, 64618, 64624-64628, 64631-64632, 64634-64639, 64645-64653, 64655-64656, 64658-64659, 64661-64662, 64664, 64667, 64669, 64671-64675, 64677-64680, 64683-64684, 64686, 64688-64690, 64693, 64695-64696, 64698, 64701-64702, 64704-64705, 64708, 64717, 64719, 64722-64725, 64727-64728, 64737-64738, 64740-64744, 64749, 64751, 64754-64755, 64757, 64760-64762, 64766, 64768-64774, 64778-64779, 64781-64782, 64786, 64788, 64790-64791, 64794, 64796, 64802, 64807-64809, 64814-64815, 64817, 64819-64823, 64825-64836, 64838, 64840-64844, 64851-64853, 64857-64860, 64862, 64865, 64869, 64871-64873, 64875, 64881-64883, 64885-64886, 64888-64890, 64892-64893, 64895-64898, 64900-64908, 64911-64913, 64916-64919, 64922-64923, 64925-64927, 64929, 64931-64932, 64935-64936, 64938-64939, 64942, 64944-64947, 64949, 64951, 64954-64955, 64960, 64962-64965, 64969-64970, 64972-64973, 64975, 64978, 64983-64984, 64988-64990, 64993, 64997, 64999, 65001, 65004-65005, 65008, 65010, 65013, 65015-65016, 65019, 65021-65024, 65026-65029, 65031-65033, 65035-65037, 65039, 65042-65045, 65048, 65050, 65055-65060, 65062, 65064-65070, 65072-65076, 65078-65080, 65082-65083, 65085-65090, 65092, 65097, 65099, 65101-65102, 65104-65105, 65107-65112, 65115, 65118, 65120, 65122, 65124, 65127, 65133, 65136-65137, 65140, 65144, 65146-65147, 65149-65152, 65155-65157, 65159, 65161-65165, 65167, 65170, 65173, 65175, 65177-65180, 65182-65185, 65187-65195, 65198-65206, 65208-65209, 65211-65214, 65217-65218, 65221-65222, 65225, 65234, 65241-65244, 65246, 65249-65250, 65252-65253, 65255-65256, 65259, 65267, 65269-65271, 65274, 65277-65279, 65282-65283, 65289-65292, 65298-65299, 65301-65312, 65314-65316, 65321, 65323, 65325, 65327, 65331, 65333, 65335, 65337-65343, 65346-65347, 65350-65351, 65353-65354, 65356-65357, 65366, 65368, 65370, 65375, 65377, 65382-65383, 65386, 65391-65398, 65400, 65402-65404, 65406, 65408-65410, 65412, 65414-65420, 65431-65435, 65437, 65440, 65443-65445, 65451-65456, 65460, 65462-65464, 65466, 65469-65470, 65472, 65474, 65476, 65478-65480, 65483-65489, 65491-65492, 65494-65495, 65498, 65501-65509, 65511-65512, 65514, 65516, 65518, 65520-65521, 65523, 65525-65526, 65530, 65532-65533, 65540, 65543-65546, 65548, 65554-65557, 65559, 65562-65567, 65570-65571, 65577-65579, 65581-65583, 65585-65587, 65590-65598, 65600-65602, 65605-65606, 65608, 65610, 65614, 65617-65618, 65622-65624, 65627-65629, 65632-65634, 65637-65638, 65640, 65643-65645, 65649, 65652, 65654, 65656-65657, 65659-65665, 65667-65668, 65671, 65675, 65682-65686, 65690, 65692-65693, 65696, 65700-65702, 65704, 65706-65707, 65709, 65711-65712, 65714-65715, 65720-65723, 65728-65730, 65732, 65734, 65736, 65738, 65740-65743, 65745, 65748-65750, 65752-65753, 65756-65757, 65760, 65767, 65769-65776, 65778, 65781, 65783-65787, 65790, 65794-65795, 65797, 65799-65802, 65804-65805, 65807-65809, 65811-65812, 65815, 65820, 65831-65832, 65834, 65836, 65838-65848, 65850-65853, 65855-65860, 65862-65870, 65872-65875, 65877-65879, 65881-65882, 65884, 65891-65892, 65899-65900, 65902-65904, 65906-65907, 65911-65912, 65914, 65916-65918, 65920-65922, 65924, 65926, 65928, 65934-65937, 65939-65943, 65945-65946, 65949-65950, 65952, 65955, 65957, 65964-65967, 65969-65975, 65977, 65980, 65982, 65984, 65988-65998, 66000-66006, 66010-66013, 66016, 66019-66021, 66030-66043, 66045, 66047-66054, 66056, 66059, 66061-66062, 66070, 66072-66076, 66078-66081, 66084, 66086-66088, 66090-66096, 66098-66099, 66101-66103, 66105, 66107, 66109, 66112, 66114, 66118-66119, 66121, 66125-66126, 66130-66131, 66134, 66136, 66138-66139, 66143-66146, 66148, 66150-66152, 66156-66160, 66163-66168, 66170-66174, 66177, 66179-66184, 66186-66188, 66190-66192, 66195-66196, 66201-66208, 66210-66212, 66215, 66219-66220, 66223-66225, 66229, 66232, 66234, 66236, 66238, 66240-66244, 66246-66247, 66249-66252, 66257-66264, 66267, 66271, 66275, 66277, 66284, 66290, 66292-66295, 66297-66300, 66302-66304, 66307-66320, 66322-66323, 66325-66327, 66329-66331, 66337-66343, 66346, 66349, 66351-66354, 66357-66359, 66361, 66365-66367, 66369-66376, 66378-66379, 66381-66392, 66395, 66400-66403, 66405, 66407-66415, 66417-66421, 66425-66426, 66428-66429, 66431-66440, 66444, 66447-66450, 66452-66461, 66463, 66468, 66471-66473, 66475-66479, 66481-66490, 66492-66494, 66496, 66498-66499, 66502-66504, 66506, 66508-66512, 66515-66524, 66526-66527, 66529, 66531, 66533-66536, 66539, 66543, 66546, 66549-66550, 66552-66555, 66557, 66559-66562, 66564, 66568-66571, 66573-66574, 66576, 66578-66579, 66584, 66586, 66588, 66590, 66593-66597, 66605, 66607-66608, 66610-66611, 66613, 66616, 66618, 66620, 66624, 66628-66631, 66637-66638, 66645-66647, 66650, 66652-66654, 66656-66657, 66659, 66661-66665, 66674-66680, 66682-66684, 66686-66689, 66691-66692, 66695, 66698, 66700, 66702, 66704-66705, 66709, 66711-66713, 66715, 66720-66721, 66723-66724, 66728-66729, 66732, 66735, 66740, 66742-66746, 66748, 66750-66751, 66754, 66756-66759, 66761-66765, 66768, 66770-66771, 66774, 66777, 66781-66782, 66786-66787, 66791, 66796-66801, 66807-66811, 66813, 66816-66817, 66819, 66822, 66828-66834, 66841, 66843, 66846, 66848, 66851-66853, 66855-66859, 66861, 66863, 66865-66868, 66872, 66877-66879, 66882-66883, 66885, 66891-66895, 66899-66904, 66906-66916, 66918-66920, 66923-66925, 66927-66929, 66931-66932, 66934-66935, 66937, 66940, 66943, 66945-66946, 66948-66952, 66955-66957, 66959-66965, 66967, 66969, 66972-66974, 66977, 66982-66986, 66989-66990, 66999, 67003, 67005-67008, 67010-67020, 67023-67026, 67028, 67030-67035, 67037-67043, 67045-67054, 67056, 67058, 67061, 67063, 67066-67068, 67070-67072, 67074-67076, 67078, 67085-67086, 67088-67091, 67095, 67099-67103, 67105, 67108-67109, 67118-67120, 67124, 67126-67136, 67140, 67142, 67144-67145, 67147-67162, 67164, 67167, 67169-67171, 67173, 67175-67178, 67180-67181, 67184-67189, 67191-67192, 67197-67199, 67202, 67204-67206, 67208, 67210-67212, 67217-67218, 67220-67221, 67226, 67228, 67231, 67233-67234, 67236, 67239, 67242-67243, 67245, 67248-67250, 67253-67255, 67258, 67264-67265, 67267, 67272-67274, 67276-67277, 67280-67287, 67289-67291, 67293, 67295-67301, 67304, 67307, 67309-67311, 67313, 67317, 67319, 67326, 67328-67329, 67336, 67339-67340, 67343, 67345, 67347-67348, 67350, 67356, 67360-67362, 67364-67367, 67380, 67384, 67389, 67396-67401, 67406-67407, 67412-67413, 67416, 67418-67419, 67421, 67425-67427, 67437-67438, 67440-67442, 67444-67445, 67447, 67449-67450, 67453-67455, 67458-67460, 67463-67464, 67468, 67470-67472, 67474-67478, 67480, 67483-67484, 67487, 67489-67491, 67493, 67496, 67502-67509, 67512-67514, 67517-67518, 67520-67521, 67523-67527, 67531-67532, 67535, 67537, 67542, 67544, 67551, 67557-67561, 67563-67566, 67568-67570, 67575-67576, 67578-67581, 67584, 67588, 67591, 67593, 67596-67597, 67602-67603, 67605-67609, 67611, 67617-67619, 67621-67623, 67627-67628, 67631-67633, 67636-67642, 67644-67646, 67648-67650, 67652-67653, 67656-67661, 67664, 67668-67675, 67689, 67691-67692, 67694-67702, 67704, 67708, 67710-67711, 67713-67716, 67718-67720, 67723, 67725, 67731-67732, 67734, 67736-67737, 67740-67742, 67744, 67746-67748, 67752, 67754, 67756-67758, 67761-67765, 67767-67770, 67773, 67775, 67777-67778, 67780, 67784, 67789-67790, 67794-67797, 67800, 67802-67805, 67807-67817, 67822-67824, 67827, 67829-67831, 67834, 67836-67837, 67839-67840, 67842-67844, 67847, 67850, 67853-67854, 67857-67858, 67860-67864, 67866-67875, 67877, 67882-67884, 67887, 67889, 67891-67893, 67896, 67898-67902, 67904, 67907-67917, 67920, 67922-67923, 67925-67927, 67934-67935, 67937-67948, 67950-67953, 67955-67958, 67960-67973, 67975, 67978-67981, 67983-67987, 67991-68000, 68002-68006, 68008-68016, 68019, 68024, 68027-68029, 68031-68034, 68036-68049, 68053, 68055, 68057, 68059-68061, 68063-68065, 68069-68070, 68073, 68076, 68085, 68087, 68089-68090, 68092-68093, 68096, 68099-68101, 68103, 68105-68110, 68113, 68115-68118, 68120-68121, 68125-68127, 68130, 68132-68133, 68136-68139, 68141-68146, 68151, 68153-68158, 68161, 68164, 68166-68168, 68171-68172, 68175-68176, 68178, 68180-68181, 68186-68187, 68189-68192, 68194-68197, 68199-68202, 68204-68206, 68209-68210, 68214, 68217-68219, 68221-68222, 68224, 68227-68230, 68233-68234, 68236-68239, 68241-68246, 68249, 68252-68253, 68255-68259, 68263-68264, 68266-68267, 68270-68279, 68281, 68283, 68285-68289, 68295-68296, 68300, 68303-68306, 68311-68312, 68314-68319, 68323, 68325, 68331, 68333-68338, 68340, 68346, 68348-68359, 68361-68365, 68367, 68369, 68372-68375, 68377-68379, 68381, 68384-68395, 68397-68400, 68403-68413, 68415, 68417, 68420-68423, 68425, 68427-68433, 68435-68444, 68446-68449, 68453-68458, 68462-68463, 68465, 68469-68470, 68472, 68475, 68477, 68479-68480, 68482, 68487, 68491, 68493-68497, 68499-68500, 68502-68503, 68505-68507, 68509-68512, 68517, 68519, 68521-68522, 68525, 68540, 68542-68546, 68548-68555, 68557, 68559-68560, 68563, 68566, 68568, 68571, 68573-68574, 68577, 68579-68582, 68584-68587, 68590-68592, 68595, 68598, 68601-68605, 68609, 68611-68615, 68617-68618, 68623-68625, 68627-68634, 68636, 68638-68643, 68645-68651, 68653-68655, 68658, 68660-68665, 68667-68669, 68671-68673, 68676-68677, 68685, 68687-68694, 68697, 68699-68700, 68703, 68706-68711, 68713-68715, 68717-68721, 68723-68727, 68730-68731, 68734-68736, 68739-68741, 68744, 68748, 68750, 68752, 68754, 68756, 68759, 68761, 68764-68765, 68768, 68770-68771, 68773-68776, 68783-68786, 68788, 68790, 68792-68794, 68796, 68798-68802, 68805, 68808-68811, 68816, 68818, 68824, 68826-68827, 68831-68835, 68837-68839, 68841, 68843, 68847, 68849, 68851, 68855-68860, 68866-68868, 68871, 68873, 68877, 68879-68883, 68887-68888, 68892-68897, 68899-68905, 68907-68908, 68910-68912, 68914, 68916, 68920, 68922-68923, 68927-68929, 68931-68933, 68935-68936, 68938-68939, 68943-68945, 68947-68953, 68957, 68962, 68964, 68967, 68969-68974, 68977, 68979, 68982, 68985, 68988, 68991, 68993-68994, 68997, 68999-69000, 69002-69005, 69007, 69010-69013, 69015-69016, 69018-69019, 69021-69022, 69025-69026, 69028-69031, 69033-69034, 69036, 69038, 69040, 69043, 69045-69050, 69053-69054, 69056-69057, 69060-69061, 69063-69068, 69070, 69072-69080, 69082, 69086, 69090-69091, 69095-69096, 69098-69100, 69102-69107, 69113, 69115, 69120, 69122, 69126-69127, 69131-69138, 69140-69141, 69143, 69146, 69148-69149, 69156-69161, 69163, 69165-69166, 69172, 69174-69175, 69177, 69181-69184, 69186-69188, 69190, 69193, 69197, 69200-69202, 69210-69212, 69215-69218, 69221-69223, 69225, 69227-69228, 69234-69236, 69238-69244, 69247-69249, 69251-69254, 69256, 69258-69262, 69264-69266, 69270-69273, 69277-

69278, 69282, 69288-69289, 69291, 69294, 69297-69299, 69303-69306, 69309, 69311-69312, 69314-69317, 69320, 69323-69325, 69328, 69332, 69334, 69337-69339, 69345-69349, 69351-69353, 69355, 69358-69363, 69365-69366, 69368, 69370-69371, 69373-69374, 69378, 69380, 69382-69383, 69385-69386, 69389-69403, 69405, 69407-69408, 69410, 69414, 69416-69417, 69419, 69421, 69427-69435, 69437-69441, 69443, 69445-69447, 69450-69452, 69454, 69456-69460, 69464, 69466, 69471, 69474, 69479-69480, 69482-69484, 69490, 69493, 69496-69505, 69508, 69510, 69512-69514, 69520-69521, 69523, 69525, 69528-69532, 69534, 69537-69538, 69540-69541, 69547-69550, 69552, 69554-69560, 69563, 69567, 69570-69573, 69575, 69578, 69580, 69582-69586, 69588-69592, 69595, 69597-69601, 69603-69607, 69609-69614, 69617-69624, 69626-69634, 69641-69644, 69647, 69649-69652, 69654, 69656, 69658-69659, 69661-69662, 69665-69672, 69674, 69679, 69683, 69686, 69689-69690, 69692-69694, 69696-69699, 69702-69705, 69708-69710, 69712-69714, 69719-69723, 69725, 69728, 69730, 69732, 69735, 69738, 69740, 69743-69744, 69746, 69751-69752, 69754-69757, 69759-69762, 69764, 69767, 69769, 69775-69778, 69785, 69789, 69791-69799, 69801, 69803, 69809, 69812-69814, 69816-69817, 69819, 69821-69823, 69825-69828, 69830, 69832, 69834, 69837-69839, 69841-69845, 69847-69850, 69852-69860, 69862, 69866-69867, 69869-69870, 69875, 69879, 69883, 69887, 69889, 69891, 69893-69904, 69906-69911, 69916, 69919, 69921-69925, 69929-69930, 69932-69941, 69943-69949, 69954, 69960, 69963, 69965-69974, 69976, 69978, 69980-69981, 69983, 69986, 69988-69990, 69995-69996, 70001, 70003-70004, 70008-70014, 70017, 70019-70020, 70024-70025, 70027, 70029, 70032-70033, 70035, 70039-70041, 70044-70048, 70051-70056, 70058-70062, 70064-70069, 70072, 70075, 70077-70079, 70082, 70084-70086, 70088, 70090-70091, 70098-70099, 70102-70103, 70107, 70110-70111, 70118-70119, 70122-70128, 70132-70133, 70135, 70138, 70142-70145, 70147-70149, 70151-70154, 70156-70165, 70169, 70172, 70174, 70176-70178, 70180, 70182, 70185, 70187, 70190, 70192-70196, 70200, 70203-70204, 70207, 70209-70210, 70213, 70215-70220, 70222, 70225, 70227, 70231, 70233, 70236, 70238-70240, 70244, 70247-70249, 70251-70257, 70259-70263, 70267-70271, 70277-70279, 70282, 70284, 70288, 70291, 70294-70295, 70297-70298, 70307, 70310, 70314, 70317-70318, 70320, 70322-70323, 70325-70326, 70328-70331, 70334-70337, 70339, 70342-70343, 70345, 70352-70354, 70356-70357, 70359-70362, 70364-70368, 70370-70371, 70374-70382, 70385-70388, 70392-70395, 70397-70398, 70400, 70402, 70404-70419, 70422-70426, 70428, 70430, 70432-70438, 70440-70446, 70449-70461, 70463, 70466, 70470, 70472-70473, 70475-70476, 70478-70479, 70483-70484, 70487, 70489, 70493-70494, 70497-70498, 70500-70501, 70503-70504, 70506, 70508, 70510, 70512, 70516, 70518, 70521-70523, 70525-70528, 70531, 70536-70539, 70541-70542, 70544-70545, 70547-70548, 70550, 70552-70553, 70555-70557, 70559-70560, 70562-70571, 70573-70574, 70576-70582, 70584, 70586-70590, 70592-70593, 70595, 70597, 70599-70601, 70605, 70608, 70610-70614, 70616-70617, 70619-70620, 70622-70623, 70625, 70628-70629, 70632-70636, 70639, 70641-70642, 70646, 70648, 70650-70652, 70654-70655, 70657, 70661, 70664, 70666, 70669-70671, 70674, 70679-70685, 70687, 70693-70694, 70696, 70698-70699, 70703, 70705-70706, 70708, 70712-70716, 70719, 70724-70727, 70733, 70735-70743, 70746, 70749-70750, 70762-70763, 70768-70770, 70772, 70775-70776, 70778-70779, 70782, 70784, 70786, 70788-70790, 70792-70793, 70795, 70797-70798, 70801, 70807, 70809-70810, 70812-70820, 70823-70825, 70830-70831, 70833-70834, 70841-70842, 70844-70846, 70852-70855, 70859, 70861, 70870-70871, 70875-70876, 70879-70882, 70884, 70886, 70888, 70893, 70896-70899, 70901-70902, 70904, 70906, 70909, 70911, 70913-70914, 70922-70923, 70925, 70928, 70932, 70936-70942, 70944-70946, 70950, 70952, 70954, 70956, 70965-70968, 70974, 70976, 70979, 70982-70983, 70987, 70989-70990, 71001, 71003, 71006, 71012-71013, 71015-71017, 71020-71021, 71023-71032, 71034-71035, 71037-71044, 71046-71051, 71055, 71058, 71060-71065, 71070, 71076, 71079, 71081-71082, 71084, 71086-71088, 71090, 71094-71095, 71098, 71100-71101, 71103, 71108-71110, 71112-71113, 71116-71117, 71122-71126, 71129, 71131, 71133-71134, 71137-71140, 71143-71144, 71146, 71148-71149, 71151-71152, 71154-71156, 71158-71164, 71169, 71176-71178, 71181-71182, 71184-71187, 71189-71194, 71200, 71202-71203, 71207-71211, 71214, 71217-71218, 71221-71225, 71227, 71230-71231, 71233, 71235-71240, 71244-71246, 71250, 71253-71254, 71257, 71260, 71262, 71266-71267, 71272-71273, 71276, 71278-71281, 71285, 71287-71289, 71291-71293, 71300-71301, 71303, 71305-71306, 71309, 71315-71318, 71322, 71325-71332, 71334-71341, 71349-71353, 71355-71358, 71360-71366, 71368-71371, 71373-71382, 71384-71387, 71389-71399, 71402-71404, 71406-71408, 71411-71412, 71415, 71418, 71421, 71423-71427, 71429, 71431-71434, 71436, 71438, 71440, 71442-71445, 71449-71451, 71454-71458, 71461-71462, 71464-71469, 71471-71475, 71477, 71479, 71481-71488, 71490, 71492, 71495, 71497-71500, 71503, 71505-71507, 71509-71511, 71513, 71515-71516, 71519-71521, 71524-71526, 71528-71531, 71533-71534, 71537-71541, 71543-71544, 71546-71551, 71553-71558, 71561-71562, 71564, 71569-71570, 71572, 71574-71577, 71579-71582, 71584-71590, 71593-71598, 71600-71603, 71609, 71613, 71615-71617, 71620, 71623-71632, 71634-71637, 71639-71647, 71649-71651, 71653, 71656-71658, 71662-71663, 71669, 71671, 71678, 71680-71682, 71689-71691, 71693, 71701-71702, 71705-71706, 71708, 71710, 71712, 71714, 71716-71723, 71726-71728, 71730, 71733, 71737, 71739, 71741-71744, 71747-71749, 71751-71752, 71754-71755, 71757, 71759-71760, 71766, 71768-71771, 71775-71777, 71780, 71784-71785, 71787-71796, 71798-71809, 71812, 71814-71818, 71821, 71823-71824, 71826-71827, 71835, 71837, 71840-71842, 71845-71846, 71851, 71853-71856, 71858-71862, 71864-71866, 71869-71870, 71872, 71874-71880, 71884, 71887-71888, 71890-71892, 71894-71895, 71897, 71899, 71904, 71908-71909, 71911-71918, 71922-71923, 71926, 71930, 71933-71935, 71937-71942, 71945-71952, 71955, 71957-71958, 71961, 71964-71970, 71982-71986, 71990, 71992, 71994, 71999, 72003-72004, 72008-72010, 72012-72015, 72017, 72020-72022, 72025, 72031-72032, 72035, 72037-72038, 72041, 72045, 72048-72054, 72056, 72058, 72062-72065, 72067, 72069-72073, 72075, 72077, 72079-72081, 72083, 72085, 72088-72090, 72094-72095, 72097, 72099-72100, 72104-72105, 72107-72112, 72114-72117, 72119, 72123-72124, 72126-72128, 72130, 72132-72140, 72143, 72145-72150, 72152-72155, 72157-72158, 72160-72166, 72168-72169, 72171, 72173-72175, 72178, 72180-72183, 72185-72192, 72195, 72197, 72199, 72203-72205, 72207-72211, 72214-72232, 72234, 72236-72239, 72241-72242, 72246, 72249-72251, 72253-72256, 72261-72265, 72268-72269, 72272-72273, 72275, 72277, 72279-72280, 72282-72283, 72285, 72294-72297, 72300, 72302, 72304, 72306, 72309, 72312, 72314-72315, 72317, 72319-72320, 72325, 72330, 72333-72334, 72337-72344, 72346-72348, 72350-72353, 72355-72358, 72364-72366, 72368, 72373, 72375-72377, 72379-72382, 72384-72388, 72392-72397, 72400, 72402, 72415-72417, 72419, 72426-72432, 72434, 72436, 72438, 72441-72452, 72454-72456, 72461-72462, 72468-72473, 72475, 72477-72479, 72481, 72483, 72486, 72489-72490, 72492-72494, 72500, 72502, 72508, 72515-72516, 72523-72527, 72529-72534, 72536-72537, 72539-72551, 72554, 72556, 72559, 72563, 72565-72580, 72582-72586, 72595-72598, 72600-72609, 72611-72612, 72614-72620, 72622-72623, 72626-72629, 72631-72633, 72635-72637, 72640, 72643-72646, 72651-72653, 72657, 72660, 72662-72663, 72668-72670, 72674-72678, 72686, 72690, 72692, 72695, 72703-72704, 72706-72708, 72710-72711, 72715-72718, 72720, 72723, 72728, 72730-72731, 72733, 72738-72739, 72741-72747, 72750, 72752-72754, 72756-72757, 72759, 72761-72769, 72772-72774, 72776, 72778-72779, 72781-72795, 72798, 72802, 72807-72814, 72816, 72819-72829, 72831-72832, 72840, 72842-72846, 72848-72852, 72854, 72856-72858, 72860, 72866-72868, 72870-72872, 72874, 72879-72885, 72887-72889, 72894, 72896, 72900-72906, 72908-72921, 72923, 72925, 72927, 72929, 72931-72933, 72936-72940, 72943-72949, 72951, 72953-72957, 72963-72967, 72969-72974, 72978-72979, 72983-72984, 72987-72995, 72998-73002, 73005, 73007-73018, 73020, 73024-73025, 73027-73031, 73033-73034, 73036, 73038-73043, 73045-73048, 73050, 73052, 73054, 73056-73059, 73061-73064, 73067-73068, 73070, 73073, 73075-73078, 73080, 73082-73084, 73087-73091, 73093-73096, 73098-73105, 73110, 73113-73120, 73122-73123, 73125, 73127, 73129-73130, 73133-73134, 73136-73144, 73146-73150, 73152-73157, 73159-73160, 73163, 73165, 73167-73177, 73180-73181, 73183-73184, 73186-73194, 73196-73198, 73200-73202, 73204, 73206-73211, 73215, 73222-73225, 73229, 73231, 73233-73234, 73236-73238, 73240, 73242, 73244-73245, 73247-73248, 73250-73252, 73255-73259, 73262, 73265-73267, 73269, 73276-73279, 73281, 73283-73286, 73288, 73291, 73296-73297, 73300-73301, 73305, 73307, 73312, 73316-73319, 73325-73337, 73339-73343, 73349-73351, 73353-73355, 73357, 73359, 73362, 73370, 73372-73373, 73375, 73377-73378, 73380-73381, 73384-73387, 73392, 73394-73395, 73397-73400, 73402-73404, 73407, 73409-73410, 73412-73417, 73419-73420, 73422-73423, 73425, 73427-73432, 73434-73438, 73440, 73442, 73444-73446, 73448-73449, 73451, 73455, 73458-73465, 73467-73470, 73472-73473, 73477, 73481, 73487, 73489, 73493-73494, 73496, 73498, 73500-73501, 73506, 73508-73510, 73512-73514, 73516, 73521, 73523-73524, 73537, 73539-73545, 73558-73559, 73561, 73563, 73566-73568, 73571-73575, 73577-73581, 73583-73587, 73590-73591, 73593-73595, 73597-73599, 73602-73604, 73606-73607, 73613-73614, 73618, 73620, 73622, 73624-73625, 73628, 73631-73633, 73635-73638, 73641-73642, 73645-73647, 73649-73653, 73655, 73657, 73660-73663, 73666-73669, 73673, 73675-73683, 73685-73687, 73691-73696, 73698, 73700, 73702, 73708-73709, 73711, 73713, 73717, 73721-73722, 73725-73726, 73728, 73734, 73736, 73738-73740, 73742, 73744-73746, 73751-73755, 73757, 73760-73762, 73764-73765, 73769, 73775, 73777-73778, 73780, 73782-73783, 73785-73788, 73792-73804, 73812-73813, 73815, 73817, 73819, 73821-73822, 73825, 73828-73829, 73832, 73834-73840, 73843-73844, 73846-73849, 73851-73856, 73858-73870, 73872-73877, 73879-73883, 73885, 73887-73888, 73891, 73893-73895, 73898-73899, 73901, 73903, 73905-73906, 73908, 73910-73911, 73913, 73915, 73919, 73921, 73923, 73926-73928, 73932-73934, 73936, 73945, 73947, 73950, 73953, 73956-73958, 73961, 73964, 73966-73974, 73979-73981, 73987-73989, 73991-73992, 73998-73999, 74001, 74007, 74009-74010, 74017, 74019-74021, 74023, 74025-74033, 74042, 74044-74047, 74049, 74051-74057, 74059, 74061-74063, 74065, 74070, 74072, 74075, 74080-74083, 74087-74089, 74095, 74099, 74107, 74110-74112, 74115-74116, 74123-74124, 74126, 74130, 74133, 74135, 74140, 74142-74143, 74145-74147, 74149, 74156-74160, 74162, 74164-74165, 74167, 74169-74173, 74176-74178, 74180-74183, 74185, 74192, 74195, 74197-74201, 74207-74209, 74211-74212, 74214-74219, 74221-74223, 74225-74226, 74228, 74231-74233, 74235-74236, 74239-74242, 74244-74255, 74257-74259, 74261-74263, 74265-74273, 74275-74276, 74278, 74282, 74285-74293, 74295-74296, 74298-74299, 74301, 74303, 74306-74307, 74309-74315, 74317-74318, 74321-74323, 74326, 74329-74330, 74333-74335, 74338-74339, 74345, 74347-74354, 74356-74362, 74364-74365, 74367-74369, 74372-74375, 74377-74379, 74381, 74383-74384, 74387, 74389-74395, 74397-74398, 74401, 74404, 74406-74407, 74409, 74413-74414, 74416-74423, 74427, 74429-74433, 74436, 74439-74440, 74442-74443, 74445-74449, 74454, 74457-74459, 74465-74470, 74472-74475, 74477, 74479, 74483, 74485-74490, 74492-74496, 74498-74499, 74503-74507, 74509, 74512-74516, 74518, 74520, 74526-74532, 74534-74537, 74541-74542, 74545, 74547-74552, 74554-74561, 74564-74566, 74568-74575, 74578-74580, 74582-74585, 74590-74595, 74597-74608, 74610-74623, 74625-74626, 74628, 74632, 74634, 74636, 74638-74639, 74642-74643, 74645-74646, 74648, 74651-74653, 74655-74659, 74661-74671, 74673, 74675, 74677-74685, 74688, 74690, 74692, 74694, 74698, 74700-74702, 74706-74711, 74713, 74715-74718, 74720-74726, 74729-74730, 74732-74733, 74736, 74738, 74740-74741, 74743-74744, 74746, 74750, 74752, 74759-74762, 74764-74767, 74771-74776, 74778-74781, 74783, 74787-74789, 74793-74794, 74796, 74800-74804, 74806-74808, 74810-74814, 74816, 74818-74821, 74823-74825, 74827, 74832-74834, 74840, 74842-74843, 74845, 74847-74849, 74851-74853, 74856-74858, 74861, 74866-74874, 74877-74878, 74884-74886, 74888, 74890, 74892-74896, 74898, 74901, 74903-74905, 74907, 74911, 74913-74919, 74923-74929, 74931, 74935, 74937-74938, 74941, 74945-74950, 74952-74953, 74957-74965, 74967, 74971, 74974, 74981-74982, 74985, 74987-74989, 74991, 74997-75001, 75006-75008, 75010-75015, 75022, 75026, 75029, 75031-75034, 75037, 75039-75041, 75043, 75045-75046, 75050-75052, 75054, 75057-75058, 75060, 75063-75064, 75067, 75069, 75073-75077, 75079, 75081, 75087, 75091-75092, 75097-75098, 75104-75106, 75108, 75111, 75113, 75115-75118, 75122, 75124-75127, 75131-75132, 75135-75136, 75138-75149, 75151, 75154, 75159, 75161-75168, 75170-75171, 75173-75175, 75178-75179, 75181, 75185-75190, 75192-75193, 75195, 75197-75198, 75203-75204, 75206-75208, 75210-75211, 75216-75217, 75219-75223, 75227-75228, 75230-75231, 75233, 75236, 75241-75249, 75252-75253, 75255-75259, 75261, 75265-75267, 75270-75274, 75276-75280, 75283, 75285-75290, 75293-75298, 75300-75302, 75305, 75307, 75310-75312, 75314-75316, 75322, 75328-75330, 75332, 75335-75336, 75338-75347, 75350-75351, 75353-75354, 75356-75357, 75360-75361, 75363-75365, 75367, 75369, 75373-75375, 75380, 75384-75390, 75392-75402, 75405, 75408-75414, 75416-75417, 75421, 75426-75427, 75429, 75437-75439, 75442-75445, 75447, 75449-75453, 75455-75458, 75460-75461, 75464, 75467, 75469, 75472-75478, 75480, 75482, 75486, 75489, 75491-75492, 75497, 75499, 75503, 75505, 75507-75509, 75511-75516, 75518, 75520, 75522-75529, 75531, 75533, 75539-75542, 75545-75548, 75550, 75555, 75561-75564, 75566, 75569-75570, 75572-75573, 75575, 75578, 75580-75582, 75584-75589, 75591-75601, 75606, 75608, 75610-75612, 75614-75620, 75623, 75625, 75632, 75634, 75636-

75640, 75643, 75648, 75653, 75658, 75660, 75662-75664, 75667-75668, 75670, 75672-75673, 75675-75676, 75678, 75680, 75683, 75686-75687, 75690-75691, 75708, 75710, 75712-75713, 75715-75719, 75721-75725, 75727-75728, 75730, 75734, 75737-75741, 75743-75744, 75746, 75748-75749, 75751-75752, 75755-75756, 75759-75764, 75766, 75768, 75775, 75779, 75781-75782, 75785, 75788, 75790-75798, 75802, 75808, 75810-75814, 75818, 75821, 75824, 75832, 75836, 75838-75839, 75841-75843, 75847-75848, 75851, 75853-75857, 75861, 75864, 75869, 75872-75873, 75875-75877, 75882-75883, 75885-75887, 75894, 75896-75899, 75906-75908, 75910-75911, 75913-75914, 75916, 75919-75920, 75922-75924, 75926, 75929, 75932, 75934-75935, 75938-75940, 75942, 75945, 75950-75956, 75958-75961, 75963-75967, 75971, 75973-75981, 75984, 75987, 75989, 75992-75993, 75995-75997, 75999, 76002-76004, 76007, 76009-76010, 76014-76027, 76029-76035, 76037-76041, 76044, 76047-76048, 76053-76055, 76057-76059, 76062, 76068-76069, 76071-76080, 76082, 76084-76085, 76087, 76089-76092, 76094-76095, 76097, 76100-76102, 76104, 76106-76107, 76112, 76115, 76118, 76120-76122, 76124-76128, 76131, 76133, 76136-76139, 76141-76144, 76147-76148, 76150-76156, 76158, 76160-76167, 76170, 76173, 76175, 76177, 76180, 76184, 76186-76187, 76189-76192, 76194, 76196-76198, 76200-76201, 76204, 76212, 76214-76215, 76218-76219, 76221-76223, 76230-76232, 76235-76236, 76238-76240, 76243-76244, 76247-76249, 76252-76255, 76258, 76260-76261, 76263, 76265-76270, 76272-76273, 76277-76278, 76280-76282, 76285, 76287, 76296-76299, 76303, 76305-76307, 76309-76312, 76315-76318, 76321, 76323-76328, 76330-76333, 76335, 76340-76345, 76349-76353, 76355-76357, 76360, 76363, 76365-76366, 76368, 76370-76372, 76377-76378, 76384-76390, 76392-76393, 76396-76397, 76399-76403, 76405, 76408-76409, 76413, 76416, 76419-76423, 76428, 76430-76431, 76435, 76438, 76440, 76442, 76444, 76449-76450, 76453-76458, 76460-76466, 76468-76470, 76472-76481, 76483, 76487-76491, 76493, 76495-76504, 76508, 76511, 76513-76515, 76517, 76520, 76522-76523, 76525-76529, 76531-76532, 76535-76539, 76541-76544, 76547-76552, 76554, 76563-76572, 76574, 76576-76581, 76585-76593, 76596-76597, 76599-76600, 76602-76607, 76609-76610, 76612-76613, 76619, 76621-76622, 76624, 76626, 76628, 76630-76634, 76637, 76639-76641, 76643-76645, 76650-76651, 76654, 76656-76658, 76660-76663, 76665-76667, 76669-76671, 76674-76677, 76685, 76687-76689, 76692, 76694, 76698-76700, 76704-76707, 76711-76712, 76715-76716, 76719-76722, 76724-76725, 76727-76730, 76732-76734, 76736-76737, 76740-76745, 76747, 76752, 76754, 76756, 76758-76760, 76762-76768, 76770-76775, 76777, 76784, 76787-76788, 76790-76792, 76794-76795, 76799-76800, 76806, 76808, 76811-76812, 76815-76817, 76819-76823, 76825-76829, 76832, 76835-76836, 76841, 76843-76844, 76846, 76849, 76853-76854, 76856-76859, 76861-76869, 76871, 76873, 76875, 76877, 76879, 76881-76888, 76893, 76896, 76898-76900, 76902-76905, 76907-76909, 76914-76915, 76917-76918, 76920, 76922-76924, 76926-76927, 76929-76930, 76932-76947, 76951-76952, 76954, 76957, 76960-76961, 76963, 76966-76967, 76970, 76972, 76976-76977, 76980, 76984-76985, 76987-76988, 76991-76997, 76999, 77001, 77003-77005, 77007, 77010-77012, 77014-77019, 77021-77023, 77025, 77030-77031, 77033-77034, 77036, 77041, 77043, 77045, 77048-77052, 77055, 77057, 77060, 77065, 77068, 77070-77082, 77086, 77091, 77095-77102, 77106-77110, 77112-77114, 77116, 77119, 77121-77123, 77131-77137, 77139-77140, 77142, 77150-77153, 77156, 77158, 77160, 77162-77165, 77168-77173, 77176, 77180-77182, 77184-77185, 77188, 77190-77191, 77193, 77195-77200, 77202, 77213-77218, 77223, 77225-77226, 77231-77232, 77239-77240, 77242, 77244, 77251-77253, 77256-77257, 77259, 77262-77263, 77266, 77268-77270, 77272, 77274, 77277, 77279-77280, 77283-77285, 77287-77290, 77298-77300, 77302-77304, 77306, 77311, 77313-77315, 77319-77320, 77332-77333, 77336-77337, 77339-77340, 77342-77343, 77345-77348, 77352, 77354-77358, 77360-77362, 77364-77366, 77368-77369, 77371, 77374, 77376-77380, 77382-77385, 77387-77388, 77390-77391, 77397-77401, 77403-77406, 77410-77412, 77414-77416, 77418, 77420-77421, 77423, 77425-77428, 77430-77432, 77434, 77436-77437, 77439-77444, 77448-77450, 77452-77455, 77458-77459, 77461-77462, 77465, 77467-77469, 77472-77474, 77481, 77483, 77486-77492, 77498, 77502, 77516-77518, 77521, 77523-77525, 77527-77529, 77532, 77534-77536, 77542-77543, 77545-77546, 77550-77552, 77554-77555, 77557, 77559, 77563-77565, 77568-77573, 77575-77576, 77581, 77583, 77585, 77587-77595, 77597, 77599, 77605, 77610-77612, 77617-77618, 77624-77628, 77630-77634, 77636-77640, 77642-77643, 77647-77648, 77650, 77654, 77656-77658, 77660-77667, 77669-77677, 77679-77680, 77683-77686, 77689, 77692, 77695, 77697, 77699, 77703-77708, 77719, 77724-77729, 77735, 77746, 77749-77750, 77752-77754, 77757, 77759, 77761, 77764, 77766, 77769-77770, 77772, 77774-77775, 77781, 77783-77784, 77786-77787, 77789, 77792, 77795-77797, 77799, 77806, 77808-77809, 77811, 77814-77816, 77819-77820, 77822, 77827-77829, 77831-77838, 77840-77841, 77843-77844, 77847, 77853-77855, 77861-77863, 77865, 77867, 77870, 77873, 77877, 77879, 77883, 77885, 77888-77890, 77892, 77895, 77898, 77900-77902, 77911, 77913-77914, 77916-77917, 77919-77920, 77922-77924, 77926-77929, 77931, 77935-77936, 77940-77944, 77946-77949, 77954-77956, 77958, 77960, 77962-77969, 77971-77973, 77975, 77977-77978, 77982-77988, 77991-77994, 77999, 78003, 78005-78006, 78008-78010, 78012-78018, 78021, 78023-78024, 78026-78031, 78033, 78035, 78038-78042, 78044-78047, 78052, 78056-78059, 78061-78062, 78064, 78067-78068, 78072-78073, 78075-78078, 78080, 78082, 78089-78092, 78094-78097, 78099-78101, 78105, 78107-78108, 78110, 78113-78115, 78117, 78120, 78122-78124, 78132-78133, 78136-78138, 78143, 78146, 78148, 78150-78151, 78157, 78159, 78161, 78165, 78167-78169, 78172-78176, 78186, 78189, 78194, 78196, 78199-78202, 78206-78209, 78211-78212, 78219-78220, 78222-78224, 78228-78229, 78232, 78234-78235, 78238, 78240-78243, 78248-78256, 78258-78259, 78261, 78263, 78265, 78267-78272, 78275, 78277, 78279, 78281-78285, 78287-78290, 78292, 78295-78298, 78300, 78302-78305, 78309-78317, 78319-78321, 78323, 78325, 78327, 78329-78332, 78334-78336, 78339-78340, 78342-78345, 78348, 78350-78351, 78354-78360, 78362, 78365-78367, 78369-78370, 78373, 78375-78378, 78380, 78382, 78384-78385, 78388, 78390, 78395-78397, 78404-78406, 78408-78412, 78415-78418, 78420-78422, 78424-78425, 78427-78428, 78430, 78433-78434, 78442, 78444-78445, 78447, 78449, 78451-78455, 78457-78464, 78466, 78468-78469, 78472-78477, 78482-78484, 78486, 78488, 78490, 78493-78494, 78496, 78499, 78503, 78509-78512, 78516, 78521-78526, 78528-78529, 78531, 78538, 78542, 78544, 78548, 78550-78551, 78553, 78557-78558, 78561-78562, 78564-78565, 78567-78568, 78570-78571, 78575, 78577-78579, 78581-78582, 78587-78588, 78591, 78597-78598, 78600, 78602-78611, 78616-78622, 78624, 78627, 78629, 78640-78641, 78643, 78645-78648, 78651-78652, 78654-78656, 78658-78662, 78664-78666, 78669-78670, 78672-78674, 78676-78678, 78680-78682, 78684, 78687-78688, 78695-78701, 78705-78711, 78713-78721, 78724-78725, 78736-78737, 78739, 78742, 78744-78747, 78751-78752, 78755, 78757, 78760, 78762-78763, 78765, 78770, 78772, 78774-78777, 78779-78780, 78782, 78785-78786, 78792, 78794, 78800-78802, 78804-78805, 78807-78808, 78810-78811, 78813-78815, 78820-78821, 78824-78827, 78831-78835, 78837, 78839-78840, 78843-78852, 78858, 78862-78863, 78865, 78867, 78869-78871, 78877, 78879-78883, 78885-78887, 78891, 78893, 78896, 78899, 78901, 78903-78907, 78910, 78912-78917, 78920-78921, 78923-78929, 78931-78933, 78936, 78938, 78942-78947, 78949-78952, 78954, 78960, 78963-78965, 78967-78968, 78970, 78976, 78979, 78984-78986, 78989-78996, 79005, 79007, 79014, 79019, 79021-79023, 79025-79029, 79032-79037, 79044, 79046-79047, 79049, 79051-79055, 79062-79065, 79067, 79069-79071, 79073-79074, 79076-79083, 79086, 79091, 79093-79097, 79101-79102, 79106-79107, 79113-79116, 79118-79119, 79121, 79123, 79126, 79129, 79132, 79140, 79142-79144, 79146-79148, 79163-79165, 79168-79169, 79171-79172, 79175-79176, 79183-79184, 79186-79187, 79192, 79194-79199, 79201-79203, 79206-79207, 79209-79222, 79227-79229, 79231, 79236-79238, 79240-79242, 79244-79245, 79247-79251, 79253, 79257, 79260-79261, 79264-79265, 79267, 79269-79270, 79272, 79274-79284, 79287, 79292, 79294-79296, 79299-79300, 79302-79309, 79311, 79315, 79318-79320, 79322-79325, 79331, 79335-79337, 79339-79342, 79344-79353, 79356, 79360-79362, 79365-79366, 79373-79378, 79382-79383, 79385-79386, 79388-79390, 79394, 79396-79398, 79402, 79404, 79410-79411, 79413-79416, 79419-79420, 79422, 79425-79426, 79428-79430, 79432-79436, 79438, 79440, 79444, 79451-79452, 79456, 79459-79466, 79468-79473, 79475, 79481-79482, 79484-79486, 79490, 79493-79494, 79496-79499, 79502, 79505, 79509, 79516, 79519, 79521, 79523-79525, 79530, 79533, 79536, 79538, 79546, 79554, 79556-79558, 79560, 79562, 79564, 79567, 79569, 79572-79574, 79580-79581, 79583-79586, 79595, 79599-79601, 79603, 79605, 79607, 79609-79611, 79613, 79615, 79617-79621, 79628, 79631-79633, 79635, 79638-79639, 79642-79648, 79650, 79652-79658, 79660, 79662-79665, 79667-79668, 79673-79674, 79679-79685, 79687, 79689-79691, 79694, 79696-79700, 79704-79708, 79710-79712, 79714, 79716, 79719, 79721-79723, 79725-79726, 79728-79731, 79733, 79735, 79737, 79739-79742, 79746-79751, 79754-79759, 79761, 79763-79764, 79766, 79773-79774, 79777, 79782, 79786, 79789-79790, 79793-79796, 79798-79799, 79802-79803, 79806-79807, 79809-79810, 79812-79814, 79817-79819, 79821, 79825, 79827-79830, 79832-79833, 79836-79837, 79843-79845, 79847, 79852, 79855, 79857-79860, 79862, 79864-79865, 79867, 79873, 79875-79876, 79879-79882, 79884, 79886, 79888-79889, 79895-79896, 79898, 79906, 79911, 79913-79915, 79918-79921, 79924, 79926, 79929, 79931, 79938, 79941-79944, 79948-79949, 79953, 79959-79963, 79965, 79971-79972, 79976-79977, 79979-79980, 79984-79985, 79987, 79989-79990, 79993-79994, 79997-79998, 80000, 80004, 80006, 80008, 80010-80011, 80013-80015, 80017, 80020-80021, 80029-80030, 80032-80047, 80051-80055, 80059-80061, 80063, 80065, 80069-80071, 80073-80075, 80080, 80083-80085, 80087, 80090, 80092, 80094, 80096-80102, 80105, 80121, 80128, 80130-80132, 80136, 80141-80145, 80149-80154, 80157, 80159, 80164-80165, 80167, 80170, 80175, 80179, 80181, 80183, 80188, 80192-80193, 80195, 80198, 80201, 80206-80209, 80211, 80214-80216, 80218, 80222-80223, 80225, 80233, 80235-80236, 80240, 80244, 80249, 80251-80252, 80254-80264, 80274-80275, 80277, 80279-80280, 80283-80293, 80295, 80297-80298, 80300, 80302-80303, 80306, 80308, 80311-80314, 80316-80318, 80320, 80324, 80326-80329, 80333, 80335, 80339, 80342-80343, 80345-80347, 80349, 80353, 80356-80361, 80364-80367, 80369-80370, 80372, 80374, 80378-80379, 80382, 80388-80389, 80391-80392, 80394, 80397-80400, 80404, 80409, 80411-80415, 80417-80424, 80428-80431, 80433, 80435, 80437, 80439-80444, 80447, 80450, 80454, 80457-80459, 80461-80462, 80464, 80466, 80468-80470, 80476-80477, 80479-80485, 80489-80491, 80493, 80496, 80498, 80500, 80502-80505, 80511-80513, 80515-80520, 80523, 80525, 80529-80533, 80538-80539, 80548-80551, 80553-80557, 80563-80564, 80566-80569, 80574, 80576, 80578-80579, 80581-80591, 80593-80594, 80596, 80599-80600, 80604-80605, 80608-80610, 80612-80614, 80620-80621, 80623, 80629, 80631-80633, 80639, 80641-80642, 80647, 80649-80654, 80658, 80661-80662, 80665, 80667-80669, 80674, 80676, 80678-80679, 80683-80684, 80688, 80691, 80693-80694, 80696-80701, 80704, 80708-80710, 80715-80717, 80723-80725, 80728, 80730-80734, 80736, 80738, 80740-80743, 80745, 80747-80750, 80752-80753, 80755, 80757-80759, 80761, 80768-80772, 80776-80779, 80782, 80785-80787, 80791, 80793, 80795, 80797-80799, 80801-80806, 80808, 80811-80819, 80821-80822, 80825-80826, 80828-80832, 80834-80840, 80842-80843, 80846, 80848, 80852, 80859, 80861, 80863-80864, 80867-80868, 80870-80871, 80875, 80877-80878, 80881, 80885-80888, 80890-80894, 80896-80903, 80905-80906, 80921, 80923-80924, 80926, 80936-80940, 80946-80949, 80951, 80954-80957, 80959-80961, 80966, 80968, 80970, 80972, 80974-80976, 80982-80983, 80987-80989, 80992-80993, 80995-80996, 80999, 81004, 81006-81007, 81009, 81011-81013, 81016-81017, 81019, 81021-81022, 81025, 81027-81033, 81035-81037, 81040-81041, 81047-81048, 81050-81051, 81055, 81061-81062, 81064-81068, 81070-81074, 81078, 81080-81082, 81085, 81088, 81092, 81094-81098, 81100, 81103, 81106, 81108, 81110-81113, 81118-81120, 81126, 81129, 81134-81136, 81140-81143, 81145-81154, 81161-81170, 81172, 81174-81176, 81180-81181, 81183-81184, 81191, 81195-81196, 81200, 81204, 81208, 81210-81211, 81214, 81216-81219, 81223-81224, 81228-81230, 81232-81233, 81237, 81239, 81241, 81243, 81245-81249, 81257-81263, 81273, 81275, 81279, 81282-81294, 81296-81303, 81305, 81307, 81312-81314, 81316-81322, 81325-81328, 81330, 81333-81337, 81341-81343, 81345-81346, 81348-81350, 81353-81355, 81357, 81359, 81361-81362, 81367, 81369, 81372, 81374, 81376, 81381, 81383, 81385-81386, 81389, 81391, 81393-81396, 81398, 81400, 81402, 81405, 81410, 81412, 81420-81421, 81424, 81427-81430, 81432-81438, 81442-81451, 81453-81455, 81458, 81461-81468, 81470, 81473, 81475-81476, 81478-81480, 81483, 81497, 81502, 81508-81510, 81513, 81515-81517, 81519-81524, 81527, 81531-81537, 81540-81546, 81549, 81552, 81554, 81559-81560, 81567, 81578, 81583-81584, 81586-81589, 81592-81594, 81596-81597, 81599-81600, 81604-81608, 81611-81614, 81617-81618, 81620-81621, 81625, 81628, 81630-81631, 81640, 81642-81643, 81645-81646, 81648-81655, 81657-81662, 81664-81670, 81672, 81679-81681, 81687, 81689-81690, 81694, 81697-81698, 81700, 81702, 81704-81705, 81707, 81712, 81718, 81724, 81728, 81731-81732, 81736-81737, 81739-81741, 81744, 81747-81754, 81757-81761, 81768, 81770, 81772-81777, 81780-81781, 81783-81784, 81791, 81794, 81796-81798, 81803-81805, 81808, 81811-81812, 81814-81822, 81825-81830, 81832, 81836, 81839-81840, 81843, 81846, 81849-81857, 81859-81860, 81864, 81866, 81868, 81870-81874, 81876-81877, 81881, 81885-81886, 81888-81891, 81893-81897, 81899-81901, 81904-81905, 81908, 81911, 81915, 81917-81921, 81927-81931, 81933-81935, 81937, 81940-81942, 81947, 81949-81950, 81953-81954, 81957, 81959-81961, 81963-81966, 81968, 81971, 81974-81976, 81978-81983, 81985, 81987, 81989, 81992, 81994, 81996, 81998-82000, 82005, 82007-82008, 82010-82011, 82014, 82016-82019, 82021, 82023-82024, 82026, 82028, 82031, 82037, 82039-82040, 82044, 82046-82048, 82051-82053, 82056-82063, 82065-82070, 82072, 82074-82076, 82078, 82080-82082, 82085, 82087, 82090, 82094-82096, 82098, 82100-82101, 82103, 82105-82111, 82114, 82118-82119, 82122-82126, 82128-82129, 82136-82137, 82147-82148, 82150-82151, 82153, 82155-82158, 82160-82165, 82168-82172, 82176-82181, 82183, 82185-82186, 82189, 82191, 82193-82195, 82197, 82199-82201, 82203-82206, 82209-82211, 82214-82215, 82217, 82223-82228, 82230-82232, 82235, 82240, 82242, 82247, 82250-82254, 82256-82258, 82262, 82266-82267, 82269, 82271-82273, 82276-82279, 82281-82282, 82294-82301, 82303-82304, 82306, 82309-82310, 82314, 82320-82321, 82325-82329, 82331-82334, 82336-82344, 82351, 82354-82356, 82360, 82366, 82369, 82371-82373, 82376-82379, 82382, 82384-82386, 82390-82391, 82393-82399, 82401, 82403-82405, 82408-82409, 82412, 82415, 82422-82425, 82430, 82432-82436, 82438-82439, 82442-82447, 82450-82451, 82453-82454, 82459, 82461, 82463-82467, 82469, 82471, 82473-82477, 82480, 82483, 82485-82487, 82489-82492, 82495, 82500-82502, 82505-82506, 82509, 82511-82514, 82516, 82518, 82524, 82526-82527, 82530-82531, 82533, 82535, 82543, 82545-82554, 82558, 82560, 82564-82566, 82574, 82583, 82588-82590, 82593, 82595-82599, 82601, 82604-82605, 82607-82608, 82614-82621, 82623, 82625, 82627-82628, 82630, 82635, 82637, 82640-82641, 82645, 82648-82650, 82656-82658, 82660-82664, 82667-82669, 82672, 82676-82677, 82683, 82685, 82689-82690, 82692-82694, 82702, 82704-82706, 82709, 82712-82713, 82716, 82720-82721, 82724, 82726, 82730, 82732-82738, 82740, 82746, 82753, 82756, 82758-82763, 82766-82773, 82775, 82782-82785, 82790, 82792, 82794-82795, 82798, 82800-82801, 82805, 82807-82808, 82810, 82813-82815, 82823, 82825-82826, 82830-82831, 82833-82834, 82841-82844, 82846, 82850-82856, 82860-82861, 82864, 82866-82867, 82870-82872, 82879-82880, 82882, 82884-82891, 82897-82898, 82900-82903, 82906-82908, 82912, 82915-82916, 82919-82920, 82922-82923, 82925, 82930-82934, 82937, 82939-82941, 82943, 82945, 82947-82948, 82953-82954, 82956-82957, 82961, 82966-82969, 82973-82980, 82984, 82987, 82992, 82994-82996, 82998, 83001, 83007-83008, 83011-83012, 83014-83017, 83019, 83022-83024, 83026, 83033, 83043, 83045, 83054-83056, 83059-83060, 83063-83064, 83067, 83070, 83081-83083, 83085, 83087, 83089, 83092, 83094, 83096, 83105, 83107-83109, 83112, 83114-83116, 83118-83120, 83122, 83125, 83131-83134, 83136-83141, 83147, 83155, 83157, 83160-83161, 83163-83164, 83166, 83168, 83170-83179, 83181-83182, 83184-83190, 83192-83194, 83196, 83198-83202, 83205, 83208-83211, 83213-83215, 83219-83223, 83226-83229, 83231, 83239-83243, 83248, 83251, 83259, 83261-83262, 83265, 83271, 83273, 83275-83279, 83283-83285, 83287, 83289, 83291, 83293, 83295, 83297-83301, 83303-83305, 83312, 83315, 83321, 83323, 83327, 83329, 83331-83332, 83334, 83336-83337, 83340-83341, 83346, 83348-83349, 83351, 83354, 83359, 83362-83365, 83367-83370, 83372, 83374-83376, 83383-83385, 83391-83396, 83399, 83402, 83405, 83408, 83412-83414, 83416-83420, 83424-83425, 83427-83435, 83437, 83440-83441, 83443-83444, 83446-83448, 83451-83453, 83458, 83460, 83468, 83470, 83472-83474, 83476, 83478, 83480-83482, 83484, 83488, 83490, 83494-83495, 83498, 83500, 83502-83508, 83510, 83512-83517, 83523, 83527, 83530-83531, 83535, 83537, 83539-83540, 83544, 83546-83548, 83552, 83555-83556, 83562-83564, 83566-83568, 83570-83572, 83574, 83576-83582, 83584-83587, 83591-83593, 83596-83601, 83603, 83605-83606, 83608-83612, 83614, 83619, 83621, 83623-83624, 83626-83629, 83631-83634, 83638-83640, 83644-83646, 83648-83651, 83658-83659

The foregoing written specification is considered to be sufficient to enable one skilled in the art to practice the invention. The present invention is not to be limited in scope by examples provided, since the examples are intended as a single illustration of one aspect of the invention and other functionally equivalent embodiments are within the scope of the invention. Various modifications of the invention in addition to those shown and described herein will become apparent to those skilled in the art from the foregoing description and fall within the scope of the appended claims. The advantages and objects of the invention are not necessarily encompassed by each embodiment of the invention.

SEQUENCE LISTING (83660 sequences)

SEQ ID NO: 1 - DNA, 99925 bp, Homo sapiens
caagcgtagtggtgtgctcctataatcccacctactcgggaggctgaggcagaagaatcgcttgaaccttggaggcagaggttgcagtgagacgagactgcgccattgcactccaatctgggcgacagagtgagactctgtctcaaatcaaacaaacaaacaaaaaacaaacaaacaagaaaattgggtcgaaaatctttagagaaacctccccaaagaagatagacagatggcaaataagcatatcagacgatgctccatatcatacattatcagggaaatgcaaattaaagcaacaatgagacgccagtacacacctactagaatggccaaaatccagaacactgataacaccaaatgctggtgaggatgtggagcaatggaaactcattccttgctggtgggagagcaaaatggtatagccaccctaaaagacagtttggtggtttcttataaaactaaacatacacttgccagatgatccagcaatcacactccttggtatttacccaaaggagttgataagttatgtccacacaaaaacctgcacatggatgtttatagcagctttattcataattgctcaaacttgggagtaatcaagatgcctttcagtaggtgaatggataaataaacggtggtatatccagttgatggaatatcattcagtgctaaaaagaaatgagctctcaagccatgaaaaaacattgaaagaagcttaaatgcatattacaaagtgaaagaaggcaatctgaagaggctacagactgtaggatttcaactctatgacattctggaaaagataaaactatggaaacagggagaatatgggaattctctgtaccttcctctcaattttgctgtgaacctaatagtgctctaaaatataaagtctttaaaaagaaatctggccttccctctccctcaccctgcaggggcaggtcctgttgcctgcctgtcccaggatccaggctcagctggtttctggctgggtttgaccataggagacccgagccggagactagagggaagaagaagtggggggagcagctcggcggcagctgcagctcctaccaaaaggcccctgtggttctaggccttctctctgtggccccccaacctcgggtgggctgtgctgatcccctatcaacctccaagtagtcctgggtaccctttccctggtatttagtgccctaagtcgaagtggtttctgttttcctggggcgactctaaactgatgaaatagtcacttggagactgatatgatttggatatgtgtccccacccaaatctcatgttgaattgtaatccccactgttggaggtggggccaagtgggaggtgattggttcacgggggtgggtttctcatgaatgatttagcaccatcctcttggtgctatccccacaatagtgagtgaattctcaccagatctggttgtttaagagtgtgtggcaccctggagccccagctactcaggaggctgaggcaggagaatcacttgaacccgggaggcataggttgcagtgagccgagatagcaccatccactgcactccagcctgggcaacagagtgaaactccgtctcaaaaagaaaaaaaaaaaaaagtaaccccgacaatgtaaaattaaagtgtagctgatgcaaaatggtcaaagataactttactagtgaaagctaatggaacaagagatttaaatgtattatttaaacatacaaagaactaaagataacagtggatggtgttacatacatggtcatatatcaggtgtgggggtccccaataccacctgcaggaacacccaggcctgctggagttaactcttgctacacagaaagaggagagaaatgtgtcccatccagcaacaaaaacctatccttccatgttttgtgtataggttgacgctaaaacctgaaaagcaaaaacaaaaattcacattagaaagtctatgtaaatattttcagtgccaggtcaagaagaggaatgctaggattatatttctttcttatacgtctaattcgatagtccctgagtcatttgaaaagagaactttcctagcacccaggtcccaatgattctcttcttaccatgaattaggaaaattatgatctattttactttacttctggcttttttcttttttctttattttatttttattttttgaaatggagcctcgctctatcacccaggctggagtgcagtggtgcaatctcggctcactgcaacctccacctcccaggttcaagcaattcttgtgcctcagcctcttgagtagctgggatcacaggtgtgcaccaccacacccagctaatttttatatttttagtagggacatgttggtttcgccatgttggccaggctggtcttgaactcctggcctcaagtgatctgcccacctcggacccccaaagtgctgggattacagacttgagccactgtgcccggcctgcttcttgttttgatcataactttctttttttttttttttttttttgagatggagtctcactctgtcgcccaggctggagtgcagtggcgctatctcggctcactgcaacctccgcctcccgggttcacgccattctcctgcctcagcccccgagtagctgggactacaggcacccgccaccacgcccggctaaatgtttgtattttttagtagagatgggatttcactgcattagccaggatggtctcgatctcctgaactcgtgatccgcccgccttggcctcccaaagtactgggattacaggcgtgagccacggctccttgcggatcataactttcttgtatagttctttccttctggtatttttaattgcttttccttattttcttgtactatttgccatcatcgtatccaacttcagactcccaatcacaccatctaatatgttgaattcacatatacacaattttttttttttttttttttgagacggagtctcactctgtcgcccaggctggagtgcagtggcgcaagctcggctcaccgcaacctctgcctcccaggttcaagcgattctcctgcctcagcctcctgagtagctgggattacaggcacccgccaccatgcccggctaatttttgtattcttagtagagacggggtttcgccacgttggccaggctggtctcgagctcctgacttcaggtgatccacccgcctcagtctcccaaagtgctgggattacaggcgtgagccaccacacccggctatacatatatatttaattcttggagtcctctctcccagagcctaccattctcctactccaacctggactgattgccaaccaggctttctgcccagttggcatccctggtatttcccatcacagctctcctggattagatccattgtcttatggatcccacattttcctttttcttggcttgcacccttgatttgctgcagagcatccccaagtagcttcctaagaaagtacatttcagaggcaaattttcttagctcttgtgtatctaaaaacatttttattccattatcacacataatggatattttggatggtgtacttctatgtggaaaatcattttcccttggaatttggaaagcattgccctattatctttttcttttcttgttgtcctgtgatcttttatcattcagtgttgttatgaactctggtgctactctgattcctgttcctttttctttatttcatttttccataattcttgttagttgcttgccagacttcctagatcactcctcaaagtcctcatattttctctcatatctttgtctctattgttttgttctattttctgggagacttcttcagttttattttccaatatttctattgaaatttgaatttcaataattccttcttgttctctgattgctctttttacataatattctgttcttgttttatgaatacagcattttcttttagttctgtagatatgttaattaaattaaattttttgatacattccctgaattttcttgaattccaagtttatattttttctacaggtttatcttgactctttttcctgttgaaggctttcatcaaatttctgataatatttactgactggtttatatttaataaggaaggactggataagtattgtggatttaatctgctgttgggcaaataggtctgttttcctgctgtgactcttctctgtgtaggacagggaggtgacgaacagagtatcccctagatgccggaatgaggaaacaattgttcaggggttgtcagcatccatgctggaagccttagctctccaccgacatttcaatcaatttctttacagaactgtcaggtgttttccctgtaggtctgtgccagctcccagctcagctgtctggtggggagaggaggttccaactggtacagtcattctgtactggtgccttcaattaatccccatgtgttcagtcctatttaattctatcgttttctaccacatgcctactgattctgattgtctggtgttatatctagcaaactcactcccacttcttctgtggctcccttgtcaaatattctcacctggatttttactgcctattttattcatcaatcaattcccatatgctttctataaagttgttgtcctttgatgataacctctcatcctcaccacattctcttcactctggtgggtttattcctttccttttttttttttttttcagacggagtcttgctctgtcacccaggctggagtgcaatggcacgatctcggctcactgcaacctctgcctcctgggttcaagcgattctcctgcctcggcctcccaagtagctgggattacaggtgcgtgccaccaggcctggctaattgtttgtatttttagcagaggcagggtttcaccatgttggccaagctggtctcgaactcctgacctcaagcaattcaccctccttggcttcccaaagtgctgggattacaggcatgagccaccacaccctgcctcctttctgtttcttgacattcttcttttagtgcacttctatgagtaaagaaggaaaactgtgtgtgtgtgtgtgtgtctgtgtctgtgtgtctgtgtgtgtgtctgtgtgtatgtgtgtctgtgtgtctgtgtatgtgactgtgtgtgtgtgtctgtgtgtctgggtgtgtgtgtgttcatgcacatctgtgcctgctcatggtgtcttatatcagaatttattcatttcttatctattttctaacaaatatggttaaggctattaatttttctaggtgacctctgtagccttatctcctaggttttaatatgtagggctctcaatgttggtcatttcttttgtttttagagacaggggcttgctctttctcccaggctggagtgcagtggcatgatcccacctcagcctgttgagtagctaggactacaggtgcgcacgtgcccagctaatttatttcatttttgggaaaaacggggtctcactttgttgcccaggctgatctcgaactcctgggctcaagcgatcctcctgccttggcctcccaaagtgctgggattacaggcatgagccagcgcccctggcctggattagctcttctgaaatatatatattctctatcagtttaagagatttttagacaaatggagtaaaagtttgtgttgtttgtcatattgataaaatccttctggttgtgggctttctgtcaattaccatctatactagattttcctggtttttatcttctacagtcctgtttttaagaggaccttaaactattacagtcccattttttaaattactgatttttaattctaatagtaaataattttgattatagtatatttttcttttttttcttttttttgagatggagtcttgctctgttacccgggctggagtgcagtggcacgatctcggctcactgcaagctccgcctcctgggttcaccccattctcctgcctcatcctcccaagtagctgggactacaggcgcccaccaccacacccggctaattttttgtatttttagtagagacggggtttcaccttgttagccagaatggtctcgatctcctgacctcgtgatctgcccgcctcggcctctcaaagtgctgggattacagacgtgagccaccatgcccagccgattatagtatatttttctacttttcaatggcaagtgtgaaactgtataacttaagttccttctattcaacctaaggaatttagcaagattctcttcattattttttaatatttcaaaaacttcttgagttctagtcttgtacattattctttccaatctagatttaagttgttatagcccatgaaacttcttgacttttgattgagcaaagaatttccagagttattgatgaagaattaacatttctataatgttaatgcttcccctccaggaatacggtagcgtctgtttttgtttttgttttcttcaggtcttcttttagatttttcagtaaagttttatagctttttgatgcaggttttgacatttcttattaagtttattcccagctgttttataatttttgtagtgagagtgagttgaatcttttttccctcattacattttccagctttttattactggtcgtgtttacatgcctgcatcctaacaccggggaactgacttgaaatgggcctttctccccgcagagacgcaccaagaatgaggtttaaaagagaatggaagaaggatgtatgtggggctttttatttttgttttttaattgacacatatttagggagtacaatttgatatttcaatatatatttatgttgcacaatggtccaagcagggtagttaatatatccatcagctcatgcatgtaccatttctttgttgtgggaactttcaaaagtctctcttctaggtattttgtaacatacaatatattgctgtcaaccatagtcaccctgctgtgcaatagaacaacataatttttttttttgagacagaatctcgctgtgtcacccaggctggagtgcagtggtgtgatctcagctcaccaggttgctctgcctcctgggttcgagcgattctcctgcctcagcctcccaagcagctgggactataggcacccgccgccatgcccagctaatttttgtatttttagtagaaatggggtttcaccatgttggccaggctgcactcaagctcctgacctcaagtgagtcacccacctcagtctcccaaagtgctgggattacaagcgtgagccactgcacctggtcaaaacaccagaatttattcatcttatctaataataactttgtacctgttgaccaacctctgcccatcctcctctccccgatcctctccccagtctctggtaactactgttctactctctgcttctatgatatcaactcttttttgtttttgagattccacatatgactgagatcatgtggtatttgtctttctgtttctggtttatttcccttaactttatgtcctccaggttcattcatgttgtcttaagtgacaggatttcattcttttttatggccgaatattattccattgcatatatgtaccacattttctttatccattcacctgttggtggacacctaagttgattctgtatctggctattgtgaatagtcattcaataaaaatgggagtgcagataactcttccacatactgatttcatttcctttggatatataccggtagtaggattgctggtagttctattttcaatttattgagaaacctccatactgttctccatagttgactatactaacttactaccccaccaacagtatgaaagtattcccttttctccacatctttgccaacttgtcttcttttgtctttttgattaaagccattctaactgaattgaaggggtatctcattgggcttttgatttgaatttccctgatgatgagtgatgttgaactttttttcccctccctccctccctcccttccttctctttcttttttcgagacagggtctcactctgtcacccaggccaaagtgcaatggcacgatcctggctcattgcagcctcaaactcctgggctcaagtgatcctcccaccccagcctcccaagaagctgagatgacaagtgtgcacaaccatgcctggctaattttttgtttttttagagacagtggtcttgccatgttaaccaggctggccttgaactcctggactcaagtgatcttcccacctcggcctaccaaagtgctgggattacaggtgtgagccaaggtgcctggcgagatttttcccatatacctgttggtcatttaaatgttttcttttgagaaatgtctattcaggttttttgccctctcctaaccttttattttatctatctatctatctgtctgtctgtctgtctgtctatctatctatctatctgtctatccatccatccatccatccatccatccatctatttcgagatggagtctcgctctgtcacccaggctgtagtgcaatggcacgatctcggcttactgcaacctccacctcccaggttcaagcgattctcctgcctcagcctccagagtagctgggactacaggtgcgtgccaccacgcccggctaatttttttttgtatttttagtagagatggggtttcaccattttagccaggatcatctcaatcccctgatctcgtgatccgcctgcctcggcctcccaaagtgctgagattacaggcgtgagccgtcgtgcctggtcacctttttttttttttttttttttttaaagacagggtcttgctttgttgcccaggctagagtgcaatgtgcaatcatagctcactgcagcctcaaactcctgggctcaagtgatccttccacctcagctttccagggagctgggactacaggtgtgtgccaccacgtctgtctaatttttaaattttttttgtaaagacggggtcttgcttcttgctatgttgcccaggcttgtcttgaactccagttctctgatttttaaaaaaaatcataagtagatgttgaattttatcaaatgctttttctgcatctattgaaataattatgtagtgtttttccccttaagtttgttaaggttgggtttctaattttaaaccatatttgcattcttaggataaaactcaactcggttgtgatagatcatatactgcaggattcagtttatttgtctagaattttaaaacttatttccacatcttgtgtcatacttttcttggctcatcatagtagatatattagtctagtaaaataagtttggagacatttatttcttttctgtgtatgattggaattgcctactcattaaagatttggtagaagtcatccataaagccctcttggtctgtttctctctctctctctctctctctctctctgtgtgcgtgtgtgtctgtgtgtgtctgcgtgtctgtgtctgtgtgtaggaggatgggtagctttttaaatacatagtcaatttcattgtggttacagggattttctgtttctaaagtcggttttggtaagctgtactttcctaggaatgtattccttttgcttatgttttcaaatttactgacacacagtgcataataaaaccttttcatgagtaacataatttacttttctcttttctctttatatccagcttgttagagggttggcttttgtttttcagcttttcaaagaagcaggtttaaaattttctcaatcctctccatcatttgtttctatttcattaagttttattcatccttatttttctttcttctacttttgcaggcttactctgtcatttctttatggcttcttgaattggatgttcagcgtgatgacttttggactgctttagccgcatctctatacttcagcatcgcacacccaatggcttactcaacatctccactttcacaccactgggcaccccaagcttaatacagccaaagcagaactcttgatctgcacctctgaaaatgtacttttcctgtagttctccccactatggtgaaaagcacccttatttccccagttgctcaggccccaatctcaggaatcatccttgtttcttcccttgctctatgccctacatccaatccttttgttcagttctgaaaacatatcttgaatctcacaacttctcagagctgcactgctgccaccctagttaaagctaccatcaactctttctcctagactgttccagggccttgcaactagccttgtgctgtagttttgtttcatcacgtccagttctccactctacacctgcaacatagatcagacagctcctggctcaaaatcctctgagggcttctcatcttagaataaactctcggttctggccgggtgcggtggcttacgcctgtagtcccagcactttgggagtccgaggcgggcggatcacttgaactcaggagtttgagaccagcctgggcaacatggtgaactcccatctctatcaaaaatacaaaaacttagccaggcgtggtggttcgcatctgtggtcccagctacttaggacgctgaggagggaggatcgcttgagctcagggtggacgttgcagtgagccaagattgcgccactgcactgcagcctgggtgacagaatgagaccccatccccaccccccccaaaaaagaatgaactcccagttctcatagtggccccagctgcctttccaatcacattccctaccactctccagcaacactgacttcctcgttagtccccaacatgccaggcatagtctctcctcatgtcctttgaacttgcctggaatgttctttccccagatattcatatgagggagtaaaatgagggtgaaaaccagcagatatctaaatagcacccccttcacttagtttatctttctcaaagcccttatcactatgtgaaatgatatattatacttatttgtatgctagtatgaatcttcccggcaagaatgttagtttgctgtctgttcagtaccgtgcatccagagcctggaagagtgcctggcacatagcaggtagtcaataaatgaatgggggcaagcagccaaatcagaatcaggttttcttgctaagcatagaactaacagaaggatcattgaatggattggataatgactggcatcagggtaaggtccccttaacaaacactcctgtcctgaacacctggttagctaacagttttctcatactcttattttcccaaaacacaattgctggatctcagctccaaatcaactcttctaggaaagtgaaaaattgctggatctcagctcccaaatcatatcttccaggcagagctaacattgccccttattcacacctccaccaaaccatctgatccaacagtgacaggtgtcacgaggccttggcatgcactctcttcccccgccagagttctgcgaaagccagggttgcgatttgttgtcagtttattccccgcctctatgagagtgtgagcactgggcaggctcggatgaaataatgcattgagtaggcctctgaaaccaaggcccctcagctggggcaacgtcaggctccagggtgggcaactttgctgcttctgccgaagatagtgatattgagaaaatgtgggtgcaatgaaacgcttattgcagcgcactcggtgcatctgtggacagagggtcaatcgcccctcagagcagcgcaaacaggcgtcccaagcctaggccttcacttgccccagcatccgcaagggtccattaatccttaacattcaaattccgcccactaaaccagtccctccgcgcccaagccgcctcttttccccaaacgacggccgaaagcagccaatcaacagctggaggggtccgcccccttttccctggccgaaatggacaggaaatctcgccaattgacggcatcgccgctgagacctcccccctcccccgtcctccccgtcccagcccggccatcacagccaatgacgggcgggctcgcagcggcgccgagggcggggcgcgggcgcgcaggtgcagcagcgcgcgggccggccaagagggcggggcgcgacgtcggccgtgcggggtcccggcgtcggcggcgcgcgcgctccctcctctcggagagagggctgtggtaaaagccgtccggaaaatggccgccgccgccgccgccgcgccgagcggaggaggaggaggaggcgaggaggagagactgtgagtgggaccgccgtggccgcgggcggggacccttgccggggggcgggggtcaggggcgggacgtggcgcgggaggggcccgcggggtcggacgacacggctggcggatggcgtccctcctctctaccctccccctcccgccgccgccggtggcgactctcccctcggcccgtcacccgtgctcgcgggtgaccgtcctcggcgcggcctccctggagccgccttcgcctgacgcccctcttcctcccgccctcgacgcgcatcccggcccccggccccgcgggcgcccctgtcgccggggttcgcctgtcggggctgcgcgcgctcctgcccttctcggggctttgggccgcggcgccgtcgcgcgcccgcggccccggcctctccctggatcgcgctctccccctccctccctcgcgcgccccctctcccgttactcggcccccccaccggcgcgcgtgcgcacttcgcctcccgtcgggagagtgcgccacaagggctcctgagctctcacccccatctctgggctttgcctccccctccttctcgcccattccatgaatttctgccccccgctacccccccgcgagcgagtaggtccaccggctcctttccccatctagcaggaacaagtaggtggggattattatccacaaaagggactagacattgtgttctgggtcccacaactcatcataaagaggtggttatagttcccatcaggagccgtgggtaggggactgtgcgtccagcagcacccgaggctcttcggcgccagaggctctaaggtgcgagcgtgtccccagggtgctcagaggttctttggagtgctgtggcctcggaatgtgagcaccctcccatcctaccctccccttcgccggcgatcttccagttacataagtggagtgggacatagtaggtaacgggctctcatcgccctggagcgctcgggatcaccggtaccagatggggcaagttcatcgcgacgctgtggctcctgttaattgtgcctgaaaggttatcctctgttcagtttggtcatgaccgaatcacccaaactgaaactcagatgacttttatatggcagtggcaatgtttctgtggttttgcactaaagacttaaggtcattatgaagagtgtaaaaggattgctgtcgcaggggagaccgtttatgacattgctaagtatggaccccgagggggaaaaagctcattctggaattgctctgtggcggttgcttctgttgcgagtgtgttcgggtgtgggttggtcacagcagaaatgggctccaccacaaaattgatattcctgactcatggtcaggcagatgtgtgcttctggttatttttccaggaacaggaatgggctctgccgagcctttcacacgttgtgtctctgctgtgcgggatcagtaccccagactgtgagataacaggatcgaattcaggggttggttggtgatccaggaaccatacctacttggatgtgatactgagtggcctagacgttgtaggactctcataagttttagacattttgttatactgtaaaaatgaagcatatacggcctcagtagtaacattgcactaataggtaattattactctagagaattttgggttccatggctggaatgttcatcagtatctcagcaatttcagttaataaccagattaagctgacctcttgagtcttttgaaatctgctgggtccctataataagacagggtctggattttttaatcttttgggaatttccaccaaggatttagggaaataggcttttatgggcttttcaggatttctatttcaaatcccaatgaggaagtctaggaaacacttgcttttattttcttgcctgaatatgtcagaaccttaaatcacccaatcaatctagaagtactacagttgattaaagtaagtcaccacaggtcacccattcgtggcaggtcagctaggtggctgatcactggaatacagtcatatccccaggcatacacacgagcctcacttgacgatcccaaagtttgtacatctgagcttgagacgtgacaagttgaggtctctgctttgttcttcatagttggcagtttgtctcctcgggtgcccctccggttagctgtttatcatacgtctagccctatcaacagtgcaggcagcttccagagtatagttttctctgcaaagtgcctggtggaggggtacctccttttccattgtcctaatggctccactgggcttccataccagccctttccagtgtcttaacagctcaaagaaacccatctgtggctttcttgttagcactggcctatcacaccttcctattgcctgttaactaaaattttgcctggaatgctttaagcttagagtactgggtctttgtttcacccgattgataggagagtgtcatgcagtcagccgaactccgacttctgtgctgtttaaatccttaggtaggtctggggcaaggcacaaaccactgtgtattcaaagggttatggtgcttgcattctgtgtgtatatgtttgtaatttccaaccagagtcgtttcccgtgcctgccctgcctctgtgcaatctagtctagtagggtagggaggcaagctgtggagtttgaaaaaaaaaaaaaaagctagatgagtttaataggctgttaccccctccagaacattcctcccatgtggagatgaaacgagaagttcatttctttaacctaaaataaagaacaacagagataaaattgttagttccttattggagcctggtttccattgctaatgtacctgcttgggactctgcatgataaatgacgtgtcctggaacctgaaatcttttataaaggttaatatcagcagaaatcttttaattagctaagagcagcttgttctcaagctgcccgagttatcttggaggagagaatcacaggaaatgtttgatatttctagtaaccagtgttttcagtgcgtggggtaaagcacactcctagactggccagtcccaaagagtgtggcaggacacctgcttgttttccctgccctctgctatggtgacatccttgcagaccagtcttgcgtggctggcagacgcaatctttttttcttgggtagagcattatcaccgctgcgatggaaggaccttgtcctcggtgcctccataccagccctttccagtgaaactactgctgtcccggcaagcccctgtgcgtgtgcatcattccgggtaggacaagatgtgaacaggtccctcttctttgggcttaagtagaagttgtgctcttctgcttttacctgtgtgctcttctgcttttacctgttctcttctgcctttctcttgcaagaaacctgtcgaaagcttgctttgcatgccattgcttaaatactttgatggtatgtatggtatgtgggataactgagtgggagccggaattggggggtgggcagggcatccccacccccacccccacatcaaagggggaatgaccatttcgttagagaataaagcctgagtcttataacttcttcaagcacatgtatgctgggtctcctggcgtgtgaatgtgttcccgctgtgctgtgtggctgttttgcagttactgtagacactgtagtctgggctctcattattgcctctgaagttgacaggaccaagccttagtaaggatgcacttgtcttcctagcccaagagctaggggtgttttatatatatattaactttcttttttagatttcataaactgctctcattttctcttttctttctttctttttttttttttttttttgagacagtctcactctgtcacccatgctggagtgcagtggcacgatctcagctcactgcaacctctgcctcccgggctcaagcagttctctgcctcagcctcccaagtagctgggattacaggcacctgccaccacgcctggctaatttttgtattttttttttttttttttttttttttttagtcgagacggggtttcaccatcttggccacgctggtcttgaactcctgacctcgtgatccacccgcttcagcctcccaaagtgcagggattacaggcgtgagccaccgcacccagcctctggctcttttctttttgacatgaaatcttaagttaattatcttaaactttaagaactagaaggattcttagtccagcaccatcagtttacaaacaaaaaaaacttgtgtccctgagaagttgtgacttttccagggcctcctagccaggataccagtttggtttttattatatagctagccgagtaatactattaacttgacttctgggatttcaaagtattctatgacttgactgtttaagggaattatgaggcctcactgaacctcaaaagataattttaggtaccatcctggtagctgtagagcagcaacagaccagtaaaagacttggttggtgttgcccttcttctgggtttgattacatgagtaattgtgtgaatagtctctaagttgtatgctctgagctttcgtttttagcttataaaagtgctactcttgggccagcatagtatcagaaattagctaattcatatggggcagtttaggctttaactaggaaatgatggttatcttaatgacaaaaaaggtactgacaaaagtccttttttgaacatgtgttcaaaagaaaaagagaaactatcaaactaataactgagtttgttgaacatcgagattgactgatctgagaggcttaaaactgattgccctgaaatagacttgcatgttttggatgatggctttgggtctcccagagcacttggtttcccttggtgctgattttttctctcaggattaaagcccctttatgtgatgttgttacagcagcttattgcaacttcattcagctgcttgaaaaagaagggagactgcctctaggttccatgtgttctttcagggatggtattttgatgttgcgtattctcttgaacatgtattcttccctgagaatttctgtgtgccgtggtagaagaaatacttgccagaaatcgccactcatggtatgcttttgtagtgtcgaagtgtcccctagaggtgacaaggcttgtgatagtgttgattctaacaagcatgaatctttcctttattttagcactgtgtgttacgtgccagtaatttgcagcttatcctttgtttctagctaggtaagctgggaaatagcctagtactttgtctatgtgtttatcttcaaaatgtcccaaatagccctgggaaaaaggtcgtgcagctcaatgggggctttcaacttacaattttctttgttttaggctccataaaaatacagactcaccagttcctgctttgatgtgacatgtgactccccagaatacaccttgcttctgtagaccagctccaacaggattccatggtagctgggatgttagggctcaggtaagtaaccttcctttttttttttttagtatatgtcctggtttggccatctgttttttttttttttaaaaaaaaaaaaaaaaggaaaagaggaaaaaaatatactactcttggacagtataaaagtaccccaaagactaaagacataactgtgccaaactgtgccatataataaaaaaaagtcacttccctgagccctgaaaggtcagtgtgtgtagggttacttggtcgccacagcgtgatctgggggcgggcgtcagattagagccggaactggtgatctgcaacttcagttcaccttgaagcaggtcagctgagctgagagcgcttgcactgagcccttttgcgctgctgctgttgccttagcggtcttcagcatgtgtttgctttggtttggggtaaatggcttagtggtcaacattagtgagcagtggtaatgcattttcagatatgggaactggtatgtggttggttccctagaaggacaccctcctgaaagctgtctcagaacaccgggggccatggctaatgtcatgtgcttgctacactcctcccatggtaactaaagagagtacccagatatacatctggttcttgggactctagaggaggatgagtactttgtaaaaacctgggggccccagtcattctaggtctgacactcaggtgctgtatcagctgcagtttgaactacttggcaccattgtgtggactttagttttgtaaaaatgaatggttccttaatttctcaaccttcaggctcaacatctcaagctgtttgttgttgttgttgttgttgttgttttgttttgtctttttgattagtggtcactccgcatttgatgttttgacatgtggatttcagaacttctgtgtggtaaagcagaatgttccaattgaattttcccattttttttcccctaagcaaaaatgtgagttttcacttatgcggccattgtgattccgactgagaccctaagtcgttctttgttgtctctctagtggtttctgacacctcagtgtgaagctgttgtagacatccataagaaatagcctgcttagggattatgtgagggcaaggtttggctgaaggagaatagaaggtgtggaaggaagcggaagaccagaagagcatcacactgcctcaagtcccaaatttgattctgctcctgatcctgtgactcaaattgtcattctcttttactgctgtggggtgtgctctgggcccagctgacaggacattctttgtactccacgtatttatgctggtgggagttgtatggctagtgctttgtgctttgtctcagaaattgtgtggactaaatgtaatatgggcagtgaatgggtttcttctggaagatgttaggcctggagggtggtttgggtttttacgagtctttttctcagattacagattacgaatggatgttataaaacaggcagtgttgacaccatacagtttctcctaagaaatgtacagagagttcaacctgaggaagctaattgaaaataaacttttaaaaagaaatgtagaaagaggaaatttaaaaagtatcttatgaatgggaaagatgtagccatttgagcttcaaagaacttttgagggaattctcaaaggacagtacccgtctttagtagataaatgcttgatatctatttttcttcttttactttttaaagaattactaaaataatacatggatttatagaaaaatcaaaccacttaaaaattgatcaggtggctgggcaaggtggctcatgcctgtaatcacagcgctttgggaggcctaggcgggtggatcacctgaagtcaggagttcgagaccagcctggctaacacggcgaaaccccatctctattaaaaatacaaaaattagctggccatggtggcttgagcgtgtagtcccagctactcggaaggctgaggcaggagaatcacttgaacctgggaggcggaggttgcagtgagccaagatcacaccactgcactcctgcctgggtgacagagtgagactcggtctcaaaaaaaaaaaaaaaaaaaagtatcaggtaaaaaaatgaaagctccccgcttaatctctgctcccactacccagaataactgctgttaatagcttaatgtagatccttctaagtcttctaagactaaactgtgtactttttgtgttgtaattaacaggagggtttttgttttgttttgttttttctttttttgagatggagtcttgctctgtcatccaggctggagtacagtggcacaatcttggctcactgcaacctccacctcctgggttcaagtgattctcctgcctcagcctcctgagtagctgggattacaggcgcctgccaccacacccagctaatttttgtatttttagtagagatgggtttcaccatgttggccaggctggtgtcgaactcctgacctcaggcgatccacctgccttggcctcccaaagtgctgggattacaggcgtgagccaccgtgcctggcctcaggatggtgttatatatacatattctgcatttttccatctcatatattcatctctgcctcatttcttttaaatagcagtgtagtccagggctgacttaccgtcatgcatttcgttgtctctctatgttattaaaaatgctacaggattgaaattcctcatgtgccagtcattttgaagaatggctgcctagacttggaatttctggtggataccaccacatcactgtccaaaatggctatcccagttcccacaacagtctgagaaagtgccattttcccatatcgtcccagaattggatatacatcttttaaattggtgccgcttggattattactgaggctaaacctcaataatcattgtcatagctcttaatgtattaaagatgttaactctttgtcatgcagatattttcctgttttgtcttacgtcttgattcttgtctttctgatatataaaatttatgttatgatttattcttttgctttcatacttaggaaatccttttttactctttttttttttttttttttttttttttgagacggagtctcgctctgtcgcccaggttggagtgcaatggcgtgatcttggctcactgcaagctccatctcccgggttcattccattctcctgcctcagcctcccgagtagctgggactacaggcgcccgccaccacgcctggctaatttttttgtatttttagtagagacagggtttcaccatgttagccaggctggtctcgatctcctgaccttgtgatccgcccgtctctgcctcccaaagtgctgggattacaggcgtgagccaccgcgccccgccaggaaatcctttcctactcttaacaacagatcaatagtcatctatattttcttcctaaaaaacctgatgatgtattatattcatacatacgtatttaatacatacaaaagggccagatgcggtggctcatgcctgtaatcccagcactttgggaggctgaggcgggtggatcacctgaggtcaagagttcaagaccagcctggccaagatggtgaaatcccgtctctactaaaaatacaaaaattagccaggcgtggtggcgggcacctgtaatctcaactactggggtgactgaggcaggagaatcgcttgaacccaggaggcagaagtttcggtgagccaagatcacgccactgcactcctgcctgggcgatagagtgaggctctgtctcaaaaataaaaaataaaaataataattttatagttaagttgccctgtgtttttcctgtgattaaaaaaaaaaatacctgttttgtatttaactttggggtgggataaggtatagcccacttagtcagttgtgtctaagccacttgatgaaccagtcaatccagtcttcacctttaacaaatgctgatttcttcaagtgagcaaaatatctcttaaactttttcctattttctctataaagttgcttttttctgaattttttctttatgaggcttgatgggcagccctatcagcagacaatcattcattcacccaacaaatatttgagtatctgcttcaagccaggggcagtgctaagccctggaagtggtatcttctccttatccgggagtggggctacagtgttcattccagaagactcaagaaaatagcagatcatcacaaaagtaggttttacataaatgaggaggaatccacagggttgtgtatatgtgtgtgtattttaaattctgacataagttggagctttagggtagactgtgacataagagtagtttgttttccaactcatgtaattgccggctgatttttgtcttgaattatgataatggtaacttctgttgaaacaattctgtattcatcttagcttggttgggatgcaataaaagttttgtactggtaaaaatgataattttcttccatgatgattttgaagcttttctgtaacacctgataaaaatagaggggccaggcatggtggctcatgcctgtagtcccagctactcgggaggatgaggtgagaggatcccatgagcccaggagttttaggctacagtgagccatcatcacaccactgtactcctgtactctagcctgggcagcctcgttctttagagtaagacactgtctctttaaaaaaaaaaaaaaagaaaaaagaaaaaaagaaaaggcttttagtgaatatatttttagggtagcaagtgtaatttttataaattgcattatttgaatctaataaataccctcaaagctgaagtcgaattctgattttgattgaaaatattttttacttaaaggaagagggatagaataaatgacacgattaaggaaaagacttcttgtataaggccggggttttttaaatgattttttgaatagttagatggacaatacggaattaaaaaggtggtgtaaaaagttatacggggctgggcacagtgactcacgcctgcaatcccagtactttgggaggccgaggtgggtggatcacctgaggtcaggagttcgagaccagcctagccaacatgacgaaacatcatttctactaaaaatacaaaaattagctgggcttggtggtatgcacctgtaatccagctactcgggaggctgaggcagaagaatcgtttgaacccaggaggcagaggttgcagtgagccaagatcgtgccattgcactccagcctgggcgacagagtgagactccatctcagaaaaataataatagaaaaaagttatatggggctgggcatggtggctcatgcctgtaatcccagcagtttgggaggctgaggcagcttgatcacttgaggtcaggaattcgagactagcctggccaacatggtgaaactccgtctccactaaaaatacaaaaattagccaagcgtggtggtgcgtgcctgtagtcccagctacttgggaagctgaggcaggagaatcgcctgaacctgggaggcagaggttgcagtgagccaagatcatgccgttgcactccagcctggacgacaagagcggaactccgtctcaaaaaaaaaaaaaaaagagttatattgtaaagtatctctgctaccctgccccaaacattcatttctttccctggaggcagccactattacctgtttctttaaaaaaaaaaaaaaattgtggccgggcacggtggctcacgcctgtaatcctagcactttgggaggtggaggtgggtggatcatgaggtcaagagatcgagaccatcttggccaacatggtaaaaccccatctctactaaaaatacaaaaaattagccgggcatggtggcgggcacctgtagtcccagctactcgggaggctgaggcaggagaatcgcttgaacctgggaggcagaggttgcagtgaactgagatcacgccgctgcactccagcctggcaacagaatgagactccatctcaaaaaaaaaagcgtgtgtgtacccgtgtgttaaatttttattataaaatatatataacaggctgggcgtggtggctcacgcctgtaatcccagcactttgggaggccgaggcaggctgatcacgaggtcaggagatcgagaccatcctggcgagcacggtgaaacctcgtctttactaaaaatacaaaaaattagccgggcatggtggcgggcgcctgtagtcccagctactctgagagcctgaggcaggagaatggcgtgaacccaggaggcggagcttgcagtgagccgagatcgcgtcactgcactccagcctgggcgacagaccgagactccgtctcaaaaaatatatatcgatatatataacaatttacagttttaatcatcttaactgtacagttcagtggcactgagtacattcacattgttgtacagccattactaccatccatctctacaacctttcgtcttgcaaaactgaaatttcatacctattaaacactaactcccacttctcccctttcccccaccccaccctctggcaactactattctactctttgtctctattggacatatttttgtgtgtttaggtttgtgtatatattttacatgtgtgtataaatacacaagggtatgtgggcgttgtgtttttacacatactataaaatattgtgcacatttgtttattttaatgtatcctgtagattatttagaatcggttcatacagagccgtatcattccttttaagggttgggtttaaatagtctgttatggatgtaccacaatttatttaaccagtttttaaattttttacttattttttttaatgtttttttagagacaggatcccactccatcacccagactggagtgcaacagcatgatcatagcttactgcagccttgaactccggggctgatgtgatcctcccacctcaggctctcttgtagctgggactacagggatgtgccgccatgcctggctaaattttttatttttatttttatttttatttttggtagacacggggtttcactgtgttgcccaggctggtcttgaactccttgggcttgagtaatcctcctgccttggcctcccaaagtgccgagattacaaccatgagccatggagcccgacaagagtagccttttatttgcagaccattagagaaaaagttgcgtgtaagtagataagcatacgaatttatcactgcaatactgtttgtagagatcacagagctgttaggctaggaagaagtttttagcagttagcactagaaagcaaaactttggaaacttccatttcatcaaaagtgacctcatctgagtagggcatgtgagggaaggacctttttactcgacaaggggaacttgccagttcttgtttgtgaaccttgaagaaagtggagcatttttattttgggaccattctaggttgtggtagttccttggtactcggggttggagaatctccctctgctgctggaccttctgcctcctcatgctgtaatatgcataagaggtgtcctagaagtattcaggaacaggctgtggttgctttgttgttctgtgactgttgaactctttatatagcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttcttttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatccacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatggaatgggagtcagctgtggtacaaagtacgctgcttagttctactgattttttattttttatttttacataagactttgatggtaaaggaagcagtgtgtgagcaagctgactcctgtcttgtcaagtaccaggtccactctgatgagcccctgtggacagcactgctgtaactccccaagcctgggctcaggaggtgggccctaagcgctgttcccagctcttcctccatgctgtcagctcttccaccattcttcctggcgtcattctaaggtcctgtcttcccccgccctcttccttcctggcttctacgctcagctcaagtagtagctgtttgggtacttttcacccagacttaggaaatgttatcagttggtcgtattcctgtcagccctcttactatggaactcaaataggacagattcagctgaattcccagccctgtggttgcactctttgtctgccctgcttccccaaggtagcctgctccctaaaggtcaccgagatactccccatgcaaggtttttgttgtattacacatgacaacatggaataaagtgttttgcaaatttactggatgatatcctactatgtggaacatcctacaacttactcttttcactcaacatttgacttttgaacctggtctgtattgctccgtgcagaccaatgttcattcatttgatatgtctccttgtgccatagaaatagttttacaatagaagcctgtccagagccatgagggagaaggggattgtagagaaacaaggattggcatctggtttatgtttacatcctttagtcctgttaaccgagaagaagatatttttatttccatgtttgcgaaagctttccacaaaaaaaagcatccattttctagacttattaatagggcagtccaaaggttttatttttagatttgaaagaaagcaaagtaggcttctgagatatgcacatttccctgtgtccctgtctcttttgcaacattccacattgctgctaaaacttgaacatgagcactttcaagcatgtgcttactttctatgtatgactcattttttaaaacattaaagcattttcggccgggtgtggtggctcacgcctatattcctagcactttagaaggccgaggcgggtagatcacttgaggtcaggagttcaagaccagcctagccaatatagtgaaaccccatctccactaaaaatacaaaaattagccgggcatggtggcgggcgcctgtaatcccagctactcgggaggctgaggcaggagaattgcttgaacccaggaggtggaggttgcagtgagcagagatcgagccactgcactctagcctaggtgacagagcgagactctgtctcaaaaaaataaaaataaagcattaaagcactttgtctggtggtatgtaagttttggcattacttagataagttgtattttaagtctttctacacacaataacttatttttaaaatacaagtttctgtgtacttccgggttttgtgtttttgtaaacagcagaaggtattagtccatattaagtactaatttgttctaatattttcagctgtttttggaattacacttggcaaaaaaatagacaaatgtctgcagttgtgacagtttgtttttttgttctttttaactccagaataaataattctagtgagtttttttcttggcttgtaagaacatgggaatgattagagtcatcataacacttaagtagttatagaaggttgaacatctgtagtcagttgtataaaatttcctagtcatccttccaggttgtttaagacaaacaaatacatagtatttattaagctcttataaattttaattgtaaaacatcattgtacaaaactttgaaaatgcgtataggtacaaagataaaaaattaggccaggcatgccatggctcacgcctgtaatcccagcactttgggaggccaaggtgggaggatcttttgagcccaggagttcaagaccagcctgagcaacatattgagaccctatctctacaaaaatatcataaaacaaaatagaatcactctggcgattccactatccaaaaaaaaaaaaaactgctgttaatatttggtatgtatctttctagaccaaggcctccaactttggttgagaattcagccgggtctgtgaccttggatgggaaaaacattcactctttattttcactaatgtctctgaaaacccagatttttagctgggcatggtggctcgtgcctgtaatcccagtgctttggaagcccgtggagggcagatcacttgagcccaggagtttgagaccagcctgggcaacatagcaagaccctgtcttttaaaaaaaaaaaaaatccagccgggtgtggtggctcatgcctgtaatcccagcactttgagaggctgaggcaggcagatcacctgaggtcaggagtttgagaccagcctgaccaacatggtgaaatcctgtctctactaaaaatacaaaaatcagccgggcatggtggtgggcgcctgtaatcccagctactccggaggctgaggcaggagaatcacttgaacccggaaggtagaggttgcagtgagccaagatcacaccattgcactccagcctgggcgacagagcgagactctgtctcaaaaaaaaaaaaaaaaatccacattttcttcaatgacaattgtaagcaacagatcatggtagtattagaatagcagtgactgtcaccagtagagatcaaagatactttcatatcatattatagttgttacagatattttgaaatatatatgtccatcactgcttcaaacttaaggtaattattagacccatctctagatctggttatttaatgatttactgaagaagcacatattatttgagaacgaactcttgaaatatgttgttaatttctgtgcattttacacatttcaaaacattcttctgaggaggggtccagaaggccaaaagggtccatggcagaaaaaggttaagaacacctgttctgtactttgtaccatgtggctacaaatataaaaacagacgttaagccgggtatggtgatgcacacctgtagttccacctacttgggaggctgaggtgggaaaatcacttgagcccaggagtttgaggccagcctgggcaacagagcaagaccccatctcttaaaaaccagtcagcacttgactagtcagttagtgggggaaaacacaggtacagtaaaaggagtcaaaattacacttaaacttaggtcatcttattatatcaaacatttattaacatgtttagtgttttgtgtatattatgcaaagtgtaatgcaactaaaactgtttaacacttctcgatatcacataaatttgttggtgcataatagcctaaaagttacttttgctgttggcattttattttattacttacttatttatttatttatttatttattttgagacagagtcacactgtcgccaggctggagtgcagtggtgcgatctcagctcactgcaacctctgcctccctggttcaagcgattctcccgcctcagcctcctgactagctgggactacaggtgcgcgccaccatgcccagctaatttttgtatttttagtagagatagggtttcgccatgttggccaggatggtcttcatctcttgaccttgtgatctgcccacctcggcctcccaaagtgctaggattacaggcatgagccaccacgctgggcctgctgttggcattttaaacatccttctagagtctttcttatttgcctgtaagcacgtacacatgttgttgttgttttgagacaaggtctgtcgcccaagctggagcacagtggtgcaatcacagctcactacagcttcgacctcttgggtgcaagtgatcctcccaatcagcctcccaagtaggtgggactacaggtgtccgctaccatgcccagctaatttttgtattttttttgtagagacggagtttcaccatgttgcccagactggtctcaaactcctttgctcaaacgatccttccgcctcggcctcccaaagtgccgggattacaagtgtgcacctctgtgcctggcccacatattgttttagatgaatgagatcatatatgtacttttgtaacttgctacctttcctcaacaaaatgttgtaaatatccatgtccataaaaatagacgtatatcttcacttttccctaaaatgaaaataacttaacttgcattttcttttttgtttttgtttttgttttgagacaggctcttgctctgttgctcaggctggagtgcagtgatgtcacagctcactacagcctccacctccagtttcaagtattccacctacctcagcctccaagatagctaagactacaggcacatgtcacgacgcctggctaatttttaaaatattttttgcagaaatgggatttcactatgttgcccaggctggcctcaaactgctggcctcaagtgatcttcctgccttggcctcccaaagtgctgggattacagtcgtgagccactgtgcccagcctgcattttcttattataaaagtaatacatgttcaatggacaaaaaattttcagaaaatatgcaaagatgaaaagtaaaaattgtccataaatctgtcatctacagataaagataacttctggataatgtttttctaccatcatttttagtaatcacataacatttcgttgtatgtctatgccttcatttaattaagaggcatttccattatttctgcatgttcatgactctgaatgatgatatgtctgcctgctgatggctacaaccctgtttctgcatttcaaacctctctcttgagctccagatttgatggcctcgtcagcatttacttgagttgctcataagtgtctcaaatttaacaagtcccagtcttgatttttttcccccttcaaacctattcctcatgttgtctctatttcagtaaacaatatcaacatccacccagttactcagtccaaaattctaggagtcatccttgattctgctctttctttttttttttttttttgagacggagtctcgctctgtcgcccaggccggactgcggactgcagtggcgcgatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcttttttttttttgatacggagtctcattctcgtcatccaggctggagtgcagtggtgcaatcttggctcactgcaacctccgcctcccgggttcaagcaattcttctgccccaacctcctgagtagctgggcctggctaattttttgtatttttagtagagatggggtttcaccatgttggccaggctggtcctgaactcctgaccttgtgatccgcccacctcagcctcccaaagtgctgggattacaggcgtgagccactgcacccgccctgattctgctctttctctcatcatccctgatctgtcagcaagtcctgttaggccaaccacttctcagcatctgcactgccagtatgctagtccaagccacaaaacacctctcagaggtacgcaacaggactttgttgttgttgtgtgtgtgtgtgttttttttttttttacggtagaattattttataacttgaagtgtagggatgaccttccttttaaaattttatttattttcttaattttttattcccatagattttaggggaacaggtggtatttggtgacatgagtaagttctttaatggtgatttctgagattttggtgcacccatcacccgagcagtgtacactgaacccaatttgtagtcttttatccctcaccccctcccaccctttccctcaagtccccaaagtccattgtatcattctgatgcctttgcatcctcatagcttagctcccacttatgagtgagaacatacggtgtttggttttccattcctgagttacttcacttagaataatagtctctagttccatccaggttgctgtgaatgccattaagtcattcctttttatggctgagtagtattcctttgtatatatatgccacaatttctctattcactttctgattgatgggcatttgggctggttctatatttttgtaattgtgaattgtgctgctataagcatgcgtgtgcaagtatcattatgcaacgggacttcggatgacatattgaacaacttcctcactgatatccttgtgaaacgctacatatttcatgggtctgtttgttataccaacactcaattctgaatgatggaattatttcacatttagtctctttttcatctagccattatagtttagtttaaacaccaagttccattcctgctgcatgctgaaggatttgcagtacatcaggctatagtccatcaattcattccacaattgagtaagtaaggtatctatagtacctcaggccctgtgttaggcagggatggggtaacctagacagatttggtacctgtcctcatggagcttgactttagcggcagagacagatcttagataattgtaccagtacttaagtgttcagaaggacaagtatggaggtgggagccactccagtcctctacagtcacgtgctgcacaacaacgtttcaaccgacaacagagcacacatacagtggtgttcccataagattagaatgccatatttttactgtaccttttctatgtttagatatacaaatacttaccattgtgttccagtgatctacagtattcagtatagtaccatgctgtacagttttatagcccaggagcaataggctatataccgtatagcctaggtgtgtagtatgctacaccatctagatttgtgtaagaacactctctgatgttagcacaaataaatcgcccaatgacacatttctcagaacatatccctgttgttgagcgactcatgactgtacaatgggggaacagctcagcctgccttccccaaggaggcaacgccgatgcagggaaccgagggttgaacagaagtgggcaaggtgcagagaggaaaaaggctttccagatggagaagagcatgtgtgaaggccctcagtctggcaagagcttagtcctgtgtggcaggagctgaacgaggggttaggggagagtggcaaagggtccgggccatcagagaggtcaacaggggctggatcatgcaggattttgaatgttaacatcagagcgatagaaaacatgaagggtaaggtggtttgggttttgaatttttatcaaaatattgcaactactcggcaacaagttagatataacaaaagaggtcatcgtaaaaacagcagtctaccccttccccttcccttccctgactcagacatgacagcttttaactgtttctgattttagttcctttgatggttacctccaaaattaaatcatatgcttatacatctttcttgatttgccaactttagggaactgtgttaactccctgaaatgaaagagaatgacttagcttacgttacctccccatgttgaaattcatattcacatttctctgtaattttttttttgagatggagtctcactctgtcgcccaggctggagtgcagtgatgtgatctcggctcactgaaacctctgcctcccgggttcaagcaattctcgtgcctcagcctcctgagtagctgggactacaggcgcacaccagtgcactgggctaatttttgtatttttagtagaggcggggtttcaccatgttggccaggctggtcttaaactcctgacctcaggtgatctgcctgccttggcctcccaaagtgctgggattacaggtgtgagctaccatgccaagcccacatttctctgtaaattttaaacagtattttagtccatatgtcagttcccctctttttaagataaggatattaataaccctacttttccttccactttccctccttaacttctgcgtcttaaaagctgtacttgaccatacccattcttgcatttgttaacatgtgtgttctgccctgcaaccacagccaagttgtagcttaattctaaagtcgaaaataacattatttacattattacacatgtgagtattgttcttggcgagaccaaataatgaatgtgcccaggattacatttccttctttacagatctggaccactcaaaggagaatgaccaatcaaggtcaaatggattcccttttcttagactctgtcacctgcttaaaatccttgctaggatttaatctacttcatattcaaaccttggcttgcttatatagctctttgttttgcccaccatttctagttgcctttttattttgtttactattcctccttgattatgttgtaaaatgctattagcagtgctgtttatttcgtacgattcggctttttccccactgaagacctttctcttggaaggcctctgcccttctgcaatctgggcaagtatctgctctttgatttaaggttgcatatacagctgtacctggaccttctcctcactgggctcttgggttggagcccgtgtcttaaaacccatatcttcctttcacatggtttactccctcgttttctggactgcatccttaaataatgtgctcagatagagtgcatggggagtaaactgtagtggataccgttgtcacctaccccatatccatttcttctttgcccattcctaacagaatcctgatattattcacctttctaccttattcccaacttcagaaaggatccttaagtcattccacacattgcattcctttggcaactgttactggtcaaggatggacatacgatctaagttggttcactcagactgaagggaaggacttccatggcacgttcagggaagactttctctttttctctcactggagtaagtgagaaaggtgttgctgggggctcttctgtaacctcagactgagggacaaagcctgaggataaagcctgctcaccaaggaaggcggagcagagaaacgggaagaacctgggtcttgatgccgttgcttagctggtgattgcactgtggctggggcctgtcctacctgagctagggactcagataggatggactttcttactgaatgagccagcttcagttttcttttctgttacttgtaaccaaaagcattgtaacagataggtcttctgagtcactgcatgcctgaaatacctttcttctactcttacacttgattggctgagtatagggttccaagttgaaaatcattttttctcctaactttggaggcatctcttctagtatgcagagtaacaaatgcaacaaatgcctgatgccaatcttattatggttcttttgtaggtgcccttcttttctcttccttccctggaagtttttaggatttcgtctccttatttttagtgtcctgaaatctcatgagaatatgtctagagttgtgtcttgttcactcgttgtactgtggtcattcaatctgaatacttttgtcaactcttttttttaaaaaaaaattactaatttacatgctttcattttctctatggggactactgtttaactttggacctcttatattggtcttctgtcttctctcatatttttcatttattgggcggtggggggtgctctgaattttggaagatctcctgcatttattttctttttccttttttctttttttttgaggcagagtcttgctctgtcacccaggctggagtgcagtagcctgatctcggctcactgcaacctctgccttccaggttcaagcaattctgcctctgcctcccacgtagctgggattacagacctgcaccaccacgcccggctaatttttgtatttttaatagagatggggtttcaccatgttgccaggctggtctcgaactcctgacctcaagtgatccgcccgcctcagcctcccaaagtggtgtgagccaccgcacccagcctcctgactttattttctatcccttctgttaaattctttatttcagccaaacctttttttttttttttttaacttactgtgaagcctgtgtgcctactgcctagattagacaattgttaacattttggcgtattttcctggtctgtatagatagggtgcatttttatacctttttgctcaccatttaaaaggaactcacagatgtcacgacatttcacccctaagtacttcagtatacatctcctaaaaataaggacattttccaatataagcacaataccccgatcacatctttaaaagttaacaataattctctaatgttatcaggcacccactttaaattcagatttcctccaaatgtctcttatcgctgttgaggggctccaaagcaattaagatttatacattgcatttgaatatgcttcctttgtctcttatttatttatttattttattttgagacagagtctcgctgtctcccaggctggagtgcagtggtgtgatctcagctcactgcaacctccgccttccaggttcaagcgattctcctgcctcagcctcccaaatagctgggattacaggtacgcaccaccacgcccagctaacttttttgtatttttagtagagacagggtttctactaaaccatgttggccaggctggttttgaactcctgacctcaagtgatctgcccgcctcggcctcccaaagttctaggattataggcgtgagccaccatgcccagcccctttgtctcttttaacaagaacagcctacccacctctccttcacttgtgatactgactttttgaagcagtcagcccaattgtcatctagaagggcccacattttaagatacatatttttagagatggcgtgtcactatgttgcctaggctggccttgaactcctggcctcaagtaatcctcctgcctcagcctcccaggtagctgggactacaggcttgtgccaccacgactagctggcccacattttagatgtctctcttttcttgtgatataatttaacttgtttgtccatatatattacttgtagacaagaagttaggtctacaggcatgttcaggttaaacattttgggcaagaatatttcataggcagtactgtgtacttcatatagcatcagctcaccaggcacttaatggttggttaccctgtggtttgtgatgctacgttttaacacttgattaaagaaggaggtgactgccaaatctccccattgtagacatacagttttcctgtggtaattgatatataatctgtgatgtgatgctttggcaccatacaaatatcctattgcccaacagccatttgcataattattttagcattcattgatccttgcctgaaaccattattacattgggggttgcaaaatgatagtttttttaattgtcacctcttctacatttagtactgtcattcctctgtaatgaattttccctcatcaaataaggaggcattatatttcctcctaaaaagacagtatagatgcttaatctttgcctttattacatttcagagtaaggagttggtagaataatcacctcaaatggtggcaaaatatttgctgttgtgtttccttttctctttcatgtcaatatggactcatagggatttatttattaaatgttttacaattcaaattgggtcaacaagagtcccttcatgttggttcctatattctcctggcataccctcattaattagtctttgagcaatttcttgttttctggcacaagatattccatcccaatatgtgcttttcgtgtcctagaactgattccaaggagctctggttccttatagtggcaacggtatttagaatccaacatgtgggtactaaatgtgctgattcttactggggtaacattatatctaggcactttcagaggacatcgctagaaaatatattcagtttttattttttatttttaatttttttgtagagacaaggtctcactatgttgcccaagctggtttcgaactgagctcaagcgatcctcccacctcagcctcccaaagtgctgggattacatctgtcagggcaaactgctggtaaatattttcacaaaagaaaaataaaaaaaccaaagtgctgggattacagatgtgagccactgtgccctccattttttttttaagtcataaatacataatgatgtcttctatggcaatttaacattacagggttcttccttaacttttttttttttttttcttttttttgaggcagggtcttgctctattgcccaggctggagtggtgcagtggtacaatcctaattcactgcagcttcaaatgcctaggcttcaaacaatcctcctccctcagcctcccgagtagctaagactacaggtgcatatcaccatgcccagctaatttttaaaaattttttgtagagatggggggtctcgttgcgttgcccaggctggtctcgaactcctggcctcaagtgatcctcccatctcgatttcccaaagtgctgggattacaggtgtgagccaccatgcctggccaacttttatttgatctgtatatatcttttccttacactgaaaatgttgggtcttactaatgttaacatagttacttatttgctttatcttgtaatagacataaaattacaaaattataataccaatattacgataaatagctgggcatggcggcgctcgcctgtagtcccagctactcaggaagctgaggtggagggactgcttgaacctaagagtttgaagctgcagtgagctgtggttgtgccactgtactcctacccggacaacagagtgagtggggggaaaaaaaagaaataatggaagatccagagaaagccccaaatatttaaaaattaaacaatacactttgcagcttcctcacctctctcagccttcatagaattgaagagagttagggccttgcactagattaggctttgccttaaggaaatgttgtgtttgatttgatcttttatccagaccattaaaacttccttaacgtttattagtaataaggctatttcactttcatatcatttgtgtgttcactggagtagcacttttagtttccttcaagaactttgattcacaacttggctaactttggtacaagaggcctagcttttggcttctcggctttcaacatgcctctcactaagcctgatcatttggtttttggtttaaagagaaagacatatgactcttccttttacttgaatgcttagaggccattgtagggttattaattggcctaatttcagtactgtcttgtccaagggaatagggaggcccaaggagagagagagagatgggggaacagctgattggtggagtagtcagaatatacacatttatcacttaagttttgccatcttttctttttctttttcttttttttttttgagacagtcttgctctgtcacccaggctggcatgcagtggcatgatctcagttcactgcaacctctgcctcctgggctcaagcaattctcctgcctcaacctcccgagtagctggtattacaagcgtgcgccaccatacccagctaatttttatattttttagtagagacagggtttgccatgttggccaggctggtctcgaattcctgacctcaagtgatccacccgccttggcctcccaaagtgcggggattacaggcgtaagccactgccgcctggccaagtttgccaccttttttattttttttattttttgagatggagtctcactccatcacccaggctggagtgcagtgatgcaatctcggctcactgcagtctctgcctcctggattcaagcgattctcctgcctcagcctcccgagtagctgggactacaggcatgtgccagcacgcccagcttgttttttgtatttttagtagagacggggtttcaccatgttggccaggctggtctccaactcctgacctcaggtgatctgcccggctcagcctcccaaagtgctgggattacaggcgtgagccaccccgcccggccaagtttgccatcttttatgggtgcagtttgtggtgccgcaaaatgatgatagtagtaacatcagagagcattgatcacagatcaccataacaaatataataatgagaaatttgaaacattgtgaaaattaccaaaatgtgacagagacatgaagtaagcacatgctattggaaaaatggcactggtaaacttgcttgatgcagggttgccacacaccttcaatttgttaaaaactcagtatctgcgaagtacagtaaagcaaagcacaatcaaatgaggtgcgcctgcatattacaaccaagaggcttttcgcagaaacacgagtgtgcttcaacattcaaaaatcagttggtgtaattcaccacattaagataataaaggaggccgggtgcggtggctcacacctgtaatcccagcactttcagaagccgaggtggacagatcacttgaggccaggagtttgagagcagcctggccaacatagtgaaatcctgtctctactaaaaatagaaaaattagccgggcagggtggcacgcacctttagtcccagctattcgggaggctgaggcaggtgaatccttgaaaccaagaggcggaggttgcagtaagctgagatcacgccaatgcattctagcctgggcaacagtgagacccagtatccaaaaaaaaaaaaaaaaaaaaaaaagataataaaggagaaaaaccatatagtctattcaataaatacagaaaacgcatctgacaaaattcagtgccctttcatgataaaaattcagcagattagaaatagaggaagtgcatgtatgaaagagctacagatagattgtacttaattgtgaaatattgaacatgttaccccgaaaatcaggaaaaaggcaaagatgtccactctaaccacttctattcaacattatactagaggtcatagccagtataatgaggcaagaaaaaacataagaggcattaatatttaaaggaagtaaaactgtttctatttgtaggtaatgtcgaaaatgtgaaagaaactatcagaacctgctagaactaaaaagtgaattcagcaaggtctcagggtacgagatcattcaaaaactaatcagaaatgaaatttcaaatgcaatatcgttaggaataatttaataagaaatgtacaagatttacacgctgaaactgaaaatgttgctgaaagaaattaaagacctaaataaatggaatgttgtaccatgttcatcagctgaaagactaagtgtctttacagtgtcagttctcccttcattgaactgtagattcataaccccagtcataactgcagggttttttttgtagaaattgattgtaaaatgtatatggaagctgggcacggtggcttatgcctgtaaaccagcactttgggaggctgaggcagacagatgacttgaggtcaggaatttgagaccagcctggctaacatgacgaaaccccgtctctacaaaaaatacaaaaattagccagacatggtggcacacacctgtaatcccagctacttgggaggctgaggcatgagaatcacttgaacccggaggtggaggttgcagtgagccaagatcatgccactgcacgcccgcctgggcaacagagtgagactttgcctcaaataaataaataaataaaacgtatatggaaatgcaaaggacctagaacatccaaagtaaacttgaaagagaacaaaattaaggggcttatgtgatgtgactttatagtcatttgatttttaacagaggcaccagaacagtccggtgcgggaaaggaaagtcttttagcacgtgccggatgatggcaaatgacatccataccagacaaaaatgaaccttgaccttaccctaaatattagtttcttagagttgccacaaactaggtggcttaaaaccacagaaatttggctgggtgcggtggctgacgcctgtaatcccggcctttgggaggccgagtcgggcagatcacctgaggtcaggagtgcaagactagcctggccaacgtggtgaaactttgtctctactaaaaatacaaaaaacttagtcaggtgtagtggtgcacacatataatcccagctagccaggaggctgaggcaggagaattgcatgaacctgggaggttgcactgagccaagattgcaccactgcactccagcctgggtgacagagtgagactccgtctcaaaacaaaaccacagaaatttgctgtctcataattccagagtctagaagtccaaaatcaactgtcatcagggccatggtctctgtgaaacctgtaggggagtccttccttgcctcttcctagcttccagtggttggcaacctttggcattctttgatttgcagctgcattacttcaatatctgtcttcctcatcacacagcattctccatgtatgtctctgtctttacatggcctccttcttgtaagaacaacagtaatattggattggggcctgccctactccagtgtgacctcaccttaactaattacacctgcaacaacgctgtttccaactaaggtctcagtgtgaggtactgagggttaggacttcaacatatcttttttgggggacatagtccaacccatgacactacttcacaccatacataaaaattaattcatgagagattatagacctaaatgttttaaaagctaaaaatataaagcttctgcaagaaaacataggagaatatctgtgcagtccaaagaataaggttttttttaaacacaatttcactctgttgcccaggctggagtgcagtggtgcgatctcagctcactgcaacctctgcctcccgagttcaagcgattcccatgcctcagccttccaagtagctgggattacaggtgtgcgccaccatgcctggctaatttttgtatttttagtagaggcagggttttgccatgttggccaggctggtctcaaactcctgacctcaagtgatctgcctgcctcggcctcccaaagtgctgggattacaggtatgagccaccgtgccaggccaaaaaaagatttattaggatacatgaagcaatagctattaaaagaaaaaataaattggacttcattaaaatttaaaacttttggtcctcaaaagataccattaagaaaatgaaaagacagagctgggcgtggtgaggcttgcctgtagtcactactgggtacttgagaggctgaggcaggaggatcacttgagcccaggagttctaggccaacataggcaatatagtgagacagtgtctcttaaaaaaaaaaagaaaaagaaaaaacaaaagaaaataggctgagagctgtggctcatgcttgtaatcccagcactttgggagtacaaggcagatggattgcttgagctcaggagttcaagaccagcctgggcaacagtgaaatcccatctctacaaaagatacaaaaaattagccaaccatggtggcgtgcacccgtagtccatagtcccagctactcgggaagcagaggcaggaggattgcttgatcccaaggaggtcaaggctgcagtgagctgaggtcgcgccaccgcaccccagcctgggtgactgagtgagaccctgtctcaaagaaaatgaaaagacaagtccaccaagaaaacagttgagaccagtcatagaaaaaatagaaagtcatatctgacaaaggatttgtattcagaagaattcctataactcggtaataaaaagacaacctgatttttaaagggtgaaaatattttaatggatacttttttttttttttttgagacagagtctcactgtgtcacctaggctggagtgcagtggtgccatcatacatagctcactgcagactcgaactcctgggctcaagtggtcttcctgcctcagcctcctgcgtagctaggactacaagcacgtgccactatgcctggctaatttttaaattttttgtagacatgggctggtgtgtgtctgtgttgtctaggctggtcttgaactcctgggctcaagtgatcctcccacctctgccccccaaagtgctgggccaccacgcctggtgtggtgtcaccagagatgagccaccatgccctgcctgatacttttcttttatcatctgtttatttcttgtttatgggtgtttctgttctgattttatgactattctgtattctaagatttctctgagaatattatttgtttcctctaaggacagacttggtctctcttccatggggctggttcttgagccgccagggatggggggaggacctgggtagctgctgcgctgccccttctctgctgtggtggagtggcccgttgcctgcggggtctgtctctgaagggtggtttggagaagttctgtggaggcgaggcaggggtcagctcttgccccatggaccctcagagactgggaaaaggtaggcatcacctgggctgctgccagccacatcaagagcctttggggtgggtggggtgggggccggggaagggaaggttctagctgttgatttagaaaagacccattgatttcttgcctgagggaagaagtggcaccttgccactccaagtttgctctgctcaccagccccaacagcatcagcctcacctgggagcttattgaaggtgccctgccccaaagcttgtgggtcgggatctggcagtcagcagcccccaggtgttgcacacatgacagcactgcttgcccctcctctcgtctggtctggtctggtctggtctggtctggtctgagagcttctttggggctctgacaggtatacaggctctcatctgctctacagctctcttgtagtacattcctctctgttccattagtcaacatgttcttgcctacttccagcatctagaaatttgctgagtgtatcttatccgttcagaggtcctctcctgctattgcctctgttagaaatttcttccctttcatatgtctgtacttcggtttctttgaggtttgaagggtcaagtggcaattacatgtaggcagttggccatcctctggtgaaggctttaaagcccaggaataacaagatccattatgtctaaaactagcaaaaaccctacctgtcacatggtgaactgaattagaggtgatggggacagaagccagattggagtgagtggaaggtgagggagtggagattgggtatagacaactctctttaagaagttttgttgtgatggtgaccagaaaaataggagtggggtagagggggatgagggtgtttttcacgtgggtgaatatgagagcatgtttacatccttctgggaatggcccaggagagaggggagcgtgagaaggaggaaatggggacctggaggagcagactccttgtgtggaggggggaagcggcatctagagctgttgcaggaggtgggctttgagtaaatgcttcctctttggtaaagacggggaacgggaacggtagaagttgcacggaccctttgttaaagctcagaagctgagcgagaattagagcttaagtttatggagtagtcagaataaagtacccctaactgtattcttgcacagtgcaggaagccaggggtctgaaatcaagatgttgcagggctccattccccccagagcctctagcatggatccttccttgcctcttccagcttttggtggctgcctggcagtcctagactttccttggcttgcagttgcattgctccattctctgcttgtgtcttcacatggccttctctgtgtccccgtattcttctctggatgcttgtcactgtattaggcccaccctaaatccaggatgatctcatatcaagatccttcacttaattacagaagcaaagaccttccaaataaggtcagagccacagggtctgggggttaagacatacacctaactattcggggctaccatcgaacccctgtagaagcctgtccatttccaggatagcagagcccaaggaagggccagaagtccccccaaaacagttgtttgcattcaccagattctaagctataagcagatgggcagtggcagtcggtcctaatccatataccattggcaacaatagtttagttcactgtagacataatgagatgcttatcttctgctaagtagtcctcatggtaacagccatattactcctggctttgagtgacagcgctgtgctcttgtctggtgcccatatacttcagcagctggaaacaagacagtgctcatgattcaccggaaagtttctgtagttaaaatcaagtgatcccttgagtctattctaatatttgtctgtaccatgttctgtgacgagacatggaaacaaaacattaagaagtgaaagtatctttgattatgctcttgaagacaactttttgtttgtttgttttgtttgagacggagtttcactcttgttgcccaggctggagtgcaatggtgtgatctcggctcactgcaacctccgcattcccgggttcaagcgattctcctgcctcagcctcccaagtagccaggattacaggcatgcaccaccacgcctggctaattttttttattttagtagagacggggtttcaccatgctagtcagactggtctcaaactcctgacctcaggtgatccgcctgcctctgcctcccaaagtgccgggattacaggtgtgagccaccgtgcctggccgaagacaactttttaaagatgcatatgctctgggctgggtgtggtggctcacacctgtaatcccagcactttgggaggccaaggcgggcagatcacctgaggtcaggggttcaagaccagcctggccaacatggtgaaacaccgtctctactaaaagtataaaaattagccgggtgtggtggcgggtgcctgtaatcacagctactcaggaggctgaggcaggagaatcgcttgaaccccagaggcggaggttgcagtgaattgagactgtgccactgcactccagcctgggcgacagagtgagacttggtctcaataaataaaataaaataaagatgcatatatgctctgaaggctggctacattttattttttctcaaacaacttttacagtggatagtgctgtaaaagttgtttagctctggtcattttatcttttttgtgatctgcaaaaggagatccttttccttttcactgcctctaatacccaactccaatactcctttgacctcacaggcacttagaatccatcagtggctccatcttttctcagacttcacctccttcgtatccttattcctctcctttgtagcttcagtgccagtcagacgtcgttactccctggcacactacctcagcccttcggcactttcttgctttgttatattcagtcgacaaagccccagcctcatgaaattcagtcatgtctgccccatgcctgctccgtcctgaagctgaatgtgactccttcattgattccccctttaagttcatgtctaccccaggtaaacttcttgccgccaagcccacctgcatactgcagttccccggtctctcctagcccctcccaccctcctcatcagctgtcacacctccttgcagctgatatcttagttcccagagagcacagaagcaagctcaagagagtgtctacaggccagcgtctactccttcgctctgcctccctcatgctgtcacggagcgcctgtcccaggccctcactcctgttctaaggcatctctccagtcctctactgcactctcccccatcagagattcctccctcgcctgccctagaaacttgttgctacttctcccaccttgacaaaagctgctcccaaccccccacctgtctagcatctctgttttcctttaccagcaagactccagtccctgtctccacaccctcttcaaccttctccagttgttcctttgctgccacagctctgccaagctgctccatgaggtctccagtgatgaccttcatgttgttaaatctgggagctgcttgtcacttcttttcccagagctgtcgtcgtcagttaaccccaatacccatacgagacaatcctttccctcccttgagtctctgcactgatgtgcaccttctcagtgcaaaccacagcttttgtctctttctagctgaatacatgactgactgtgcttatcttagctgtcacccctgctggagcagaagctccacaggacaggattgtctccttgattcacagatgtagctcaagctcctagaacagtgcctggtgtctgtgggtcctcaggaagtcctaggtgagtgtgtgaatgtctgtcctcctcggtcttttctgtttcgcatgtgatgttggaaggcctcaggttcaggcttttcttctccaccctcactcccgaagtgattccgtccagcctcatggctcccaaatttatgtctccaggctgactgggtcacgggaactccttatcctccctagaccttctctttccctggtcttctcctttccagtaaacagcaactccaactcctgctcctcaggccagaaacctggcgctggttacctcatttgttcacaaatactgttactccacctgcaagatggatacaaaatctcatgagttcccctgcctccatggcccccaccctggtccaggtgtccagcttccctgcctctgcccttgccccctggttctttgtttagtcctgcaatattgtgctcttctgttcagaaccctccagtgggtccctgcttgctcagagtcacagcccaacaggatcacctctcttgccactctcccaccactcatgcactgcggcctcactggcctcctggctcctccctggaccctccaagtatgcccctgcctcaaggccttgacctctcctctgccctctgtcccaggtatcacacatgtctgctcaagtgtcaccttcccaatgtggccttccccgagcacacccatgtctgtaagtcaggcagcctgcctctgccccaccagttccccctgcctagcataggacttgtcaccatctgccacaagctgtgttactgcttggttttgtttgtgctctcccactcccttcccctccctccctctccccacccctatagaatctgagtcccatgaggacagagatttttttttttgcctcttcctcaatatatccccagtgcctagaatcatgcatattttaatttattgagtgaattaacaaataaattctgcagtgggacattgctctaaggttttgtcttataagagggacagaagaacatgcagcctgctctgctgttggctccttagcttctccatggctaacaggaacaatattgtttatgagataatcaaagccatagtcatgagttagaaggtacatataaaggcaaatatgtggagattgagttactttggcgggggcggaggggtgtgtagttatctgaaaacatggaacaaatcaatgagagtctaaatagcacccacatatttgcccctcttttaaaacatacctcctttatgagtgtagaatttaacagcacagtttcccagtgcagctttgcgaaacaagagaaatgaattttaaaggctgtcaggtgcctttgcaatctgtggcttagtatttgtgtaacaacatttgtgttttgccaacagatgtactgcttaaagtacccatgagaatggcctctgtggttttctactttctcggatggaaccttaggaactgattattgagaagaggctgatactgcccacctcagctcccaggcaggcttcagggccttggttactactcctttgggccctcactgacccttgcagacgtcttttgcaacctctgtagccagaagagacaactgctttctggcatgttgctctttccctaatggctttatgagcttcttgaacaccaaagcatgtgtgacttcctcacgccttcccctgtatagtatagcacccctaactgtatgtgtaaggagaaggagtgagcaattgatggcgtccccctggatctccaagggaatgggaaggggcagggtttctggattcagtcatgtggaatctggtcgttggtgtctaaatgtgcctgttacttgtgcccaatgtccaggttcaccaggaggcttagcctgctcatttccctgctagtagctatattttgggagagcattttttatgctctaattgaactttgtgggtctcagcaatttgaacaatgttttgtttttcttctggtcaggttacaaaggaaagaaaaggaatctggtgttgtaggaggtggtgtgttgtgtaattacttgttttttttttttaagtttttttatatttttgcaacaaggcaagttttctttgaataaataatgctgggagcttatcacatagaaggcatatgtgttgtactcagtacattctgaattatctgggtttatttttatctcttgaattcacttataaacaattcaaaggctgcttttttagctaacagaaataggaagagaatctcagaatctgttttgtcattttttcaatgggttgagttatagtgattatgctaactcggtggaaaagcagtgtagtgagtaaaccccacatacggcatatcatgaacattttgttgcttttttggcttctgaccatcttcatacctttttttgtgttaaaagtctccccattgtgtatatcttagtaagaggcaggtggaccctagtttctacctaagaaaacctgaagatggggttgggggcctgtggtgtacttccttctcatgctgtccatgaccactgcagtggctttgtaaggatccaggacccagggcccctcagtgggtgtcttccatttctcaagattgcctcttggttgtgagatgacggttgctgctctagtcattgcatccactcctccaggtaggaagaaagaggtcataggggaaaggcaaaatggcacttgacatcttaacttctaggcccattcaatatttccatttccatcttcacacccatcatcttgtcctagggaacaaacagcaccagcagctcagtagctataacagcaattattatttctcacacatgggtctgggtcagctgcaagatgggattcagatctgttctcaagcctgtcgttccaggacccaggagggagaagcagctgccaggggaagtctcttcgtaggcggaggtcaggagtccaagaggagtgagcagagtcacagaagcctcttaaagcctcttcttcccccatcccatcaacacgtgagcaagcccagagtcagtgggtgggaggtgtgctccgcccatagtcagtagaacaagagcaagcttgaaagagaacgatgaacaggagtgcactcggccactgtctccttagccataacgtagtcccatggtctgctgggaagcggggaataactctccttagctgagcgcagggtctcattagtaaggcagatggagaacatggatgttgggggacaactggcagtgcctgccacaggggaatggatatattccctccccttgctctctggaaactaggggatggcgatgaagcctaggtttggccaaacccattctgccttcagggactttgactcttgagggacagtgagggattagtcatggtggtggcagttgagtcacaaaaccagcagtggtggctaatgtccagtgatgacatgcaacagtgcccagggtgggtgtcccaaccagcaggtccctgcagtataaccttggctgtgtttgcagtggtgcagcctctattcctgctgcttttctgagcctagttctctagttctctctccatttccagatctgctgcccaagaactcctttgtgattgaatttaaccagagttgatttctgttgcttgaaactcaggaccttgatgcagtgtgcagggtctgggcaaggtaaaaacacactttcatgatttcgcctcaagtatagtagatgagcttaggctttttgagccaggtagccttgggattaattctcagctcttgcacctagcaggtgacctcagcaatcaagtcacttgccctccttgagcctcagtgttgccctcagttaaacattgctctcgtgtgttgctgagcattcagtgagattgtatataaagtgatcattgtgaaggtattgggacataatttgggaaagcgtcctggtctaagcttttgattggctctccatcatttgggtaatgggatagtgatttaggagtatcatagcagctcaaggggcccttctggaaagggtatgaggaaggtcagggacaagtctgaaatgaatcatcctaggcttaatgcctgtgactgggcagtgggtacaattatctcaggctagtcagtagtcatttattgtgagaatacatgggcagattttttaatttccttctcagtctagacttgaatgcaaacagttcttattgctaacttaccactagtcaccactaatgaacaaagactatgaacaggaaattcataaaagaagagatacagatggccaatgaagataggaaaagagttctgcctgctggtaatcaaagagatgcaaacgagaacaaaaatgatgccttttcacctaccaaatttgtcaagattaaaaagaaagcaaagagccagcgtcagctgatgttcatacctgcacctgctcggtagcttgctaatgttctgcctgctccacacgccaggccagcctccacggcgcagccaggtgaggcctttccttgtatacaggcacgtttggattcactgttgcataagtgagacatgtgcatgcttcacaattcaggaagtgcaaactccagagtgatgcaaggtctgagtgtccctgctgccctggtctcccagctgcctaggcctctcttcagggaacggctgcatccagggtcttgtctgtgtcttttgaggtgttctatgtacacgcagacacatctaaacctatttttattttccctgcacctgcttgggctactgtaagctgttaaatttttttttctaggaatttgtccattttgtctgactagcataaagttgttcatgttatagtttatacatttgcaacatctgtaattatgtctgctttttcattcctagtgtttgttgtttacttgtaccttctcccgtttttccttgtcttggtaaaagctcattaggttcattggtcttacaagaagcagacatgtaggcattattgccctgtattactctgtgtctcttttctagttcattaaattctgcttttgcttttatctttattattttttctatggtcttagagtacattctctgtgttttgttgttgttgttgttgttgtttgttttttgttttgagagagagagtcttgctctgtcgcccaggctggagtgcagtagtgcaatctcagctcactgcaacctccacctcctgggttcaagtgattctcgtgcctcaacctcccgagtagctgagatttacaggcatttgccccacacccggcaaattttttgtatttttagtagagatggggttttggcatgttgaccaggcgggtctcgaactgctgacgccaggtgctccacccgccttggcctcccaaagtgctgggattacaggcatgagccaccacgcctggccctaacttcttaagttataaatttggttcattgatttttctacccttttttcaaatgtaaacatttaaggctaaccctctggaactacttcaactgtatctagcaagttctgatagtattgtcactttaagttagcccaaagatattttaaattttctttgtttcttcctttgactcacatattattttaaaatgtgtttttcaatttccaagcacatggctttgggtttgttttttttttttcctagttgctctagaaaaaaaaattgactgcatgaggtggctcatgcctgtaatcccagcactttgggaggccgaggcgggcagatcacctgaggtcaggagttcgagaccagcctggccaacatgccaaaacctcgtctctactaaaaatacaaaattagccgggcatggtggcacacacctgtagttccagctactcgggaggctgaggcaggagaatcacttgaaccgggaggcagtggtcacagtgagccaagattgtgccagtgtactccagcctgggcaacaagagcaatactccgtctcaaaaaaaaaaaagaaaaaaagaaaaaatcaacttctaactaaatggcactgtgatcaaagaacttggtctgtgtgacaccagttcttgcagttggttgagaagtgctccatgacacattatccacaaccagtggacagaatatgtcaccaccaagcatgggtgcaggattctacatatattcattacctctgtcttatccgtttgttgtgaaagtattttctcttcttactgtcattttgtttacttgatttatcaactgatggaatacgtgttaaaacctactgtggtgatggacacatcagtttctccacagagtttggtcattttcattttattatttattttgaggccacattttcagttttagatacagtttcacattcctggtgtattgaaccctttggtattatgaagcgaccatactaatatgttatttttttttaaattattatttattttatttatttttctttcttttttttttttttgagacagggtctccctctgtcacccagtctggagtgcagtggtgcaatctcagctcactgcaacctccgcctcctgggctcaagtggtcctcccacctcagcctcctgagtagctgggattacaggcttgcaccagcgcgcctggctaagtttttgtatttttagtagagacagggttttgccatgttgcccagactggtctcaaactcctgggctcaagcagttcaccagccttggcctctaaaagtgttgggattacaggtgtgagccaccacgcccggccatcccagttttttattttcctcctttctgtgtctttatgcatcagtgaggtggagcttttgaaaatgtcagatagctagattttttttttttgagacggagttttgctcttgttgcccaggctggagtgcaatggcgtgatctcggctcactgcaacctccacctcccaggttcaaaacaattctcctgccgcagcctcctgagtagctgggactacaggcacgtgccaccacacccggctaattttgtatttttagtagagatgtggtttcaccatgttggccaggctggtctcaaactcctcacctcagctgatcacccgcctcagcctcccaaagtgttggaattacagacgtgagccaccatgcccagctgatagctagattttttttttttttttttttttgagacggagtcttgctctgtcgcccaggctggagtgcggtggcgcgatctcggctcactgcaagctccgccccccgggttcatgccattctcctgcttcagcctccagagtagctgggactacaggtgcccgccaccacgcgtggctgattttttttttttttttttttttgtatttttagtagagacggggtttcaccgtgtcagccaggatggtctcgatctcctgacctcgtgatccgcccgcctcagcctcccaaagtgctgggattacaggcgtgagccaccgcacccggcctcgagattttttaaaaaatccattgtctgtttcgtcctttaacatctatttgatttctgatgtatttagattcatttatagcatatttgtgcattctatttttccatattttctgttcttttaaattttccttctcctttcttgccttctcttagacttttaaaaaaattgtagtaaaatacacatcacctaaaatttaccatttttaaatgtacagttcagtggcattaaatacaaattggaggccaggcatggtggctcatgcctggaatcccagcactttgagaggctgaggtgggaggattgcttgaacctggaggtcgaggttgcagtgaggtgtgatcacactactgctatagcccaggcaacagagtgagaacctatctaaaaaaacaaacaaacaaacaaacaaacagattggcatcacacagtgtgtgtgctgctgtgctgtgctgttatcatttaacattaaaacataaacatcagcactgttatggactgaatgtttgtgtcccccaaaattccagtgttgaagctcaaacctccaatgtgatgttatttggagatggggtatttgagaggtggttaggtttagatgaaatcaggagggagggtgggtttcgcatgatgagattagtgtccttataacaagagacagcagagagcttgctttctccaccatgtgagtatgcaatgagaaggcagccatctccaagtcagaaagagagccctcaccaggggctgaatgtgctgacaccttgatcttggacttctagcctccagaactgtgagaaatttcagttgaataggccccccagtctgtactattttgttatagcttgagcagactaatacacccatgttatgaaaagctataaacatccctttaaaggccacctaacgcgtcgtattacctcatgcatcttctctgctgagctttccaaaagagtggcttaggctgggcctggtggctcatgcctgtaatcccagcactttgggaggccaaggcaggtggatcacctgaggtcaggagttcaagaccagcctgaccaacatggagaaatcccgtccctactaaaaatacaaaattagctgggcgtggtggcgcatgcctgtaatcccagctacttgggaggctgagccaggagaatcacttgaacctgggagatggagggtgcagtgagccgagatcgtgccattgcattccagcccggccaacaagagcgaaactccatctcaaaaaaaaagagtggctggccgggcgcagtggctcacgcctgtaatccccgcactgtgggaggccgaggtgggtggatcacgaggtcaggagttcaaaaccagcctggccgagatggtgaaaccccgtctctactaaaaatagaaaaactagccaggcgcagtggcaggcgcctgtaatcccagctacttgggtggctgaggcaggagaatcgcttgaacctggggggcggaggttgcagtgagccaagatggtgccactgcactccagcctgggtgacacagtgagaccccgtctcaaaaaaaaaaaaaaaaaaaaaaaaagtggcgtatgttcccggtctccacctctcattcgccagcccctgtgaccaaacccctgggattagatctccatcgggtccctcccctcaccctaacctcacatgcagtggttcctgagaagctgctgtttatctgatcacgggatccagcaggatctgagggctcattcactgaatctgtactacccaacaaggcaggcttgtccttacccacacttttcaggtgaaaacttaatcagattcaagcgtttatcttagtggcctcttcgtggtgtgtgatttccttcttgcagctctttactggctaaaactcttcactgggagttaaaccaggtgtggtccttgaccctcatcattttgtcccatctcctatgctgggctctgtatccttgtctccaagcagtctcgtgtgacagggaagttacctattattgtatggtcccctcttcttgtcacctctggtgtggcacttgttccatttcttgttcaatgaatgtgatttgtgaatgtgccacatctgtgggaggaaggcagttcgcagcaagagttgtagttcccttgctttgccctgagggccaggactttacactagatttttttgttgcattcctgcactcataaagtacacgtaaacttagaggtggtgtgttaaatgctagaacttaaaactgagttcagctaggctcaagtgccccacaatttttgtcccaccagacaatttcatgaatatctacagattgttccctcaatatgcctcaatattgaggcatattgatttggggagcacagacaagtcaaggttgatgtgcatccgctgaacatgatcttaagttgttgaagtaggtattattaatgaacgaacgtctattttagctccaagagcccctggtcttccagaagagactcccaatgatcttccagaagcagctgggcttcttttggtcctcccccacccaggtgcagtcccgttctccctgcctgggtgagtttgattcctctgccgtggaataggctaggctgctacctcttgagcctcttccaccaggccatccattaggtggcgacagagagcactaaaaggaactactatggaaataaaacttgttttgcttcttggggggaaaaaaaaagaaaaaggcttgtggggcgtgtgtgcattttagtcagattttactgtgcaaaacatttgagagatttctgccctctttctcccttccattcttctcaacccactgggcgccctaccacccctgtctccttcaagataaggtagatcagaagaccaaatagacaaatgccatgtccactgttttctgtcacagttgatagccataccagtcacccaagctggaaacccaacaggcccctgcccttcactgcccacatccaagggagccaccaagtcccacaaattgttcctttaactgtttgtccctcttttgtcttctgtcatcccttctaccgctgtcctggttcaatccctcatcttgctctgggactcccatgataacttatgatctttcctccacctctctatcttccacacaatccctatcatcaatctcattcccctgctttaaacccaagagtggcaccctgtgtttgagtgacatcagggcccctcatgtggctcctgcttctctttgtggccccttctgttgctgctgcttttcttatggacatagccctcagcagtccaggactgcttgtagttcctcccaggtaccatgtttcttgcactcctggcctttgtcattggctcccctgcccaagtccccttctcttctcctttccttcccctgtggccttgccttgtcgtgcttatccttgaagaccctgtcaggtatctcttccccaaagagccctgcctaaccaccgcccccctcccccccgcgacacacacacctgggttaggccctgcctctccacgcctgtgcctcctgccaagtcctcagaggtctctgatcccatgtgcctccaggcatggcatagggggactgtgacacagcctctcggcccacagacccctgattgtgggcttgctcactgccccagtcagtcctcttattgaggattccgtgccagttcctgactccagcacacacacgcatgtaggccgccctcctagtgcctggctccttccctgtctcttctgccactcattcccatggtcgtatcctggagttggtcatctctggaactccacccacggagttctaacttagctctgcctatgatgaggacttactgtcttcccagcttgcagtgtcaaccactgtttgatgcccctgggactccattggtcttccctcctcttgtgaactgtgcccatcaccagacgaacttgttttagaatttaccatcgtaactgagctcccttcagcgcatacctccttggctcctgctcagtctctgtttctccttttagccaaactctctaagagttctctccactcatgggccctcttccttgcctgctgctccttgctcagcttgctccatgaacacttgcttttccacattccatgaaataatcttaacagtcatcagtggctgtcactccttctcagccctttccttgtgtctcttctggtacctcatactctccaggtggccatctcacctcacatcttgaaccctctgggtttgggagaattctcacctcacgagttgatgggaggcctggcgacctctgattgtagtcactgcaaatgccagatgcttatttgcctagcttccctttcggtcagggcagcagttggcaaacggtatctcaagggccaagtccggcccactgcctgttttcgtaaatgaagctttaccaggacccagttccaccccgtcctttgtgcattgtccaagactgctctcctgtacaacagcaggtgggctggttgtgacagatactgtctggcccacaaggtggaaaatactatctggccccttacagaaagaaattacctgagttctacacgagggtgtaggtatgtaccctggcctctgccagtcagactcacatgctaggaggagcagggccaggcaggagagccgtgtctcctggcattggggctgcaggaaagacgagctcctaggccacagtgccagtggccagtgctgctgccttgcagggtcgcacaggcagtgctggctgtttggactggcttggcagaaggatttgaagtattgttcctagccaactggactcaaacctgttcctccaaccctctagggattctcttatcacccagtagccttttccccctagttttaaaaattgcagtaaaatacacaaaagataaaatgtactgccttaaccatttttaagtgtacaattctgtggtattgagcacatttatattgtgcaaccatcaccacatgcatcttcaatagcttttcatcagtccttgtctgcataaatcagctagagttggtttctattgattgccaccaataatcttgacagatatgtctgatcttccttctctgcactgactcctctttctctgtctcctctgctgattctttctcctcatcacaactccaaatagcagggggagggttgtttacacttatattcagcacgccctcacgcactcgcctggctcttcagacctctcccctgaactccagattcatacatccagctgccctttaggcctctagaaagctaaatacctcagtatcaaaaacatgagaaacggaagccagagtcctggatctctcgccctttcgctgtcccggtgcccatgcccttcagggatggcacctagaccagctccctgcatccctgcctagactctgcagtagtctcacgtggcagacccggaggtcactctcctctctggatgccctgcggacactccggttagcctcagctgcaagagcctcctcacccaaggtcacgccatttccaggacagcaccctggtgactgagcgaggtaagggtacaaggcccttatagggccttctctttgacttcttcccacctccctttatggatgtcagttcctgatgaacatcttacacctcaaaccgtgacccaacatctgcttctgcagagcccccctgtggcatcttgtgccctcctgccccactccctctactctatatcttcccatagttagaatgggctttttttttttttttttgagataaggtctccctttgtcacccaggctggaatgcaatggcacagtcacgactcactgcagcctcaacctcctgggctcaagcagtcctcccacctcagcctcccaagtagctgagactacaggtatgcaccaccacacctggctaatttttatattttttgtagagactggggtctccctatgttgcccgggctggtctcgaactcccaggctcaagcaatcctcccgccttggcctcccaaaatgcaggattacaggcgtgtaccagtgtgcccagcctcagatgggctctttgaaaaatgtttattagatcaggttactcccttgagaaaaaccctctcagaataaaacccgaagtccattacttgaaagcagagccagcttcatgggcctttgtaactgcccatgggcttgctggaacccaggcttggtttaatactctactctcaccatctcaaaattcttaatttttgaacaagaggccctgcattttcattttgcaccaggctccacaaattgtgtaactgggcctgcctcagcagccacatggaacatgatccctccttgcctatttgagctcattctctaccattctctcccttgctcacctggctcccactgctcttgctcttcctggaacttgccataatgttgctagagtcagagccttggctcttgctgctcctcattggctggacccctctttacttgacctgctccctcaccactcacttccttcagatctgtgttcagatttcgtcttctcagagaggcttttggcccctgtccatctctctgaatttacctctgacctctcccccaccaccactgcgctaagctgcctcagaactttgtagacattctgtctggtcttctgatgtttcccccttggaagaatcccaaggtgcctgaagaatgctttctttatccttgaagttgagtaggttgactagagtctggcttgctattgagcattctttatcaaattgtcctgggaacatggtgtattctttcagtctgcagatgtagtcgttgctgtttcaggtcagctctcttatggatctttgacagcatcttctgttccatttgttgagttctgtacttcagggacacaaattcctcatgttggattgtctttgtctctcttccaatgctattagctttgccgtaattggtttagcttttgtctttttcatctgcattcactttgtctaatttgattttcagctatgtatattctgtttctggctgtttttcaatgtatttattagtttcataatgatgtgttttggtctgcagtttgtttctctaggttggaaatttgtcttttcatcttattctgttttatcatcccatctttgaactcttttattgggaacatgttcttatgaagttgtggggaatttttttcccttccttgtgtattctcttcttggtgggagactttgcctttctcgtgccatctccctccctgggcctcttttttttcttctggccataatatgtttgcctagttaccatgtcacttcttttcgtcttggctcaggcttggatggctctgcatagtcgttctgtttgctttgagacagtggaggaattcttggctctctcttcccagtttcttggcatcttctcttgctgttttcccctctgagctatcgcgtgcaggcttgttatcttgtatccggagagaatttgcacgctggagggagctgcagccatgtagtcttcagccctatctggattcttctctttgttctaagaactgtgttggatgtcttactaaggctcactctagctgcacgagggatgtgtgtgccatttccatggggatagggggcacctcagtctctgggtggttccataatctgtgtatacctaagagcagttgcttcccacagagctgggctggctcactgggcactttgccatttctcctgcacctcccagctggagtttctgggtctaaaaggaaaaagtgaaggactcccacttggttgcttctctccagcttactgactgcaaattcccagggcgttgcccgctccctagggtggtttctgggggacggggcaggagcctggctttgctgctgctttgtcctctggagtcttttctcagactgctttgaattacacccctttcctttgtgtgctgaaatcttcccttcacactctccttccctgcctttcttttgtgtcttatcttactaggactggaagagggcagttgtgcaggaggtctgcatctaattccctaatccatgtgagagtgctcctgttgtgtgctttgtgacatgatggtgagaaatactccctagagcagtggctaccagaaggaagccatccccccccctgcacacacacacacacacacacacacacacacacacacacacacacactccttctggctgtcctcagatgcctattctaggtaaatgtcagattccaaagaaaatccagttgagatcttttttctttttttgagacgagagtcttgctgtgttgcccaggctggagtgcagtggcacaatctcggctcactgtaacctccgcctcctgggttcaagcgattctcctgcctcagcctcccaagtagctgggactacaggcgcgcaccaccacaccaggctaaaatttttttgtatttttagtagagacagggtttcactgtgttggccaggctggtctcgaactcctgacctcgtgttctgcccgcctcagcctcccagagtgctgggattacaggcttgagccatcgcgcccggcctccagttgggatcttgactggaatgactggtgttcaatcattatagtttccacctaatttgtatttgtacacaggacagttactaatttgttggtacttgtttgatccccagtccctagagttgtttatggggtggagcttcagtccctgctgcttcccctgtggcagcagctggagtcagggtggggacccagggtgctgctggcagattcttgagacaggtagaatctcctctatattggtgtctctctctgtcccagcagtgcccaggaaaacctggccagcctgtcactgacctctccacctagggcactggtggttcaggtccttctatttgccaccggcaaaccgtacttctgccagtctggctcttaggcccagtttctctgatcttgcagattttcttgggctctgctacggaatcctcatacctccggcaggtccctcctttgcccatgtgtttaactgtggtggaatcgtgtgagagctgcttctctcgcatggatcccagccacaccacattctacagcggttcctctgaaggcattgatagagatatttcctcctgttttgcatttcgttggtcatttcagtagaatcagggtgaaataaacatgggggctcagatgtcagcattacgaaccaagtacgtcaggcaggctgatgtggactgacctacactagtgagacgcaagatgacgaaaacaagggcactcactccaagttactgatgagatgtttggatcaaatgagccagtccttaagcagagttctctagtaaaagagatctcctttctgccctttcttgttccccaaaatgtgttgccttcatggtgaaaatttattttggcagattttctcttctttgataaaagcagccaacactttgttaaaagtctgtgaaacttatttacatgaagtatgtaaaggtaagaaaaaaacattatcaacaagaaatggagaaagccagcagctgaggacagaaaagtcatgcacagtgtcagtgtctatggaaacaggccacttggaccttgaggactaggtatttggaattggaggtgagcttggcctggtgagtctctaaccacttgtgtgtaggatcagtgtgagaaccctgctagaatatagtggcagagatgcaaggggaaatcattggagaagttaccagggaatgatgagctaatctgaaaaaaatacatgtttctaagttgggcgtggtagctcatctgtagtcccagctacttgagagcctgaggcaggaggatcgcttgagcccagcctgggcagcacagcgagaccctatctccctaaaaaaaactttttcgttgtttagttttgggatttttttttttcctggtcttttttccccctttttgtgaataacgggatctcactatgttgcccaggcagatctcgaactcctgggcccaagcaatcctcctgcctctgccttcctaagattacaggtatgagccactgtgttaagcaaaaaaacttttttaaatgaaaatcattttttaaaagacaggctttccaggggagggtattattccacttatatgaagtgtcaacagtaggcagatttgtggagacaaatagattagtggttaccaggggctgagaggagtgggagtggggagcaactgcttaatgggtaaagggttgtctttggaactagagagtagtgatggtcgcatgacattgtgaatgtactaaatgctattaatgataaattttatgttatgtgtattttaccacaattaaaaaaaaaagatcaaatgtcctcagaatagccaacaaccttccacttggctaaatgcctactcattaaacttcttgaactaaattcctttctgattgtcatggttattgtgtcctgggcttcagagtttcacattcaggttggcttggtccagtctgtcatgtatcactataggtccccacattggcctcttcctcagacggacagcccatctatctgccggggctctgtgccacagccagatagacttgctctgagacagctgtgtgggctctgagcactggccaggcatcacaaaacctatctttatgatttagaataattggtggtcagctgctgttttaatgttgttgttttttttaatttagatataattcacataccatgaaatttactcatttaaagtgtacaattcattcttcagtataattcataggctcacagaaaaaattgtttaaaaataaaatgtgcaattcagtgtcttttagtacattcacagagttgtgcaaccatcgcctctgtgtcattccagaacactttcagcacccaaaagaaaccccagacacaggagcagtcacctcttattacccgcagcccctggcaacaactcatccacttcctgtctctatggatttgcctattctggacatttcctataaatggaattatgcactatttggccttttgtgtctggcctctttcactgagcgtaatgtcctcaaggttcatctgcattgtagcatgtgtcagaatttctttcctttttgaggctgaatgatattatatcctatagataatgaggttttgattatccacccatcccttgggaatgcatatttgggttgcccccaccatttggctgttgtaaactgtgctgccatgaacactggtgtacggatatctgtttggttactggttttggttttttgtttgtttgttttggttttttgagacaaggtcttgctctgtcgcccaggctggattacagtggcacgatctctgctcactgcaacctccacctcccaggttcaagcaattctcctgcctcagtctcctgagtagctgggactacaggtagcactcaccaccatgcccggctaaatttttttgtatttttagtagagacaaggtttcgccatattggccaggctggtctcaaactcctgacctcaggtgatccacccacctcagcctcccaaagtgctgggattacagacgtgagccaccgcacccggcatagttgtggctttttgagagtgtatggctaggagtaaaattgccaggtcatatggtaactccatgtttaacatttgagaaactgccaaactgttctccacagcaggaattttttaacctgtatgtggtgggcttgtgtttcggttttcattttacacatctataaagatgagatttgctgtatggcactggttgcctgtatttggggagggttctgcttttggttggcaagaactgcattttatttaagcttagcaaaacataactggtttctcgcatcttctcaaaagtggaggattaagaaatggactgcgaattcagagcagggcagctgaacctcaggctccacccttgtagccttcaagctgaacctcattctctcttgctccctggagaccactgagacactctgcctgtgccagtttgatttctcacatttttaaagggccaaagcttgtgtctcaaagtgctatagcctttattgattcatgcagagaagcctccttgattccgtaattctgcagctaatactggaagtagaaagaattggaaacaccatctggatgacactttagggtggaagcagccagtacaagggggggctcattatttcctctggtcccagactgttcacctggagctgtagccaccaccctgcccttaggttaactgcctcgagtggtagtttagctctttgtgctgtgccgagggataactggaagtgaaaggtgctgagaaatgccatctcctgaaagtggcgagcatgagtgaatttacgaaaggttgggatattgctggggctctggaagtttctctggagctcactccaggggacagggagggggctggattccaattcaagtgaaaaatacctttcatctgccttgttcacctggcttttttgcctttttgtaaaatctgaaaacctcagggattgagtagtctttccttaactgcagttgcctgtctggccacacctgccagctgttgcttgtacccctgtaatttgcacggccttccgggcctttctcacaagatcactgcaggtcacattcatgaggaaaatgcaggcagttcctgccatcagacccctcaggatgtcatggtttggcctgaaaacaagattcctgcaactctaattttcctttgctagatcaaatgaaggatttgatctaatgtttgcattctagcagcaaaatcattgaatattttatttcttaagagccttacttcatattttgtaggtattttaagattttgtaaaggcctttctgcttcaacgtgtgatgtgtgcattcttagaaaaagatcttgtgttctgtaaatcacacaataaaaacatgagttcgtgcaggaaaaactggggcggggtggatcactccaaacttgtgtggtgtggtaactggagctcactgatgaaaccatgaacagttctggctgaaagaaccccacagtacactgaggtctgttggcatcgccgccagcaccgccccggtccctttgtgcgcgccaccacacctggctaattttttatttttagtagagagggggtttcaccatgttggtcaggatggcctcgaactgacctcgtgatccgcccacctcagcctcccaaagtgctgggattacaggtgtgagcctccgtgcccagccttcagctttttttcttaatgtctttgtgtaatatgaaggcattctctttaattgttaaaaagcttgcctaccactgcttcaaaatattactgtcagttggcatagcttctgattatattgatgtcatctcccttcttttaaacatgttaccatattggcactgtatttcccctagcccattgatcacttgagagttagtcatagtcctcgtgctgtttcactcctaaacgtttaagcatgcctttcctaagagcagacagtacagttaagacactcaggaagtttagcaatgagctaacacagaaccttacatttctccacataccccataaatgccttttttagagcctttgagcctggaatgcagagtccaggactgtgtgttgtattcgattgtgtcatcccttcagtctcctttatcagaaatgttcccccacccccttgttttctctcatcatcttgagtccagaccgtggttgcatggcacgccctctctggactcttcctgctgtctcctcacggtaagcttcagtctcctactcgtgatgctggttcatctcagcagcactgaggggcctgagctcagtttggtcgtgtgttaaggtggtgcctgccagatttctccacagaaaagggccccgtacttttatttgctcttcagcctgtgtattccttcctttcttgccagcttgtgggtggcttctctagcagcttctgtaagatactcagtttggcagttgtagttgtttcagcaggagaggtgtctgcatacctgaccaccacatggctagaagtcgatccatcctctggcgtaaccatcctccatgctactgtccctggggcactgaggccctcctcagtgacttcctccacctcatcttccgccatctccaagccaccagtgtccaacggactactgatatgtcccaaactcatcatttgtttattcaccaattcagagcccacctttttttcagcactgagctagcctctccttgctagaagcttacggtcgaaggtctccagccatcagaagaagcacgtggagcgctgcgtccgtgttgtggttattcatccagcatgtgttgagtaagggttgcacctgtgcctggcattatgcattgagcggggagatgggggttggcacgcacagtggggtgttctaagtacactgagggctcgggtgccctggctcatagagcagggagggaggcaggagcagggaaggtgtctcagaagtgccatctttttttttttttttttgggaagtggaatcttgttctatcgcctggtctggagtgcaatggcactatctcaactcactgcagcctccgcctcccaggttcaagcgattctcatgcctcagtccccgagtagctgggaccacaggcgcacaccaccacacccggcaaatattttgtatttttagtagaggcggagttttgccatgttggccaggctggtcttaaactcctggcctcaagtgatctgctcacctcggcctcctaaggtgttgggattacaggcatgagccactgcgcccggtctagaagtgccatcctaactgaacctgaaagatgaaagttctccagatgaacctgaaagttctccaaatgaaaaggtgggagggggtgacagggttaggcccagagcctctggtgacacagggtgggcatcattggtcactttttcctcgagggaggggcgtcacacgggtgatagggtgggagctataaccatgttgatagtgccgcctctgcccatctggcctggcatgccctgagccctctgtcccacctgtggaactcataagccctgacagcccactcactcctgattcattatccacacccctgtgcttccgctgtgcctggagcaagctttcttcagggggaagggaggctggaactatgttgtagttacctatttgtcctcccttccaaactgtgagttcttggaggtggaaggatgctgcaggatctggctcaggacgaaggcagttggtgaacagacacgtgtgtttttgactcacggtgatctcagacaagttcctctgtctagtcgaacttctttttttccatctgtaacactcaggagttgaataggtggtttttctgaggatacttcaactgtaaaatgtatgaacttgtgaactagctatttagttctcctcataatcaagattgtgtgtgtgtggggggttctgattagagggaggatgaagagaggtgtatggggttttttttgttttgttttctgtttgtttgtttgtttttgagatggagtctcactctgtcacccaggctggagtgcagtggcacgatttcggttcactgcaacctctgcctcctgggttcaagtgattctcctgcctcagcctcctgagtaactgggattacaggcatgcaccaccatgcccagctaatttttgtatttttaatagagatggggttttcgccatgttggccaggctggtctcgaactcctgacctcaggtgatccacctgcctcggcctcccaaagtgctgggattataggcatgagccaccacacctggcaggtttctttgaaaaagtttgtgtttcggcaaacaccataaaccccctgggggacagccttggggagtcacctggcaccctagcccagcctccctcccttgggtcctgcagtgaaggcttagtgagggtgtgcaaatgcccaggtcaccctgggactgggcaggccctctgggctaagggtaaactcatttggaatacctgttttctatcattgttttttatttgttaaatttaaagggtacaagtgcagttttgttgcgtggatatattgtatagtagtgaagtctgagctttcagtgtaaccatcacctgaatagtggacattgtacccgttaagtaatgtctcatccctcaccccctcccacccttcccagtctctccagtgtctgccattcctcactctgtccatgtgcacatgctattcagctcctgcttctaagtgagaacgtacggtatttgactttctgtgtctgagctgtgtcactgaagacaatggactccagctccatccacgttttttatcatttttacctgcactccacacccagcacaatccaggcttctttgtgggttttttgaaatttgtctttaattataaaagtagcagccagcaaattaacaaacacccatgtgcctttcattgcacagaattgaaaatcatcatactatatttgcttcaagtaatttccattagaaagaactagaatattacagtagagttaaagaccctttatttcccatcttcagtgctcttaaaagttcatttagggccaggcatggtggctcacacctataatcccagcactttgagaggcccaggtgggtggatcacctgaggtcaggagttcaagaccagcctggccaacatggcgaaaccccatctctactaaaaatacaaaaattagctgggcgtggtggtgcgcatctgtaatctcagctactcgggaggctgaggcaggagaatcgcttgaactcaggagggaggcagagcctgtatgcagtaagccgagattgcgccaccacaccccagcatgggtgacagagcaagactccgtctcaaaaaaaaaaaaaaaaaagttcattcattgtacacttagaaatagttaaaaaggtaaactttgttttgtgtgtgtgtgtatatatatatatatatatatatatatatatatatatatatatgtatttttttttgagacatatatgtgtctggtttgttcgcccaggcaggagtgcagtggcatgatcaacggctcactgcagcctcaacttcctaggctcaagtgatcctcctgcctcagcctcccgagtagctaggattacaggcacacaccaccatgcccagctaattttttttttttttttttttttttgtagagacagggttttgctatgttgcccaggctggtctcaaactcctgagctcaagcgatccacctgcctcacctcccaaagtgctgggattacaagtgtaagccaccacacctgacctgttttgtatattttaccacaataaaaagcctttaaaaccccaagcagacagttcattttcattcaggcccaactcagaatctgatcacagcggggtttcccccctttctagcgagtagctgaagaactgttttctctccttgatggtataactgtctctgtgggtgttgctcccctgccgctccagtggttttgtttttgtttttgtttttttgagacggagtcttgcgatctcagctcactgcgacctctgcctcctgggttcaggcgattcttctccctcagccttccatgtagctgggacttacaggcacctgccaccacgcccggctcatttttgtatttttagtagagacggagtttcaccatgttggccaggttgggctcgaactccagacctcaggtgatccacctgcctcagcctcccacagtgctgggattacaggtgagagccactgcacccagccggcccctcagtcttttccttctcaatcagtggcaccaccatcttcccaggctttggacatggtccctgactcacccttgcccctcacccccacactaatccacctgcgagctctgttgcttcaccacctagaccagccccaaatcctcaactgcccccaccctgggccacacctggaccactgctagaggcctctcatgggccctccctgtttttctcttgcactccccgggctttctggcacaagatgccccagaagcagaatcacatatctctcctgggagccaatctagtgtgtttactgcccctggagtgttattgttggccttagaatatgtcccactacaggtttgcagagcactgtagtcaaaagtcatttgaaataaatcttttctctgtggtatattgtcaatttgatatagaattaaatttgtttcttttcttttttcttttctttttttttttttttaagagacagggtcttggccaggcgtggtgtctcatgcctgtaatcccggcactttgggaagccaaggtgggtggatcgcctgaggtcaggaattcaagaccaacctggccagcatggtgaaaccccgtctctgctaaaaatacaaaaattagccgggcgtgatggcaggtacctgtaatcccagctactcgggaagctgaggcaggagaaggcttgaactcaggagtcggaggttgcagtgagccaagatcacgccatggcactctagcaagactctgtctcaaaaaaaaaaaaagagagagagagagacagggtcttgctctgtcactcaggctggagtgcagtgatgtagtcatggctcactgcagcctcatactcctgacctcaggtgatcgacccgcctcggcctcccaaagtgctgggatcgtaggctgaagccaccatgcctggcccgaactcatttgtttttatttgcattaagtgtaataaggttttgttacttttagtttgaattttattttgggtaatataaacatttacatgattcagaagtcagaattacactgaggcatgttcagctaggcctcactcctgtgcctgtacccttacctttttccccctaccccatgcagggaatcaatttcattagttcctggtgtgtccttccttaatacccccccttctttctttggtagaatgcagtagatatgtttgcgctttgctccctttgcttcacagtggatcctggaaatgactccatcgcagttcttagagctcttgtttagtccctttggatctgcacagtactccagtgtgtgggcgcaccataagtttattcagcaagtgccctggtgatagggatcgggggtattggaagcctttggctggtaaaaataatgttgtagcaaataacatcatgcatatgttctttgagatttctggaggtgtctctttagcatagatttctagaaggcattccttacgtcacgtttaggtttatagtttgacctcatggtgattaaggtatttgggaaatgcaaatgagagtttcgaagaagccagatctttcccattagttcactgtttttctctgacattaggaccgtccgggttctagggagcagccctggcgttaggcagtgccatgatggattgtgtagaagtagcgattcccatctgtctgctttcttggcccactctgctggtggctccccttccctccctcctttatggggagctggggagctgcctaggggtccattctcaaaggctgatctctggtgggcaacaggccacacctagctttccagggttcttcgtcatttcccattgagagctgtaagactcagagacatgaaaaggaagctctggctgggcacggtggctcacgcctgtaatcccagcactttgggaggctgaggcgggtcgatcacctgaggtcaggagttcgagaccagcctgcccaacatggtgaaaccccgtctccactaaacatacaaaaattagcctggcgtggtagcacacgcctgtgatcccagctactccggaggctgaggcaggagaataacttgaacccggcaggcggaggttgcgatgagccgatattatgccatcggcaacagagcgagactccatctcaaaaaaaaaacaaaaaacaaaacaaggcgagctctgtgctgggacagattagggacccctctttacagcaagaaagactgctctgtgggttgtaggatgcctttgtgtatgcagtggctctaggtgactctggcagccacactctgggccctaaacttctggaggaagatacaggatagggaggaactcaggggtgagtcatggtggggacaagacattccctcactctaagaccttgtcactagattggaacatctcttgcctccctacacctgacctgatggttctggagagatacgtccttgcagcttctgagtcccagcactaagcagcctttggtaacttccctacatcatttgagttctggtttcctaaggatgcttgccagtgagtgccatggtgccctcattgcacagtctgtgcagtgtagacaagaggggaagtctcttggggtagaccagccgcaaggcggtgactagcactgatgtgaaccacatgggacaggggagttgtggggctgagaacacggagggtgggagtagtcatgctcttttccagaatgaactgctaacgaagggactcgcaggtggctgctgcttctttccaagctgcccctgttgttgcagaggctctggagtcctaggaggtttcacggtggcatactcgacagagtactagagcatcatggccagatagtgatgctggggtgtggggcctcacggtggccatttctgacgagaccccaccgggccaaagtgatgtgtagagaaggagctgcttcggtcaccagaaaagaacggggaagcctcccacactagaataggtagggtgctcttctccaccggcaggaaggggatgtatggctctgcctggaccacacctttttccttgctcttccctccgcatctgctgtggccgaggccattcctcatcagggaacatgtgttagaggctcacgccacctgggaccacttgtcttatcacccccaggaccctaggcggtagtttcctgtggcctgagttagctgatatttatatagtgccattgtgccttttctcctgtgatgctcacagtaaggatgcctagatggggttacctgttgtcaagataaggaaactgaagcacagaatgctgaggtcatttgctgggttcatgtttggaaagcggcaaaggatttcagtgcaggttggctggctccaaacctgtgtgtgctttccatgacactgtactgtgtgcctcattgagcctcattctagaaaaccaaaaacacacccaaggcccggccttcacaaaggagacccctcccccatttggctccctttccagcagtcgacggcctcttgtcagccatcgagcccagagtcccttgaagtgcgactcatgctggggtggtatgctcaggagccgcagtgtttccgctcagaggaaagggctctgattctcctgcagtgctaggagacttgtgggtggccacagtgcaggtcaggcacaccggccagcaccacccacagcccaaattcctaaagaaatatttgggtcccagcttggcccgagtctctgttgtcctggggaaggacatcaagatctgagtgtatgatggcctggggccttgcatgtggtgggggtccaagcctgcctctgctcacttgttctgcagactggcatgttctctgtgatacttacatacttgtttaacacttcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaagtaagtaagagcaactcctatctctacagggcagggagggcagggacaaggatccctcatggagcaggaaaatgtatgtgcccagggtggggtcggggggaacataaacaatgaacactgagaccaggtgtgcttgaaatgaccgtgtacagaggtcgctgccctgagtgggaagttctcaaggtagcaggccctctatcctctccacacctcaagtctttatctggggatggaatagctgcggaagcagaggaacttgcagagctaggggttcagaggggtgaagaagcatgtttcagttctgccttttaaatgatcccaaaaaggttagcagttttcaaatgacatttgcagacagcctcatttaattccatgagaagggtgagcaaaggattatcttgttgaaactgattcctggagagactgagcaccgtacctgagttcaaacttgggaatgttctagatggtgactcaggcccaggcaccaaccagcagaatgggcctcagcctgacaacccttctgtaccaggcctgactctttggttgctgaactttggagaggcctgggggggtcagcggcaggcagacgagtgagtggctttggtgacaggtcctcaggggcagccaggcagtgtgactctcgttcaatagtaacgtttgtcagagcgttgtcaccaccatccgctctgccctatctctgacattgctatggagagcctctaattgttccttgtgtctttctgtttgtccccacagtccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagcccgggaggccgatcgccgctcgcggaacccgccgggacccgggccctccccggcgcggggcgcccccgtgtgacccagcgcgcggccgcggcgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctgtgagcgcgggactccgggcaccccacggctgggaggccggcgggccccacggggctcccccacccgggcctcaaccttcctttccttccttggcgtcccagggcaccctcccgccccgcttccgtccccaggcaccactgccccgaggcccagcagcatccctgcacccgccgaggccgaggcctggagcccccggaagttgccatcctcagcctccaccttcctctccccaggtaagagggcccggttgttaggctcggtggacccaaagaagagcccaccttgaccacggccacggctgtagaccctgctgctggtctctgcctgcctctcactggtgtctttatgaagcttttccaggctcccagacccattcagggcctgagctcggcctggtcccaagccctgcttccctgtggcctccaccgccatctccagccccttcttctaccaaggtaggtgtcccctgccccccagggaagattcgagacaaggaggaaggaattcagcctttgatgtagcgcagagccccagtcagccaagctgggtcagctgggaggcagctgtggtggggagagcctggagccttgggcagaagggaagagacagggaccccacctgatccaggctctcttcccacagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggtgagtgtcgcaccctggcagggaccctggaaggccatcagataaccctcaccacttctccagcctttccccctcgcttccccacacaactccttcagccctcattctggcgtagggtccctggccccttggtggttctgggcctcgggtaggtggcactggtggcccgaaggccttcgcttcgagagcctcacgctgcccgtcttccctgccccttcccccaccgcaccctgggggctgcagaacgctgacctggagtggactgcagtgaagcagagcttcctgaccgaggtggagcagctgtccaggtgaggccagagggggagccacaccaggtcccgtggggcttcagaccgcacaccacaggacctggctcccttgggcacctgaggcctggcaggcccgggcgagctgaggccccagccagggctgcccacccagtctggcctgatggaaagtgctcccctttttcaaacaggtttcgtcacccaaacattgtggactttgctggctactgtgctcagaacggcttctactgcctggtgtacggcttcctgcccaacggctccctggaggaccgtctccactgccaggtaggctcacctggcccggcacgcttcccaggacccaaagcactcctgacacctggctggagccgggcgcggggcctagggctttcagcctgtgtgagtgggtcctgccagcaggccaggcctgcacttccagctccccagcagcacccggctcaggatttggcccacggtggggtcaatttttttttttttttttttttttttttttttgaggtggagtcttgctctgtcatccaggctggagtgcagtggtgtgatctcagctcaccacaacctccacctcccgggttcaggcgatcctcctgccgcagcctcccgagtagctgggactacaggcatgcaccaccacacctgcctaatttttgtatttttagtagagatgaggttttgccacattggccaggctagtctcgaactcctgaccccaggtggtctgcgcgcctcagcctcccaaagtgctgggattacaggcgtgagccaccacgcctggcccgacccaatgttttctatagagctctttcccaggcctctcccctttgcaagcagcgtagctggagggtctcatcagcaagccccggaggcgagggggtctggggctaccagctggaccacctacagctgagggagggcccccttgcctcctcctgcatgctgcgtttggggagagcgggaagaatgccttcaaggacttcccgaccaccagggacaaagggatgagccctgggagccgaagcccagcagattctattgaacgtgtccccagccattgcttaagaagtgcaggtcacggagactttgctcctcgttttccagaagggggaaactgaggcctagagagtgaagtggctgttccaggctgcacggtgacaggtagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagaggtgaggaggggcccttgagaactgccggggcagggcctgcagcaaggggggccccgcgtcctatcaatgtggggatcaggcatggcctgggacctcaacaccccggcatcgcacaggtgtgggaacgggccaaggatgggccctactgatgagcagaggcccccaggcagctggagcgctcagggcagtgccagcgctttctgtgggcaaggcaccgggctggcagcctcgagtccagccttatctaagccgggcaggtgtaggagctaggaccgggctgacgccactgtcttctctccccaagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtgagccactgacccctctgctggctcagaggaggagaagccacaggcaggcagaggtgggggctgcagagtgcactgcgggccaggggccatctgccaagaccccaggaggctgcagctccagggtccccctccctccgaggccctcctcctcaccctgcacctaactgtgtgtttgtaatttgtcttcaagtgggctctccgagttgcccgagcttcagtcccataacatctggctctgcctttgtccacacccttgtcaggcccaatccatgtccacaccagaggcctcttccctgccaaggccactgccatgctctccctcttccctctctccaggtagtgctagagaccttggctggtcagagggctgtgaagacgcacggtgccaggaccaagtatctggtgagccccttgaggcagggccaggagggacacacagctgctggcagccagcaggcacagccccagtggcggggataactggggcgcagtgcccatggatgcctctgctgccacagtggcctcatttttgaaagtaggcagggctccaaacaacttcgtttaccttgccgaggacaaacctgtctgtcctgcagacactatgggccttgtacagaccccacctgggctgggggcagggggaagggcggtcccagggcactgagacccaagctgcagtggaactcagaggactctggccggagaaaggcggtggtagagaagaagcaggccccgaggaacctcctgggccccagcaggctgcagctgagctctccgcaccgtgcagggcagcctgagctgcctcacggtcttactccactcagtctgcctcaccgtggactgtggtggggccaggagactagagacctgggttttagccccagcctgacagtggccttccagcaaattcctgctcccctgtgggcctgttttcccatatgcaaaacagacttcacagaatgtgctcagccagtaattgcttcactgcttctcctcttgtttggggcggttcctgtgtgctgtggggtctccgtcaggattcagccccgctgagaacccaggagccgggcttgagccctccttcctttcccttccccgtccgtccatccatgcatcctgctgaagaagcgcaccaggctccttgggggtccttggacttccccacttgctccccaccctgcagccaaagtgctcttttcaaaggcccctttgccttttctctgctcttggggtgaaggcccagtcccttatgtggttgaccccccaacgccccaggtccctgggactcggggcgctccctgctgcctgcttcacagccttagtatgtgccgttcgctctgcgagaaaagccaccgcccacccaggtggttcctcctggtctgtctgatttcagaactggagatggcctccggtcctgtttccaccctgggggcgcctctctgcggggcgcctctctctctggggtacctctttgtctgtggggcacctctctgtggggcgctttccttctcggctctgccctctcaggctacttcctgccttcagaccccagctccatggggctctcccccaccaggaagtcagctctgtcaaaccgggtcccagggttctgtttgttcctgtatccctagggcccagagcaccactggcccacagtaggtgtttaataaatctctagaagctactcgggaatctgaggcaggaggatcgcttgagcctgggagttggagaccagcctgggcaacatagcaagataggcatggtggtacacacctgtaatcccagctgctcgggaggccgaggtgggaggatcacgagcctgggaggttgaggctgcactgagccatgattgcaccactgcactccagcctgggtgacagaatgagtccctgtctcagaaaaaaagtaagttgtagaaagaccaagagctgtggcacagtgtctcacacctgtaacaccagcactttgggaggctgaggcgggaggatcacttgagcctacttggagaccagccaggccaacaaagcgagaccccatctcttttttttttttttttttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtagccagctgcgcactgggacggggtggccagatagaaagcccgcattccaggccttgctctgtagtgaccccatctcagcacctgctaggtctctctggagtctccacacatttcttgcttgccctttggttctgtttggggcagcgcccctctgaactgaggggccccgggcagtcctgctttgcggagcccagctccgacccccttcacatagagagaaggaaagagctgctgccgcgccccctgctgggcgcactgcactactgcatctgcctttttctgtcccctccctagtaccccacctcttctcctctggtgacagttgaaaatggagaggccccgtttgagggcagcggggcagtgagattcattttgtagaaaagaacgaggccattctcagtccttgcttttggcagccgcgcttctcagcactccctgtgatgggaacagaggggcgaggggcagagcgttcccagctgcagggtatgtcattttagagccctggggcaggtcacggacggcctggagcagccctgtggtttgcccacggggtgaccggccagggctgccatctcaccctgagagtccctcttttccacttgcaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggtagctggggagacgggttcccaggagagggaccaaggcctctttgggccaaagcccctgtaagtccccaccccagccttctagaagagaaccagggccaaatgttcagctcactgtgaccttagcaaccctggtttcccctccccaggccacatccttcccaggtggagcttgctctccagccctccccccaccccattcctgaaggctgggaacaaggagggctctgtctggtagcctgagagctgggccctgcccttggacttctctgaggaattcaggcctgaggccagggaggcagggtgctaggctgcgggctggggagccacagcatgaggctaagggagtgccatctccaccccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggtgctgccgcccaggctggcctctggggtgctcaggcgcatccgtgtcagccccaaagagcagagtgtctgtcccgactgcgctgagggcgtggggcagccgggcaggccactggctctggcgacctctagaagcccagccggccccacatgcctcccttagcaagaccctggcccactccttccctcgcctcctgacagtagcacctcctttagcccgagggtgcctgccccactctgtgctttcaggaaataggaagccccagcaggaattttccatcccaggtactatttgaagaaccactgcttaggaaccctcagctgggcgaggtggctcatgcctataataccagcacttttggaggccaagatgggaggatcacttgagcccaggaggtggaggctacagtgagctgtgatcaagccactgcactccagcctgggagacagttagaccctgtctcaaaaacaaatgaacaaacaaacaaaaaccctcaattcccacgaacgccccaggagataagggagcatggcccaggccttgagccagggcttctggcagtaggggagcctcccccatttgctaagcggactttcctcttccttctgtaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttgcaatctcgggctctacttgtggactttgttgcaccgaaagccttgagctttcctgatgccttacacttcagggttcttgagcgtccagggtcttgttactactctgggctggccacacccagcacttcccgtgtcaggtttttcctgatgtagtccatgttttttatgctattctaaatggtatctttgattttctagttcatcatgatattatacagaaatgcaattgatgctgggcacggtggctcacgcctgtgattccagcgctttgggaagctaaggcgggcagatcacttgaggccaggagtttgagaccagcctgggcaacatggcgaaaccccgtctctacaaaaagtacaaaaattagccaggcatggtggtgcatgcctgtagtttgagctactcaggaggctgacccaggaggatagtttgagcccaggacgttgaggctgcagtgagccatgattccaccactgcactccagcccgggcaacagagggagaccttgcctcaaaaaaaaaaaaaaaaaaaaaaaaagcggttgagttttgcatatgaaccgtatattctgtgaccttgtttaaattcttttttttttttctttttttgagatggagttttgctcttgttgcccaggctgcagtgcaatggcgctatctcagctcactgcaacctctgcctcctaggttcaagtgat

SEQ ID NO: 2 - DNA, 99925 bp, Homo sapiens
atcacttgaacctaggaggcagaggttgcagtgagctgagatagcgccattgcactgcagcctgggcaacaagagcaaaactccatctcaaaaaaagaaaaaaaaaaaagaatttaaacaaggtcacagaatatacggttcatatgcaaaactcaaccgctttttttttttttttttttttttttgaggcaaggtctccctctgttgcccgggctggagtgcagtggtggaatcatggctcactgcagcctcaacgtcctgggctcaaactatcctcctgggtcagcctcctgagtagctcaaactacaggcatgcaccaccatgcctggctaatttttgtactttttgtagagacggggtttcgccatgttgcccaggctggtctcaaactcctggcctcaagtgatctgcccgccttagcttcccaaagcgctggaatcacaggcgtgagccaccgtgcccagcatcaattgcatttctgtataatatcatgatgaactagaaaatcaaagataccatttagaatagcataaaaaacatggactacatcaggaaaaacctgacacgggaagtgctgggtgtggccagcccagagtagtaacaagaccctggacgctcaagaaccctgaagtgtaaggcatcaggaaagctcaaggctttcggtgcaacaaagtccacaagtagagcccgagattgcaacatacgtttttattactcaaggacaacctggacgtcaccaatgcccagcttcacgggggcatgtagtgtgactcacggctgaacacaaaatcactgtgaagcctgtgctacagccctgggctacttttggacacgcaagaggacactcggttacatgaaacctgacttgcttctgaagacatgtgatacatgtcttttccctgaaaatgtttcccttccctgtctgccatgctcccaacttttctgccttccaggggcttctcactgtctgggtaactaggtcttgggcctagctagaccttgggtagtggcccctctgccacaatcagtgcctgggcctgaggctgagcttgtggcctccgaagcctgacctggctcggagctcgtctgtggcgcccagggatggcctggcttgcaggccaccacattaggccagctcgcaggtccccagtaaagcctgaagacactggcccgaggttggaggtgggtgctgctcgactttctggaggatctcagaattctcgcttcttgctaggactgaaccatgagacttacagccatacttcacttttcccagggtttttctttttgaaacagggtcttgctctgtcacccaggctggagtgcagtcatacaatcatgactcactgcagcctcgacctcccaagcataaatgatcctcctacttcagcctccccagcagctgggaccacaggcgtgcgctaccacgccaggctaatagtttaaaaaattttttggcagagacagggtctcatcatgttgccctggctggtcttgacctactgggctccagcgatcctcctgccttggcctcccaaagtgctgggattacaggcgtgagccaccgcacccggccacacttttccaaattgtaagcaggtaggagggccctaggcctcgtcggccccattgtgcagggtggccactgtccaaagagatgggcaaagagctgctgccagaggcctgggctgcagacgccctgcatggctctcaggggagccagctccctactccacacccctgcacagcagcccctctcctcccctcacgggtctgtgcagccagcagcctcccaacatgcgccagcctcctcactggatgatgccagccttccttgcccccagatgctggcatggaggcagggttccactctgcctgcctatgcccacagagcctagaacagcagggccacctccttctctcccccgcgggcatgggcccccacccccactgccggcagagtgctgaggactcgtgcaccatgagaacttctgaccatgagaactttgacttccggatttgggggatctgcccaggtgaacacatcagctctgaaattcatcactttcttcgggcccctgcctgtcctgttccaggcccaagcctacagaaggaagaggaaagtccgcttagcaaatgggggaggctcccctactgccagaagccctggctcaaggcctgggccatgctcccttatctcctggggcgttcgtgggaattgagggtttttgtttgtttgttcatttgtttttgagacagggtctaactgtctcccaggctggagtgcagtggcttgatcacagctcactgtagcctccacctcctgggctcaagtgatcctcccatcttggcctccaaaagtgctggtattataggcatgagccacctcgcccagctgagggttcctaagcagtggttcttcaaatagtacctgggatggaaaattcctgctggggcttcctatttcctgaaagcacagagtggggcaggcaccctcgggctaaaggaggtgctactgtcaggaggcgagggaaggagtgggccagggtcttgctaagggaggcatgtggggccggctgggcttctagaggtcgccagagccagtggcctgcccggctgccccacgccctcagcgcagtcgggacagacactctgctctttggggctgacacggatgcgcctgagcaccccagaggccagcctgggcggcagcacctgggagggagctggacgacagcagctgcaggctgtccagggccccatcctcgtacagggccagcttctggaccatcttctgtcgggcagggttgatgataatctgcggtggctctgacgacgatgatgcagagctgccaagggccagtcctggggtggagatggcactcccttagcctcatgctgtggctccccagcccgcagcctagcaccctgcctccctggcctcaggcctgaattcctcagagaagtccaagggcagggcccagctctcaggctaccagacagagccctccttgttcccagccttcaggaatggggtggggggagggctggagagcaagctccacctgggaaggatgtggcctggggaggggaaaccagggttgctaaggtcacagtgagctgaacatttggccctggttctcttctagaaggctggggtggggacttacaggggctttggcccaaagaggccttggtccctctcctgggaacccgtctccccagctaccttccacggctgtgggccgggatcctgggccactcccccagctcgattctcctgccgtgtccccctgaggacagccggcctccctgaggggtgctgggtccagagggcagcttggagtcaagtgccaggagcgcagggcagcagagaggccgcctaggctctcgtcactctccacgggctggttggggcctctctgcagctgctctgctgcctgggcactggctcctgatggcgctgccaggggctgccatggagcagccccactgtgggctctgccagtgctggacacgtaggagttctcctgcggggaaggggggatgcagctggcggcctccgaatgcccgggcacccccgccaccactgcctgcagcttctctagcctctcgtacacctgcaagtggaaaagagggactctcagggtgagatggcagccctggccggtcaccccgtgggcaaaccacagggctgctccaggccgtccgtgacctgccccagggctctaaaatgacataccctgcagctgggaacgctctgcccctcgcccctctgttcccatcacagggagtgctgagaagcgcggctgccaaaagcaaggactgagaatggcctcgttcttttctacaaaatgaatctcactgccccgctgccctcaaacggggcctctccattttcaactgtcaccagaggagaagaggtggggtactagggaggggacagaaaaaggcagatgcagtagtgcagtgcgcccagcagggggcgcggcagcagctctttccttctctctatgtgaagggggtcggagctgggctccgcaaagcaggactgcccggggcccctcagttcagaggggcgctgccccaaacagaaccaaagggcaagcaagaaatgtgtggagactccagagagacctagcaggtgctgagatggggtcactacagagcaaggcctggaatgcgggctttctatctggccaccccgtcccagtgcgcagctggctacctgggtcataggaggcctccttttggcccggcggtgcaggcagcagcaggccagctggcccaggcccaggcccagctcaggtgggcagggcccgggcctggggtccaggtgcttcttgtagatctgcatggcgatgggagcagcccaggcatctgcagccagacctgcttgcagtgtgctctgggtgcttctcaaagccactccagcctcctcagcctcctcttccaccaggtctttctgtgggataaatactgtcagtatggctaccaggtggccacacctgcagctgcagtcctcaggtccttgtcactcaatcgtatgggttttgataaaaaaaaaaaaaaaaaaaaaagagatggggtctcgctttgttggcctggctggtctccaagtaggctcaagtgatcctcccgcctcagcctcccaaagtgctggtgttacaggtgtgagacactgtgccacagctcttggtctttctacaacttactttttttctgagacagggactcattctgtcacccaggctggagtgcagtggtgcaatcatggctcagtgcagcctcaacctcccaggctcgtgatcctcccacctcggcctcccgagcagctgggattacaggtgtgtaccaccatgcctatcttgctatgttgcccaggctggtctccaactcccaggctcaagcgatcctcctgcctcagattcccgagtagcttctagagatttattaaacacctactgtgggccagtggtgctctgggccctagggatacaggaacaaacagaaccctgggacccggtttgacagagctgacttcctggtgggggagagccccatggagctggggtctgaaggcaggaagtagcctgagagggcagagccgagaaggaaagcgccccacagagaggtgccccacagacaaagaggtaccccagagagagaggcgccccgcagagaggcgcccccagggtggaaacaggaccggaggccatctccagttctgaaatcagacagaccaggaggaaccacctgggtgggcggtggcttttctcgcagagcgaacggcacatactaaggctgtgaagcaggcagcagggagcgccccgagtcccagggacctggggcgttggggggtcaaccacataagggactgggccttcaccccaagagcagagaaaaggcaaaggggcctttgaaaagagcactttggctgcagggtggggagcaagtggggaagtccaaggacccccaaggagcctggtgcgcttcttcagcaggatgcatggatggacggacggggaagggaaaggaaggagggctcaagcccggctcctgggttctcagcggggctgaatcctgacggagaccccacagcacacaggaaccgccccaaacaagaggagaagcagtgaagcaattactggctgagcacattctgtgaagtctgttttgcatatgggaaaacaggcccacaggggagcaggaatttgctggaaggccactgtcaggctggggctaaaacccaggtctctagtctcctggccccaccacagtccacggtgaggcagactgagtggagtaagaccgtgaggcagctcaggctgccctgcacggtgcggagagctcagctgcagcctgctggggcccaggaggttcctcggggcctgcttcttctctaccaccgcctttctccggccagagtcctctgagttccactgcagcttgggtctcagtgccctgggaccgcccttccccctgcccccagcccaggtggggtctgtacaaggcccatagtgtctgcaggacagacaggtttgtcctcggcaaggtaaacgaagttgtttggagccctgcctactttcaaaaatgaggccactgtggcagcagaggcatccatgggcactgcgccccagttatccccgccactggggctgtgcctgctggctgccagcagctgtgtgtccctcctggccctgcctcaaggggctcaccagatacttggtcctggcaccgtgcgtcttcacagccctctgaccagccaaggtctctagcactacctggagagagggaagagggagagcatggcagtggccttggcagggaagaggcctctggtgtggacatggattgggcctgacaagggtgtggacaaaggcagagccagatgttatgggactgaagctcgggcaactcggagagcccacttgaagacaaattacaaacacacagttaggtgcagggtgaggaggagggcctcggagggagggggaccctggagctgcagcctcctggggtcttggcagatggcccctggcccgcagtgcactctgcagcccccacctctgcctgcctgtggcttctcctcctctgagccagcagaggggtcagtggctcaccaccccaaagctgaaggtgtccgtgtccacagccagccttcccgtcttgatgtactcctcgggcaggtaggccagggtgccccgcactgtctgtgtccgggccaccatgctgctctggctggggctggacccggcaaagcggctgaaccgggccaggccaaagtctcccagcttgggtgtcagcctctcatccagaaggacgttggaacttggggagagaagacagtggcgtcagcccggtcctagctcctacacctgcccggcttagataaggctggactcgaggctgccagcccggtgccttgcccacagaaagcgctggcactgccctgagcgctccagctgcctgggggcctctgctcatcagtagggcccatccttggcccgttcccacacctgtgcgatgccggggtgttgaggtcccaggccatgcctgatccccacattgataggacgcggggccccccttgctgcaggccctgccccggcagttctcaagggcccctcctcacctcttgatgtctccatggatgaggctggggctgtcctgatgtagaaactgaattgcccgggctgtacccagaaggatgtccagtcgctgaggccaggagagaggtgggcaggcctgggtctggggtggcaaagggggacaggggaggttgctggatggccgttccttgatcccaaccatccttctacctgtcaccgtgcagcctggaacagccacttcactctctaggcctcagtttcccccttctggaaaacgaggagcaaagtctccgtgacctgcacttcttaagcaatggctggggacacgttcaatagaatctgctgggcttcggctcccagggctcatccctttgtccctggtggtcgggaagtccttgaaggcattcttcccgctctccccaaacgcagcatgcaggaggaggcaagggggccctccctcagctgtaggtggtccagctggtagccccagaccccctcgcctccggggcttgctgatgagaccctccagctacgctgcttgcaaaggggagaggcctgggaaagagctctatagaaaacattgggtcgggccaggcgtggtggctcacgcctgtaatcccagcactttgggaggctgaggcgcgcagaccacctggggtcaggagttcgagactagcctggccaatgtggcaaaacctcatctctactaaaaatacaaaaattaggcaggtgtggtggtgcatgcctgtagtcccagctactcgggaggctgcggcaggaggatcgcctgaacccgggaggtggaggttgtggtgagctgagatcacaccactgcactccagcctggatgacagagcaagactccacctcaaaaaaaaaaaaaaaaaaaaaaaaaaaaaaattgaccccaccgtgggccaaatcctgagccgggtgctgctggggagctggaagtgcaggcctggcctgctggcaggacccactcacacaggctgaaagccctaggccccgcgcccggctccagccaggtgtcaggagtgctttgggtcctgggaagcgtgccgggccaggtgagcctacctggcagtggagacggtcctccagggagccgttgggcaggaagccgtacaccaggcagtagaagccgttctgagcacagtagccagcaaagtccacaatgtttgggtgacgaaacctgtttgaaaaaggggagcactttccatcaggccagactgggtgggcagccctggctggggcctcagctcgcccgggcctgccaggcctcaggtgcccaagggagccaggtcctgtggtgtgcggtctgaagccccacgggacctggtgtggctccccctctggcctcacctggacagctgctccacctcggtcaggaagctctgcttcactgcagtccactccaggtcagcgttctgcagcccccagggtgcggtgggggaaggggcagggaagacgggcagcgtgaggctctcgaagcgaaggccttcgggccaccagtgccacctacccgaggcccagaaccaccaaggggccagggaccctacgccagaatgagggctgaaggagttgtgtggggaagcgagggggaaaggctggagaagtggtgagggttatctgatggccttccagggtccctgccagggtgcgacactcacctccttcagcctcttcacagcatacaccgtgttcctcatcaccgcccggtacacgcacccaaagccaccctccccgatcttgagctcctccgagaagttgtgggtgccccgggaaatctcacagaggggccagcaaaacggaaaggggcgggctccctgcaggagggacactgagctctctgggcctggctgtgggaagagagcctggatcaggtggggtccctgtctcttcccttctgcccaaggctccaggctctccccaccacagctgcctcccagctgacccagcttggctgactggggctctgcgctacatcaaaggctgaattccttcctccttgtctcgaatcttccctggggggcaggggacacctaccttggtagaagaaggggctggagatggcggtggaggccacagggaagcagggcttgggaccaggccgagctcaggccctgaatgggtctgggagcctggaaaagcttcataaagacaccagtgagaggcaggcagagaccagcagcagggtctacagccgtggccgtggtcaaggtgggctcttctttgggtccaccgagcctaacaaccgggccctcttacctggggagaggaaggtggaggctgaggatggcaacttccgggggctccaggcctcggcctcggcgggtgcagggatgctgctgggcctcggggcagtggtgcctggggacggaagcggggcgggagggtgccctgggacgccaaggaaggaaaggaaggttgaggcccgggtgggggagccccgtggggcccgccggcctcccagccgtggggtgcccggagtcccgcgctcacaggctgtgatgatgtcccgcgcacggagcagctgcaggtgcgtgaggatgtgcacgaggtcggccacacgggcgttgcggttgatccagggccacaggacgctggccgtgcgctgcccggagcgctcgcacagccgcagctcggtctggtcgcgcacgatcagggcggctgcggggcggggggcgtcaggcgtcggcgccaggagcccgcgcgcctcccgccccccggcagcccgccgccacccaccgaactggcaccagtcggcgggctccagggcgtccatcactttgtagaagcggcacatgacccagggcggcacctcgtacaagaagtgctgggcgccgggggctgcgggctcccccgggcccggccccccggccatggctgccgccgccgggccgggacctgccggggcctctcagggccgcggcgggcgcgggcctgggccggccgggtccgcggacactgactcacttccccttcgagccggcctcgtgcgacgcccggcggggcggaaggggcggtgcccgggcccgccgccatcttgcgcgccgcggccgcgcgctgggtcacacgggggcgccccgcgccggggagggcccgggtcccggcgggttccgcgagcggcgatcggcctcccgggctcgcccgggcggggctctggaggacgaacggcggctcccggcgttggggacagagggcagggcggaggcccgggctgctcggaaaggggccggggccgggccttccgaaagctcctgggcggccctgccggaaccctgctctccactgcggcctgcagggctgttaccaggagccctgcctgcccgccccacgtctagccccctgcacacggcagcagccttgagccattcagtctccttaggtgtcctgaaatatgccgagaacgctgcccgccacagccgtgagtgtatgcgttgctgctgccccagccctcatttggcaagggtgagctcaggcagctgtggtgaaggcttcctgagcccgccggcagagctcctgccaccccgtacctgtcccctcctgggcatcgtccttgattacttgtctggaccgccacccccggtccccgccctgagatggggaagaccccacaagcagcaacgcagacttactcttttgtttctccagctggatgtctcctccagcgacagttccccttgccctcttgatcctgacagcgaaggggttccccacccctagccctacagacttaggacttttcctagaaacgagaagtgcccaaggcccacagctggcccctgttggagtctctttcctgaagccaccaccactgtggccactcccaaggaagatgccaaccataccatgaaacccatggcttctcacgggacagactttactgagatgtaccaactcaagtatctgaaatgactgcacacccatgctaacctccacgggggcacttggtcctacttacacacaaaggcccatcagctcacggaacagggctggcatacgagatgctcaatgcatacaagttgacttttcaaccctgggatctacctttgaaggccaggccttccgagggtaccttctagcatgtgcatgtgaagctggactcctttgagcagttgtctcctccagccccttaccaacctggtgaggctgctcctgagagccaaggaagccagtaacaagggggccccctttgggcaaacccctcagcctgcccttgcctggtcagagaaccacgttagcagtcaacagagggcacgtgagggtcctggccagaatgagacacaggaggagccacagcctgcgggggtgggggtgtccaaaagcaccacagcacatccagacctagggggtgcccctaccatacgggtctggagcagggaggttgtgctgcaggctgactcatgccaggcccttcccgtcacacgctggagcagtgtgcctggagagcactggcttggaagaagctgaggggccagcgaggccagcatatggaggaggcttcccttggccgctcgtggcaggcctgaaggcagctacctgtgtccagggacagccagatccaatgaggaaacgcagcaccatgctgtcatgtgagctggagggggacttctgtcttataatgaaagcccagaccttgagtcactttcacagagagatttatcgagaatgctaacagcacaggatacagtacttcccaacaaaaggtgcaaacgcgtcacttagaaaggcatgctgagtattctttgctttcacatgtattaaaaaacttacaaaaataaaataaaactgcgtgctgcccatcttttccaatagtaaaagaaccttatgaaaaaatcacttgatttttacaacaaaagacacaaacggacatttttatgtaaatttataaggcaaactctttatataataaataggttacagggattcagtggggggggggtgtttttgaaacgtatacaggtacattcagacaggtttactgaaatggtacaaatttccttaataaattgccttttgtttttaaatatatcagtgctttcagtcatttggctatacacaaagaaccttttttctgaacactacaaaaaagcaatcaataatttttgtttttaaaacgacctacttattttctaaagtaattgtcccaaaacacaaaaactgaaggtgaatacgatacagggcttttagagacatctccagctaagtgtgtcccggcctctccctgtgccccaagtgcacctctcccaacctcagacaggtttccaggctggagccagctcccttctgcacagggtggcctgtgttactggcaatgctgtccatagctctcggcctctgggctggcacaggggagcatgacttcaactcaggagggggcagacaccctgcctagctcttccagatgctgcacccggcatgcaatggtcactacagtcagcactctccgcctctcagaggagggaggggctgtcaggtgttttgggagcccaaaaccatgcctaatgagggtaatggcttttctaaggagatgttttcgccatggaatgggaaggggttttctcacatctaagttttgctggcgatcgggtgacagccaagagagtgcaagccccctccatggtcattttattgccctgggaaggggagggtggggaatagagatgtcacagtgttgagccctggaggatggggtgggatgtgacggaagtgtcttaaacagtaatgcccacggggcacaccttggagagagaatgcccaccacctggcctgtccaggaagagctgcatctgccaacattagcctgacctgtgcccacagcagagcgtcccagcctcctgcttgggtgggcccagccccattctccccagctcttcagctctgcacacacacatcccctcctggctcccctcaaggaaacatcaatcttgcctttccttaaaagcacgggatggtggtaataatctcggggggaggggaagcaaaacaagaatccactgggcggaacaaaacctggttttgcagtgacttggaaagtggcaacacatcagctattcggcttgctggcttggagtgggactcctgggctccactgctttgggtggcttctggctgatctgggcaggggtcatctgttcagctctcccctctcatctcagtcaccatccccctccctccgaatgcttttgtttgtaaagaaaaagtgtctagaaatatttgtctctggaacaattactttaaacatagttacaatacagacttcagttcaaacacagaagagatttacttagcaaaattcctttcacccaccaaaaattacacaaatataagcctcaacaccacagttaagaggaccagtagagagaacctcatgtttggaacacaaaaggagaaataaaaaccaaaccaaacccaaacagaaaaaccccagaaagacaagtaaagggcaaagaaggaaggggaaggggagcaaacacagcacacgttacagtgtccagatacacgggagcccagcatgggcaagggctcggcacacattgagtaacagtcctggtgatatttggtcatatattcattgactactgactctggagcggctgttattgattgaagcagtgacaaatcaaacggaaaggaggccgtggtagcaagggaaggagcaggcttcaagttctgcaagccttttgcactccactgtccagctccccagaaacactgaaccgggtgggccccgctccatccgggcagggctagaggtcaccgggtgaggctaactcgggcgtcgatttcatgtcagtcagaaaacacgcacgtggacgcacgcagacacccacctgttcacggccaaacatcagcggcaacggcctcctcgcctcctctgcccctatcccaggctgggtgggaaagagcatcatgacccactgctaacactgaacacacgccggagctggccccggatgtgggcccagaggctgccccagccctggtcctccgaagggctcacgggtagcccggccactgaaagggcctatggctgtttttcttttggattcaggcctcagaagaagcaatgacagcagggagggaagcttttggccctggtgattataatgctctctgctttggaagaacaagtttctggatttttttggtgtttctaattattaaaaaaagatgatcaaaaagaactgttacagctaaactctctagcagatattgctcattaagaattacaaaagcaaatgcaattactcgtaggatgggggagaagaaagggacatttctggagtcttcactactcctggaggggaccccttggactgacgcacatgattctggggtccctggcgttctacctggtgcagctcacaggttccgagacaggccaggcctcccgtctccgctccagcccccaggctcgacagagtgggaaggatgaaacacactcggaccctactggcagggaggcctgcgaggctgactccacatgggctcaccctgaccaggtcacgggaaggggactgggggagtcaggccaccccagtggactccagctcccagaggtggaaggcgaccaggctgtgccgactacgttccggacttcagcaggtcaagggagcgctcctgcacccagaaccttgggacctctttcacaagcacgggagaaacaagagtgcaaaacctgggtgctgcctggagcctccttcacctggcacaggaaagcccttgaaagaagcgaggaaaagaccacgaatctgcttggacagaagaagtgaccagcagacagatttgtcgtttttttttcttttttttctttttttattttcccttgtcctatgctatggttatcagaaatattgtaattaagcaacaggtataattttaacaggtctttttttgtgtgtgtggagccacaagcaaaatgagtttataattgtgcaatatacagatatatatataaaaattcaactgctttgtgtgtctagtcggtgcgttaaataaaagggacagaaaaactaaaagcaaaactaaaaagcaaaacaaaagcccaggatagaggagacaaagcaggcctatgcgcacagtctatgtgttactggatataatcagggtcaccaggaagaacagctttgccacttgacacacaaacactgcggggagaggggctatcagtgggcaggagccaaacctcttggccttttcacctcatctgctctcactgctgagcaggacctgattaaaggtaggacagaatgggggtttgggggcaaagagatttccaaattccccaaatgttcttgaattcaaaggtaggatttcctccagggtctgggctctgcctgtgcacaagtcggagcccggagcgggagctgggggttgtgctccctccttgcactgccctcacacctgcttccttctgcctcctgacagggcaggcagggggccttggggaggcagtgagaggccagctcagaaggctcagctgatccgaggcgagcagagcaggagtgggcaaggcaggctgcccctcaggcagaagtgccttcctagttccctgggtgttttcctgacacgtcagcgctggggcaggctctgtcaagatgagaagagtgggaaggagggtggtgctgggccttccaggtcactggtgaacgctccaccttccataccactcccaaaagacaggttcagaagccatgtcctcaggtcggctacctccagattccccttgcctgtaatgctcaccaggcatctcaggccaagtgctaagtatttttagatcagcactgttgtaaaagcttgctcgtattcattcaaaaacatcgaaatgtaattttctgccaaatgttttctaggttttccttctaaattgttgagaactgacttcagtgttcagcttttcccctctaatatgtaattttagaccctgggggaggcagtatcctaacgatttataacaagtagactatgccttttctaaagattgatacaatatctaaaagagaaagacaccaaaatggagagaatcaacaaatcccgtcagagcagagagaagagtaggaagacccggagggagcagggctctgcccccccaccgggcaggtcctccagacccactccatggtaggaactctagaaacagctgactccctgaagtctaggacacaggtcctagaatctgcaggtgtgaacttgaaacaggaatccatttggggcaatgacacaggctaaaaatgtatatgcccaaagatcttcttaaagaactggtacctgtaacctcccctggcccagtcagcccagagagcctgactggaatgctctggaaaaggagctgtggttagacgggggacacagagttctggctgtcaggctccacttgggctaaaccaattccagatggtcccgcgcaggggactccgctcgtatccctctgctccctcctgggcttgagccgcttactaagtgatttaaaattcagagattctgtcagctaaagaaactcctttctccacccaacttggcagtttgtgtctggttattaccctctttcgccatcactgtcacagcaatgaaaagctgggcagagaagcaggtgacaatttggggctgctccctgtcccaggtgcactgttcatgcttcgggcctggaatgatgccacccaacagaagattgtctgcacccgcactggcgctcacgagtagcagcttccgccatccagcgagctgagaagctggggccgttggctagtttggcactgatggattgggggatgtggcgtttctgggtgtcccctgtgtcttttgatatgggaatacagcatcaacagaagggagctgtgctagcgcctggctgtgaccaagtatctccagctcactgagctgtcaagaccggcaatcccactggctatgacaagcccaccagcaggcagggccgggaggggtagacctggggggagctcgacgacatacagtattgtcaggagaggaggtagtaactaacaactggaacaagggtgggggagactgtggatgtggccttaatgacctagccccatgggtactggaaagctgtcggtcaattctgctgttcacaaattcactgaaagaggcccccatcttcataatgttcaagtacagacaaaattgaaattgaggtcacaccccaaaactgggccggacacagctggtgagaatcctgcagcttaaggctttccctccaacctcctgtcaacctgaccccaaggcaggggcagcatgagagctgcagggcccctgcctgccagggcgataaaccgccaaggctgcctgctgaaaggcgactgactcgtgatgcctttgggaaagacgagggaatgaggaagaaagggggaaatagagagaaaaccctaaggagcctcaggccccactggcagctctggaataaactggaagggaaagaggctgggcaactgcctctttgagggagctgcaggtggggcccgaatgaaataaagtgacgcttgaaatgctgtgttcccaaccacgactgccccatcggccctgaatgaactgtcatgggtgacaggggggcctggtgggccacgcactcctcttaccaggaccagatgacgcccaggtgacggggaagcagctctggacaatgattccagaagccacattacatttgactaagtataatacataaaaacccaactgaccaaaataaacatcttctcagtgacaacctggtcggatgctgcgctctcgtggataagtgtcctttggtagtgccaggagttcgaggccactatgggggcaggagccttctgtccttggaggaagagttctggaggactcaccctctcttctgaccccccttcccttcctggggaagagtcagaagtgaagctgggggggtcatcagcagagcaggtggaagggatcagggatcagggattgggctgatgggagtttggttgcaggacttgcttttacagcataaggaaatggacacatatatgctagaaagtccaactatgagactctacaaacagaacggggcaaactccctcacttctaaccattccagaagagacaaacacggttttttcttaagctactgattggaactgtcaactatggttcctgatcactaaagactggcaaggaagtgctagacagtttctatgatgtttcactccttcatgattacaccatagtaaggaagccagggacaataactgaaatacacaagacaacacacacttgacagttcatggcagcagctcacatgggacatgcctgtgggtgtttctggaagcataagactgctgtctcatttgctactttgataaggtacttctcagttggacagatttagatataagagacatctctgtaaacacagaaaaggatataccaatatgatgaagatatgcagctagataaggacttcctgaacagaggttaaaaagatgggatcccacatgaaaactgatcaattaaaaacccacagcaagcccatgcctctaagcccctacaccacagctatggaccagacagacagtgaaatgtgtggtgttctggccccctgtctgcatcgagcaaaagcaaaacattgccattcaagaagaactccgagggaaaagggggagcagaggaagggctggggacccaggtactggtcccagctcgggtcttgggagttctgcattggtaccgctactgccctgctgcactacgctagactctggacttctgagtgaggtcaaggtcggctggcatggagcccctgttgggccactcgatgactggcaggccacaggaggcctctgtgctttcctcaactaccaaatcgggcccagctcctccagtccacttctctagagtagaagggtgaaaaggctcgttgttcagggtgggaaatgccttttgctttttcttaccagggaagagggggctacctaggagagcaagaccttgctgctctcttgctcttcacagacaggccaggtcggactcagcagagcccaaggcctcctcagggctcaaaacagggtggggctggtactggcagcaggaggacaaagggcaggcagagttctggggactggagccgacaagtgtggttgggcaccgcggctgcctggaagagaagggatgaactaggaaggaggaggatggaggaagggaaagaagtgaaaggatgaaatgaacaaaaggcagaaatggaaggggagaagagaaaccaatcaggaagtccttataaaattgcagcaaacacttagagtttcggagcttcgtgggaaccctatgtgctgagcccactttaaaacaagcgcaggtatatatacaaatccaggtagttctcaacactgtcacatctggtggcttgagggactaaatgtcaccaattcaagccagtttgctctcagagcatctgtttgttttgaagtgggaacatgaagactcaatagtgcaaataattctaagctgtccctaaaggagaattggaaagtaactggaagaacattttcttctcctccccctttgccccctcccctgtccactaagtcacagactgctctgagtgattaggaatccctctcaccccgctgtgctctgcccggcctgaccccaggccagcctgcctgcaccttgtcctactgcctccatggcctctagcgccacccgttggaggacgtcccttgagaatggaccatgccacctcaccctgggccatcctctcctgtggttcaggccagtctacacccagtagttcaagggactcccccctcctagccatgccagagctggagcagacaggtgccactttcctgtcctgtgaagcgtccttgccagttttggattggggctggtgtggggccagacttgagccaccacgggtgggatcgcacaggccatagccactggtcatatccatcttctctaaagaatccaactgtctctcctgcctcacacctccctgtcccaacgtggttgggagtgggggaggtggggggagctgggggagctgtagacggggcactgatggcaccgaaaacgggagtgtcctctcaactgctctgtcgctctgtctctaacgaccacatgggggaaaggtttgggcgggaggggaggtgcctggtcaacagcttgtctggtcagtagtatctgcagcaagccttgttgaaggagcctagtttagaaaagtgcaaagctacttctggccctggttaggtcttcaacctgactgtgcttgtcggtaagaaaaacatccccaatgctccaactactcccaccctgaagccacgaaactctaagtttactgaaagaaaaaaaaatattttttatttcagttaatcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaacttatggtgcgcccacacactggagtactgtgcagatccaaagggactaaacaagagctctaagaactgcgatggagtcatttccaggatccactgtgaagcaaagggagcaaagcgcaaacatatctactgcattctaccaaagaaagaagggggggtattaaggaaggacacaccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgtatttttagtagagatggggtttcgccatgttggccaggctggtcttgaactcctgacctcaggtgatccacccacctgggcctctcaaagtgctgggattataggtgtgagccaccatgcctggccctaaatgaacttttaagagcactgaagatgggaaataaagggtctttaactctactgtaatattctagttctttctaatggaaattacttgaagcaaatatagtatgatgattttcaattctgtgcaatgaaaggcacatgggtgtttgttaatttgctggctgctacttttataattaaagacaaatttcaaaaaacccacaaagaagcctggattgtgctgggtgtggagtgcaggtaaaaatgataaaaaacgtggatggagctggagtccattgtcttcagtgacacagctcagacacagaaagtcaaataccgtacgttctcacttagaagcaggagctgaatagcatgtgcacatggacagagtgaggaatggcagacactggagagactgggaagggtgggagggggtgagggatgagacattacttaacgggtacaatgtccactattcaggtgatggttacactgaaagctcagacttcactactatacaatatatccacgcaacaaaactgcacttgtaccctttaaatttaacaaataaaaaacaatgatagaaaacaggtattccaaatgagtttacccttagcccagagggcctgcccagtcccagggtgacctgggcatttgcacaccctcactaagccttcactgcaggacccaagggagggaggctgggctagggtgccaggtgactccccaaggctgtcccccagggggtttatggtgtttgccgaaacacaaactttttcaaagaaacctgccaggtgtggtggctcatgcctataatcccagcactttgggaggccgaggcaggtggatcacctgaggtcaggagttcgagaccagcctggccaacatggcgaaaaccccatctctattaaaaatacaaaaattagctgggcatggtggtgcatgcctgtaatcccagttactcaggaggctgaggcaggagaatcacttgaacccaggaggcagaggttgcagtgaaccgaaatcgtgccactgcactccagcctgggtgacagagtgagactccatctcaaaaacaaacaaacaaacagaaaacaaaacaaaaaaaaccccatacacctctcttcatcctccctctaatcagaaccccccacacacacacaatcttgattatgaggagaactaaatagctagttcacaagttcatacattttacagttgaagtatcctcagaaaaaccacctattcaactcctgagtgttacagatggaaaaaaagaagttcgactagacagaggaacttgtctgagatcaccgtgagtcaaaaacacacgtgtctgttcaccaactgccttcgtcctgagccagatcctgcagcatccttccacctccaagaactcacagtttggaagggaggacaaataggtaactacaacatagttccagcctcccttccccctgaagaaagcttgctccaggcacagcggaagcacaggggtgtggataatgaatcaggagtgagtgggctgtcagggcttatgagttccacaggtgggacagagggctcagggcatgccaggccagatgggcagaggcggcactatcaacatggttatagctcccaccctatcacccgtgtgacgcccctccctcgaggaaaaagtgaccaatgatgcccaccctgtgtcaccagaggctctgggcctaaccctgtcaccccctcccaccttttcatttggagaactttcaggttcatctggagaactttcatctttcaggttcagttaggatggcacttctagaccgggcgcagtggctcatgcctgtaatcccaacaccttaggaggccgaggtgagcagatcacttgaggccaggagtttaagaccagcctggccaacatggcaaaactccgcctctactaaaaatacaaaatatttgccgggtgtggtggtgtgcgcctgtggtcccagctactcggggactgaggcatgagaatcgcttgaacctgggaggcggaggctgcagtgagttgagatagtgccattgcactccagaccaggcgatagaacaagattccacttcccaaaaaaaaaaaaaaaaagatggcacttctgagacaccttccctgctcctgcctccctccctgctctatgagccagggcacccgagccctcagtgtacttagaacaccccactgtgcgtgccaacccccatctccccgctcaatgcataatgccaggcacaggtgcaacccttactcaacacatgctggatgaataaccacaacacggacgcagcgctccacgtgcttcttctgatggctggagaccttcgaccgtaagcttctagcaaggagaggctagctcagtgctgaaaaaaaggtgggctctgaattggtgaataaacaaatgatgagtttgggacatatcagtagtccgttggacactggtggcttggagatggcggaagatgaggtggaggaagtcactgaggagggcctcagtgccccagggacagtagcatggaggatggttacgccagaggatggatcgacttctagccatgtggtggtcaggtatgcagacacctctcctgctgaaacaactacaactgccaaactgagtatcttacagaagctgctagagaagccacccacaagctggcaagaaaggaaggaatacacaggctgaagagcaaataaaagtacggggcccttttctgtggagaaatctggcaggcaccaccttaacacacgaccaaactgagctcaggcccctcagtgctgctgagatgaaccagcatcacgagtaggagactgaagcttaccgtgaggagacagcaggaagagtccagagagggcgtgccatgcaaccacggtctggactcaagatgatgagagaaaacaagggggtgggggaacatttctgataaaggagactgaagggatgacacaatcgaatacaacacacagtcctggactctgcattccaggctcaaaggctctaaaaaaggcatttatggggtatgtggagaaatgtaaggttctgtgttagctcattgctaaacttcctgagtgtcttaactgtactgtctgctcttaggaaaggcatgcttaaacgtttaggagtgaaacagcacgaggactatgactaactctcaagtgatcaatgggctaggggaaatacagtgccaatatggtaacatgtttaaaagaagggagatgacatcaatataatcagaagctatgccaactgacagtaatattttgaagcagtggtaggcaagctttttaacaattaaagagaatgccttcatattacacaaagacattaagaaaaaaagctgaaggctgggcacggaggctcacacctgtaatcccagcactttgggaggctgaggtgggcggatcacgaggtcagttcgaggccatcctgaccaacatggtgaaaccccctctctactaaaaataaaaaattagccaggtgtggtggcgcgcacaaagggaccggggcggtgctggcggcgatgccaacagacctcagtgtactgtggggttctttcagccagaactgttcatggtttcatcagtgagctccagttaccacaccacacaagtttggagtgatccaccccgccccagtttttcctgcacgaactcatgtttttattgtgtgatttacagaacacaagatctttttctaagaatgcacacatcacacgttgaagcagaaaggcctttacaaaatcttaaaatacctacaaaatatgaagtaaggctcttaagaaataaaatattcaatgattttgctgctagaatgcaaacattagatcaaatccttcatttgatctagcaaaggaaaattagagttgcaggaatcttgttttcaggccaaaccatgacatcctgaggggtctgatggcaggaactgcctgcattttcctcatgaatgtgacctgcagtgatcttgtgagaaaggcccggaaggccgtgcaaattacaggggtacaagcaacagctggcaggtgtggccagacaggcaactgcagttaaggaaagactactcaatccctgaggttttcagattttacaaaaaggcaaaaaagccaggtgaacaaggcagatgaaaggtatttttcacttgaattggaatccagccccctccctgtcccctggagtgagctccagagaaacttccagagccccagcaatatcccaacctttcgtaaattcactcatgctcgccactttcaggagatggcatttctcagcacctttcacttccagttatccctcggcacagcacaaagagctaaactaccactcgaggcagttaacctaagggcagggtggtggctacagctccaggtgaacagtctgggaccagaggaaataatgagcccccccttgtactggctgcttccaccctaaagtgtcatccagatggtgtttccaattctttctacttccagtattagctgcagaattacggaatcaaggaggcttctctgcatgaatcaataaaggctatagcactttgagacacaagctttggccctttaaaaatgtgagaaatcaaactggcacaggcagagtgtctcagtggtctccagggagcaagagagaatgaggttcagcttgaaggctacaagggtggagcctgaggttcagctgccctgctctgaattcgcagtccatttcttaatcctccacttttgagaagatgcgagaaaccagttatgttttgctaagcttaaataaaatgcagttcttgccaaccaaaagcagaaccctccccaaatacaggcaaccagtgccatacagcaaatctcatctttatagatgtgtaaaatgaaaaccgaaacacaagcccaccacatacaggttaaaaaattcctgctgtggagaacagtttggcagtttctcaaatgttaaacatggagttaccatatgacctggcaattttactcctagccatacactctcaaaaagccacaactatgccgggtgcggtggctcacgtctgtaatcccagcactttgggaggctgaggtgggtggatcacctgaggtcaggagtttgagaccagcctggccaatatggcgaaaccttgtctctactaaaaatacaaaaaaatttagccgggcatggtggtgagtgctacctgtagtcccagctactcaggagactgaggcaggagaattgcttgaacctgggaggtggaggttgcagtgagcagagatcgtgccactgtaatccagcctgggcgacagagcaagaccttgtctcaaaaaaccaaaacaaacaaacaaaaaaccaaaaccagtaaccaaacagatatccgtacaccagtgttcatggcagcacagtttacaacagccaaatggtgggggcaacccaaatatgcattcccaagggatgggtggataatcaaaacctcattatctataggatataatatcattcagcctcaaaaaggaaagaaattctgacacatgctacaatgcagatgaaccttgaggacattacgctcagtgaaagaggccagacacaaaaggccaaatagtgcataattccatttataggaaatgtccagaataggcaaatccatagagacaggaagtggatgagttgttgccaggggctgcgggtaataagaggtgactgctcctgtgtctggggtttcttttgggtgctgaaagtgttctggaatgacacagaggcgatggttgcacaactctgtgaatgtactaaaagacactgaattgcacattttatttttaaacaattttttctgtgagcctatgaattatactgaagaatgaattgtacactttaaatgagtaaatttcatggtatgtgaattatatctaaattaaaaaaaacaacaacattaaaacagcagctgaccaccaattattctaaatcataaagataggttttgtgatgcctggccagtgctcagagcccacacagctgtctcagagcaagtctatctggctgtggcacagagccccggcagatagatgggctgtccgtctgaggaagaggccaatgtggggacctatagtgatacatgacagactggaccaagccaacctgaatgtgaaactctgaagcccaggacacaataaccatgacaatcagaaaggaatttagttcaagaagtttaatgagtaggcatttagccaagtggaaggttgttggctattctgaggacatttgatcttttttttttaattgtggtaaaatacacataacataaaatttatcattaatagcatttagtacattcacaatgtcatgcgaccatcactactctctagttccaaagacaaccctttacccattaagcagttgctccccactcccactcctctcagcccctggtaaccactaatctatttgtctccacaaatctgcctactgttgacacttcatataagtggaataataccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaaaaagggggaaaaaagaccaggaaaaaaaaaaatcccaaaactaaacaacgaaaaagttttttttagggagatagggtctcgctgtgctgcccaggctgggctcaagcgatcctcctgcctcaggctctcaagtagctgggactacagatgagctaccacgcccaacttagaaacatgtatttttttcagattagctcatcattccctggtaacttctccaatgatttccccttgcatctctgccactatattctagcagggttctcacactgatcctacacacaagtggttagagactcaccaggccaagctcacctccaattccaaatacctagtcctcaaggtccaagtggcctgtttccatagacactgacactgtgcatgacttttctgtcctcagctgctggctttctccatttcttgttgataatgtttttttcttacctttacatacttcatgtaaataagtttcacagacttttaacaaagtgttggctgcttttatcaaagaagagaaaatctgccaaaataaattttcaccatgaaggcaacacattttggggaacaagaaagggcagaaaggagatctcttttactagagaactctgcttaaggactggctcatttgatccaaacatctcatcagtaacttggagtgagtgcccttgttttcgtcatcttgcgtctcactagtgtaggtcagtccacatcagcctgcctgacgtacttggttcgtaatgctgacatctgagcccccatgtttatttcaccctgattctactgaaatgaccaacgaaatgcaaaacaggaggaaatatctctatcaatgccttcagaggaaccgctgtagaatgtggtgtggctgggatccatgcgagagaagcagctctcacacgattccaccacagttaaacacatgggcaaaggagggacctgccggaggtatgaggattccgtagcagagcccaagaaaatctgcaagatcagagaaactgggcctaagagccagactggcagaagtacggtttgccggtggcaaatagaaggacctgaaccaccagtgccctaggtggagaggtcagtgacaggctggccaggttttcctgggcactgctgggacagagagagacaccaatatagaggagattctacctgtctcaagaatctgccagcagcaccctgggtccccaccctgactccagctgctgccacaggggaagcagcagggactgaagctccaccccataaacaactctagggactggggatcaaacaagtaccaacaaattagtaactgtcctgtgtacaaatacaaattaggtggaaactataatgattgaacaccagtcattccagtcaagatcccaactggaggccgggcgcgatggctcaagcctgtaatcccagcactctgggaggctgaggcgggcagaacacgaggtcaggagttcgagaccagcctggccaacacagtgaaaccctgtctctactaaaaatacaaaaaaattttagcctggtgtggtggtgcgcgcctgtagtcccagctacttgggaggctgaggcaggagaatcgcttgaacccaggaggcggaggttacagtgagccgagattgtgccactgcactccagcctgggcaacacagcaagactctcgtctcaaaaaaagaaaaaagatctcaactggattttctttggaatctgacatttacctagaataggcatctgaggacagccagaaggagtgtgtgtgtgtgtgtgtgtgtgtgtgtgtgtgtgtgtgtgtgtgtgcagggggggggatggcttccttctggtagccactgctctagggagtatttctcaccatcatgtcacaaagcacacaacaggagcactctcacatggattagggaattagatgcagacctcctgcacaactgccctcttccagtcctagtaagataagacacaaaagaaaggcagggaaggagagtgtgaagggaagatttcagcacacaaaggaaaggggtgtaattcaaagcagtctgagaaaagactccagaggacaaagcagcagcaaagccaggctcctgccccgtcccccagaaaccaccctagggagcgggcaacgccctgggaatttgcagtcagtaagctggagagaagcaaccaagtgggagtccttcactttttccttttagacccagaaactccagctgggaggtgcaggagaaatggcaaagtgcccagtgagccagcccagctctgtgggaagcaactgctcttaggtatacacagattatggaaccacccagagactgaggtgccccctatccccatggaaatggcacacacatccctcgtgcagctagagtgagccttagtaagacatccaacacagttcttagaacaaagagaagaatccagatagggctgaagactacatggctgcagctccctccagcgtgcaaattctctccggatacaagataacaagcctgcacgcgatagctcagaggggaaaacagcaagagaagatgccaagaaactgggaagagagagccaagaattcctccactgtctcaaagcaaacagaacgactatgcagagccatccaagcctgagccaagacgaaaagaagtgacatggtaactaggcaaacatattatggccagaagaaaaaaaagaggcccagggagggagatggcacgagaaaggcaaagtctcccaccaagaagagaatacacaaggaagggaaaaaaattccccacaacttcataagaacatgttcccaataaaagagttcaaagatgggatgataaaacagaataagatgaaaagacaaatttccaacctagagaaacaaactgcagaccaaaacacatcattatgaaactaataaatacattgaaaaacagccagaaacagaatatacatagctgaaaatcaaattagacaaagtgaatgcagatgaaaaagacaaaagctaaaccaattacggcaaagctaatagcattggaagagagacaaagacaatccaacatgaggaatttgtgtccctgaagtacagaactcaacaaatggaacagaagatgctgtcaaagatccataagagagctgacctgaaacagcaacgactacatctgcagactgaaagaatacaccatgttcccaggacaatttgataaagaatgctcaatagcaagccagactctagtcaacctactcaacttcaaggataaagaaagcattcttcaggcaccttgggattcttccaagggggaaacatcagaagaccagacagaatgtctacaaagttctgaggcagcttagcgcagtggtggtgggggagaggtcagaggtaaattcagagagatggacaggggccaaaagcctctctgagaagacgaaatctgaacacagatctgaaggaagtgagtggtgagggagcaggtcaagtaaagaggggtccagccaatgaggagcagcaagagccaaggctctgactctagcaacattatggcaagttccaggaagagcaagagcagtgggagccaggtgagcaagggagagaatggtagagaatgagctcaaataggcaaggagggatcatgttccatgtggctgctgaggcaggcccagttacacaatttgtggagcctggtgcaaaatgaaaatgcagggcctcttgttcaaaaattaagaattttgagatggtgagagtagagtattaaaccaagcctgggttccagcaagcccatgggcagttacaaaggcccatgaagctggctctgctttcaagtaatggacttcgggttttattctgagagggtttttctcaagggagtaacctgatctaataaacatttttcaaagagcccatctgaggctgggcacactggtacacgcctgtaatcctgcattttgggaggccaaggcgggaggattgcttgagcctgggagttcgagaccagcccgggcaacatagggagaccccagtctctacaaaaaatataaaaattagccaggtgtggtggtgcatacctgtagtctcagctacttgggaggctgaggtgggaggactgcttgagcccaggaggttgaggctgcagtgagtcgtgactgtgccattgcattccagcctgggtgacaaagggagaccttatctcaaaaaaaaaaaaaaaaagcccattctaactatgggaagatatagagtagagggagtggggcaggagggcacaagatgccacaggggggctctgcagaagcagatgttgggtcacggtttgaggtgtaagatgttcatcaggaactgacatccataaagggaggtgggaagaagtcaaagagaaggccctataagggccttgtacccttacctcgctcagtcaccagggtgctgtcctggaaatggcgtgaccttgggtgaggaggctcttgcagctgaggctaaccggagtgtccgcagggcatccagagaggagagtgacctccgggtctgccacgtgagactactgcagagtctaggcagggatgcagggagctggtctaggtgccatccctgaagggcatgggcaccgggacagcgaaagggcgagagatccaggactctggcttccgtttctcatgtttttgatactgaggtatttagctttctagaggcctaaagggcagctggatgtatgaatctggagttcaggggagaggtctgaagagccaggcgagtgcgtgagggcgtgctgaatataagtgtaaacaaccctccccctgctatttggagttgtgatgaggagaaagaatcagcagaggagacagagaaagaggagtcagtgcagagaaggaagatcagacatatctgtcaagattattggtggcaatcaatagaaaccaactctagctgatttatgcagacaaggactgatgaaaagctattgaagatgcatgtggtgatggttgcacaatataaatgtgctcaataccacagaattgtacacttaaaaatggttaaggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaatagtacagactggggggcctattcaactgaaatttctcacagttctggaggctagaagtccaagatcaaggtgtcagcacattcagcccctggtgagggctctctttctgacttggagatggctgccttctcattgcatactcacatggtggagaaagcaagctctctgctgtctcttgttataaggacactaatctcatcatgcgaaacccaccctccctcctgatttcatctaaacctaaccacctctcaaataccccatctccaaataacatcacattggaggtttgagcttcaacactggaattttgggggacacaaacattcagtccataacagtgctgatgtttatgttttaatgttaaatgataacagcacagcacagcagcacacacactgtgtgatgccaatctgtttgtttgtttgtttgtttgtttttttagataggttctcactctgttgcctgggctatagcagtagtgtgatcacacctcactgcaacctcgacctccaggttcaagcaatcctcccacctcagcctctcaaagtgctgggattccaggcatgagccaccatgcctggcctccaatttgtatttaatgccactgaactgtacatttaaaaatggtaaattttaggtgatgtgtattttactacaatttttttaaaagtctaagagaaggcaagaaaggagaaggaaaatttaaaagaacagaaaatatggaaaaatagaatgcacaaatatgctataaatgaatctaaatacatcagaaatcaaatagatgttaaaggacgaaacagacaatggattttttaaaaaatctcgaggccgggtgcggtggctcacgcctgtaatcccagcactttgggaggctgaggcgggcggatcacgaggtcaggagatcgagaccatcctggctgacacggtgaaaccccgtctctactaaaaatacaaaaaaaaaaaaaaaaaaaaaatcagccacgcgtggtggcgggcacctgtagtcccagctactctggaggctgaagcaggagaatggcatgaacccggggggcggagcttgcagtgagccgagatcgcgccaccgcactccagcctgggcgacagagcaagactccgtctcaaaaaaaaaaaaaaaaaaaaaatctagctatcagctgggcatggtggctcacgtctgtaattccaacactttgggaggctgaggcgggtgatcagctgaggtgaggagtttgagaccagcctggccaacatggtgaaaccacatctctactaaaaatacaaaattagccgggtgtggtggcacgtgcctgtagtcccagctactcaggaggctgcggcaggagaattgttttgaacctgggaggtggaggttgcagtgagccgagatcacgccattgcactccagcctgggcaacaagagcaaaactccgtctcaaaaaaaaaaaatctagctatctgacattttcaaaagctccacctcactgatgcataaagacacagaaaggaggaaaataaaaaactgggatggccgggcgtggtggctcacacctgtaatcccaacacttttagaggccaaggctggtgaactgcttgagcccaggagtttgagaccagtctgggcaacatggcaaaaccctgtctctactaaaaatacaaaaacttagccaggcgcgctggtgcaagcctgtaatcccagctactcaggaggctgaggtgggaggaccacttgagcccaggaggcggaggttgcagtgagctgagattgcaccactgcactccagactgggtgacagagggagaccctgtctcaaaaaaaaaaaaaagaaagaaaaataaataaaataaataataatttaaaaaaaaataacatattagtatggtcgcttcataataccaaagggttcaatacaccaggaatgtgaaactgtatctaaaactgaaaatgtggcctcaaaataaataataaaatgaaaatgaccaaactctgtggagaaactgatgtgtccatcaccacagtaggttttaacacgtattccatcagttgataaatcaagtaaacaaaatgacagtaagaagagaaaatactttcacaacaaacggataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcctcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaaatatctttgggctaacttaaagtgacaatactatcagaacttgctagatacagttgaagtagttccagagggttagccttaaatgtttacatttgaaaaaagggtagaaaaatcaatgaaccaaatttataacttaagaagttagggccaggcgtggtggctcatgcctgtaatcccagcactttgggaggccaaggcgggtggagcacctggcgtcagcagttcgagacccgcctggtcaacatgccaaaaccccatctctactaaaaatacaaaaaatttgccgggtgtggggcaaatgcctgtaaatctcagctactcgggaggttgaggcacgagaatcacttgaacccaggaggtggaggttgcagtgagctgagattgcactactgcactccagcctgggcgacagagcaagactctctctctcaaaacaaaaaacaaacaacaacaacaacaacaacaaaacacagagaatgtactctaagaccatagaaaaaataataaagataaaagcaaaagcagaatttaatgaactagaaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgtacatagaacacctcaaaagacacagacaagaccctggatgcagccgttccctgaagagaggcctaggcagctgggagaccagggcagcagggacactcagaccttgcatcactctggagtttgcacttcctgaattgtgaagcatgcacatgtctcacttatgcaacagtgaatccaaacgtgcctgtatacaaggaaaggcctcacctggctgcgccgtggaggctggcctggcgtgtggagcaggcagaacattagcaagctaccgagcaggtgcaggtatgaacatcagctgacgctggctctttgctttctttttaatcttgacaaatttggtaggtgaaaaggcatcatttttgttctcgtttgcatctctttgattaccagcaggcagaactcttttcctatcttcattggccatctgtatctcttcttttatgaatttcctgttcatagtctttgttcattagtggtgactagtggtaagttagcaataagaactgtttgcattcaagtctagactgagaaggaaattaaaaaatctgcccatgtattctcacaataaatgactactgactagcctgagataattgtacccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtgtttttaccttgcccagaccctgcacactgcatcaaggtcctgagtttcaagcaacagaaatcaactctggttaaattcaatcacaaaggagttcttgggcagcagatctggaaatggagagagaactagagaactaggctcagaaaagcagcaggaatagaggctgcaccactgcaaacacagccaaggttatactgcagggacctgctggttgggacacccaccctgggcactgttgcatgtcatcactggacattagccaccactgctggttttgtgactcaactgccaccaccatgactaatccctcactgtccctcaagagtcaaagtccctgaaggcagaatgggtttggccaaacctaggcttcatcgccatcccctagtttccagagagcaaggggagggaatatatccattcccctgtggcaggcactgccagttgtcccccaacatccatgttctccatctgccttactaatgagaccctgcgctcagctaaggagagttattccccgcttcccagcagaccatgggactacgttatggctaaggagacagtggccgagtgcactcctgttcatcgttctctttcaagcttgctcttgttctactgactatgggcggagcacacctcccacccactgactctgggcttgctcacgtgttgatgggatgggggaagaagaggctttaagaggcttctgtgactctgctcactcctcttggactcctgacctccgcctacgaagagacttcccctggcagctgcttctccctcctgggtcctggaacgacaggcttgagaacagatctgaatcccatcttgcagctgacccagacccatgtgtgagaaataataattgctgttatagctactgagctgctggtgctgtttgttccctaggacaagatgatgggtgtgaagatggaaatggaaatattgaatgggcctagaagttaagatgtcaagtgccattttgcctttcccctatgacctctttcttcctacctggaggagtggatgcaatgactagagcagcaaccgtcatctcacaaccaagaggcaatcttgagaaatggaagacacccactgaggggccctgggtcctggatccttacaaagccactgcagtggtcatggacagcatgagaaggaagtacaccacaggcccccaaccccatcttcaggttttcttaggtagaaactagggtccacctgcctcttactaagatatacacaatggggagacttttaacacaaaaaaaggtatgaagatggtcagaagccaaaaaagcaacaaaatgttcatgatatgccgtatgtggggtttactcactacactgcttttccaccgagttagcataatcactataactcaacccattgaaaaaatgacaaaacagattctgagattctcttcctatttctgttagctaaaaaagcagcctttgaattgtttataagtgaattcaagagataaaaataaacccagataattcagaatgtactgagtacaacacatatgccttctatgtgataagctcccagcattatttattcaaagaaaacttgccttgttgcaaaaatataaaaaaacttaaaaaaaaaaaacaagtaattacacaacacaccacctcctacaacaccagattccttttctttcctttgtaacctgaccagaagaaaaacaaaacattgttcaaattgctgagacccacaaagttcaattagagcataaaaaatgctctcccaaaatatagctactagcagggaaatgagcaggctaagcctcctggtgaacctggacattgggcacaagtaacaggcacatttagacaccaacgaccagattccacatgactgaatccagaaaccctgccccttcccattcccttggagatccagggggacgccatcaattgctcactccttctccttacacatacagttaggggtgctatactatacaggggaaggcgtgaggaagtcacacatgctttggtgttcaagaagctcataaagccattagggaaagagcaacatgccagaaagcagttgtctcttctggctacagaggttgcaaaagacgtctgcaagggtcagtgagggcccaaaggagtagtaaccaaggccctgaagcctgcctgggagctgaggtgggcagtatcagcctcttctcaataatcagttcctaaggttccatccgagaaagtagaaaaccacagaggccattctcatgggtactttaagcagtacatctgttggcaaaacacaaatgttgttacacaaatactaagccacagattgcaaaggcacctgacagcctttaaaattcatttctcttgtttcgcaaagctgcactgggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaacttttacagcactatccactgtaaaagttgtttgagaaaaaataaaatgtagccagccttcagagcatatatgcatctttattttattttatttattgagaccaagtctcactctgtcgcccaggctggagtgcagtggcacagtctcaattcactgcaacctccgcctctggggttcaagcgattctcctgcctcagcctcctgagtagctgtgattacaggcacccgccaccacacccggctaatttttatacttttagtagagacggtgtttcaccatgttggccaggctggtcttgaacccctgacctcaggtgatctgcccgccttggcctcccaaagtgctgggattacaggtgtgagccaccacacccagcccagagcatatgcatctttaaaaagttgtcttcggccaggcacggtggctcacacctgtaatcccggcactttgggaggcagaggcaggcggatcacctgaggtcaggagtttgagaccagtctgactagcatggtgaaaccccgtctctactaaaataaaaaaaattagccaggcgtggtggtgcatgcctgtaatcctggctacttgggaggctgaggcaggagaatcgcttgaacccgggaatgcggaggttgcagtgagccgagatcacaccattgcactccagcctgggcaacaagagtgaaactccgtctcaaacaaaacaaacaaacaaaaagttgtcttcaagagcataatcaaagatactttcacttcttaatgttttgtttccatgtctcgtcacagaacatggtacagacaaatattagaatagactcaagggatcacttgattttaactacagaaactttccggtgaatcatgagcactgtcttgtttccagctgctgaagtatatgggcaccagacaagagcacagcgctgtcactcaaagccaggagtaatatggctgttaccatgaggactacttagcagaagataagcatctcattatgtctacagtgaactaaactattgttgccaatggtatatggattaggaccgactgccactgcccatctgcttatagcttagaatctggtgaatgcaaacaactgttttggggggacttctggcccttccttgggctctgctatcctggaaatggacaggcttctacaggggttcgatggtagccccgaatagttaggtgtatgtcttaacccccagaccctgtggctctgaccttatttggaaggtctttgcttctgtaattaagtgaaggatcttgatatgagatcatcctggatttagggtgggcctaatacagtgacaagcatccagagaagaatacggggacacagagaaggccatgtgaagacacaagcagagaatggagcaatgcaactgcaagccaaggaaagtctaggactgccaggcagccaccaaaagctggaagaggcaaggaaggatccatgctagaggctctggggggaatggagccctgcaacatcttgatttcagacccctggcttcctgcactgtgcaagaatacagttaggggtactttattctgactactccataaacttaagctctaattctcgctcagcttctgagctttaacaaagggtccgtgcaacttctaccgttcccgttccccgtctttaccaaagaggaagcatttactcaaagcccacctcctgcaacagctctagatgccgcttcccccctccacacaaggagtctgctcctccaggtccccatttcctccttctcacgctcccctctctcctgggccattcccagaaggatgtaaacatgctctcatattcacccacgtgaaaaacaccctcatccccctctaccccactcctatttttctggtcaccatcacaacaaaacttcttaaagagagttgtctatacccaatctccactccctcaccttccactcactccaatctggcttctgtccccatcacctctaattcagttcaccatgtgacaggtagggtttttgctagttttagacataatggatcttgttattcctgggctttaaagccttcaccagaggatggccaactgcctacatgtaattgccacttgacccttcaaacctcaaagaaaccgaagtacagacatatgaaagggaagaaatttctaacagaggcaatagcaggagaggacctctgaacggataagatacactcagcaaatttctagatgctggaagtaggcaagaacatgttgactaatggaacagagaggaatgtactacaagagagctgtagagcagatgagagcctgtatacctgtcagagccccaaagaagctctcagaccagaccagaccagaccagaccagaccagacgagaggaggggcaagcagtgctgtcatgtgtgcaacacctgggggctgctgactgccagatcccgacccacaagctttggggcagggcaccttcaataagctcccaggtgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagcccaggagttcaagaccagcctagacaacacagacacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtgacacagtgagactctgtctcaaaaaaaaaaaaaaaagtatccattaaaatattttcaccctttaaaaatcaggttgtctttttattaccgagttataggaattcttctgaatacaaatcctttgtcagatatgactttctattttttctatgactggtctcaactgttttcttggtggacttgtcttttcattttctttgagacagggtctcactcagtcacccaggctggggtgcggtggcgcgacctcagctcactgcagccttgacctccttgggatcaagcaatcctcctgcctctgcttcccgagtagctgggactatggactacgggtgcacgccaccatggttggctaattttttgtatcttttgtagagatgggatttcactgttgcccaggctggtcttgaactcctgagctcaagcaatccatctgccttgtactcccaaagtgctgggattacaagcatgagccacagctctcagcctattttcttttgttttttctttttctttttttttttaagagacactgtctcactatattgcctatgttggcctagaactcctgggctcaagtgatcctcctgcctcagcctctcaagtacccagtagtgactacaggcaagcctcaccacgcccagctctgtcttttcattttcttaatggtatcttttgaggaccaaaagttttaaattttaatgaagtccaatttattttttcttttaatagctattgcttcatgtatcctaataaatctttttttggcctggcacggtggctcatacctgtaatcccagcactttgggaggccgaggcaggcagatcacttgaggtcaggagtttgagaccagcctggccaacatggcaaaaccctgcctctactaaaaatacaaaaattagccaggcatggtggcgcacacctgtaatcccagctacttggaaggctgaggcatgggaatcgcttgaactcgggaggcagaggttgcagtgagctgagatcgcaccactgcactccagcctgggcaacagagtgaaattgtgtttaaaaaaaaccttattctttggactgcacagatattctcctatgttttcttgcagaagctttatatttttagcttttaaaacatttaggtctataatctctcatgaattaatttttatgtatggtgtgaagtagtgtcatgggttggactatgtcccccaaaaaagatatgttgaagtcctaaccctcagtacctcacactgagaccttagttggaaacagcgttgttgcaggtgtaattagttaaggtgaggtcacactggagtagggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccaggctggagtgcagtggtgcaatcttggctcagtgcaacctcccaggttcatgcaattctcctgcctcagcctcctggctagctgggattatatgtgtgcaccactacacctgactaagttttttgtatttttagtagagacaaagtttcaccacgttggccaggctagtcttgcactcctgacctcaggtgatctgcccgactcggcctcccaaaggccgggattacaggcgtcagccaccgcacccagccaaatttctgtggttttaagccacctagtttgtggcaactctaagaaactaatatttagggtaaggtcaaggttcatttttgtctggtatggatgtcatttgccatcatccggcacgtgctaaaagactttcctttcccgcaccggactgttctggtgcctctgttaaaaatcaaatgactataaagtcacatcacataagccccttaattttgttctctttcaagtttactttggatgttctaggtcctttgcatttccatatacgttttatttatttatttatttgaggcaaagtctcactctgttgcccaggcgggcgtgcagtggcatgatcttggctcactgcaacctccacctccgggttcaagtgattctcatgcctcagcctcccaagtagctgggattacaggtgtgtgccaccatgtctggctaatttttgtattttttgtagagacggggtttcgtcatgttagccaggctggtctcaaattcctgacctcaagtcatctgtctgcctcagcctcccaaagtgctggtttacaggcataagccaccgtgcccagcttccatatacattttacaatcaatttctacaaaaaaaaccctgcagttatgactggggttatgaatctacagttcaatgaagggagaactgacactgtaaagacacttagtctttcagctgatgaacatggtacaacattccatttatttaggtctttaatttctttcagcaacattttcagtttcagcgtgtaaatcttgtacatttcttattaaattattcctaacgatattgcatttgaaatttcatttctgattagtttttgaatgatctcgtaccctgagaccttgctgaattcactttttagttctagcaggttctgatagtttctttcacattttcgacattacctacaaatagaaacagttttacttcctttaaatattaatgcctcttatgttttttcttgcctcattatactggctatgacctctagtataatgttgaatagaagtggttagagtggacatctttgcctttttcctgattttcggggtaacatgttcaatatttcacaattaagtacaatctatctgtagctctttcatacatgcacttcctctatttctaatctgctgaatttttatcatgaaagggcactgaattttgtcagatgcgttttctgtatttattgaatagactatatggtttttctcctttattatcttttttttttttttttttttttttggatactgggtctcactgttgcccaggctagaatgcattggcgtgatctcagcttactgcaacctccgcctcttggtttcaaggattcacctgcctcagcctcccgaatagctgggactaaaggtgcgtgccaccctgcccggctaatttttctatttttagtagagacaggatttcactatgttggccaggctgctctcaaactcctggcctcaagtgatctgtccacctcggcttctgaaagtgctgggattacaggtgtgagccaccgcacccggcctcctttattatcttaatgtggtgaattacaccaactgatttttgaatgttgaagcacactcgtgtttctgcgaaaagcctcttggttgtaatatgcaggcgcacctcatttgattgtgctttgctttactgtacttcgcagatactgagtttttaacaaattgaaggtgtgtggcaaccctgcatcaagcaagtttaccagtgccatttttccaatagcatgtgcttacttcatgtctctgtcacattttggtaattttcacaatgtttcaaatttctcattattatatttgttatggtgatctgtgatcaatgctctctgatgttactactatcatcattttgcggcaccacaaactgcacccataaaagatggcaaacttggccgggcggggtggctcacgcctgtaatcccagcactttgggaggctgagccgggcagatcacctgaggtcaggagttggagaccagcctggccaacatggtgaaaccccgtctctactaaaaatacaaaaaacaagctgggcgtgctggcacatgcctgtagtcccagctactcgggaggctgaggcaggagaatcgcttgaatccaggaggcagagactgcagtgagccgagattgcatcactgcactccagcctgggtgatggagtgagactccatctcaaaaaataaaaaaaataaaaaaggtggcaaacttggccaggcggcagtggcttacgcctgtaatccccgcactttgggaggccaaggcgggtggatcacttgaggtcaggaattcgagaccagcctggccaacatggcaaaccctgtctctactaaaaaatataaaaattagctgggtatggtggcgcacgcttgtaataccagctactcgggaggttgaggcaggagaattgcttgagcccaggaggcagaggttgcagtgaactgagatcatgccactgcatgccagcctgggtgacagagcaagactgtctcaaaaaaaaaaaagaaaaagaaaaagaaaagatggcaaaacttaagtgataaatgtgtatattctgactactccaccaatcagctgttcccccatctctctctctctccttgggcctccctattcccttggacaagacagtactgaaattaggccaattaataaccctacaatggcctctaagcattcaagtaaaaggaagagtcatatgtctttctctttaaaccaaaaaccaaatgatcaggcttagtgagaggcatgttgaaagccgagaagccaaaagctaggcctcttgtaccaaagttagccaagttgtgaatcaaagttcttgaaggaaactaaaagtgctactccagtgaacacacaaatgatatgaaagtgaaatagccttattactaataaacgttaaggaagttttaatggtctggataaaagatcaaatcaaacacaacatttccttaaggcaaagcctaatctagtgcaaggccctaactctcttcaattctatgaaggctgagagaggtgaggaagctgcaaagtgtattgtttaatttttaaatatttggggctttctctggatcttccattatttcttttttttccccccactcactctgttgtccgggtaggagtacagtggcacaaccacagctcactgcagcttcaaactcttaggttcaagcagtccctccacctcagcttcctgagtagctgggactacaggcgagcgccgccatgcccagctatttatcgtaatattggtattataattttgtaattttatgtctattacaagataaagcaaataagtaactatgttaacattagtaagacccaacattttcagtgtaaggaaaagatatatacagatcaaataaaagttggccaggcatggtggctcacacctgtaatcccagcactttgggaaatcgagatgggaggatcacttgaggccaggagttcgagaccagcctgggcaacgcaacgagaccccccatctctacaaaaaatttttaaaaattagctgggcatggtgatatgcacctgtagtcttagctactcgggaggctgagggaggaggattgtttgaagcctaggcatttgaagctgcagtgaattaggattgtaccactgcaccactccagcctgggcaatagagcaagaccctgcctcaaaaaaaagaaaaaaaaaaaaaaaagttaaggaagaaccctgtaatgttaaattgccatagaagacatcattatgtatttatgacttaaaaaaaaaatggagggcacagtggctcacatctgtaatcccagcactttggtttttttatttttcttttgtgaaaatatttaccagcagtttgccctgacagatgtaatcccagcactttgggaggctgaggtgggaggatcgcttgagctcagttcgaaaccagcttgggcaacatagtgagaccttgtctctacaaaaaaattaaaaataaaaaataaaaactgaatatattttctagcgatgtcctctgaaagtgcctagatataatgttaccccagtaagaatcagcacatttagtacccacatgttggattctaaataccgttgccactataaggaaccagagctccttggaatcagttctaggacacgaaaagcacatattgggatggaatatcttgtgccagaaaacaagaaattgctcaaagactaattaatgagggtatgccaggagaatataggaaccaacatgaagggactcttgttgacccaatttgaattgtaaaacatttaataaataaatccctatgagtccatattgacatgaaagagaaaaggaaacacaacagcaaatattttgccaccatttgaggtgattattctaccaactccttactctgaaatgtaataaaggcaaagattaagcatctatactgtctttttaggaggaaatataatgcctccttatttgatgagggaaaattcattacagaggaatgacagtactaaatgtagaagaggtgacaattaaaaaaactatcattttgcaacccccaatgtaataatggtttcaggcaaggatcaatgaatgctaaaataattatgcaaatggctgttgggcaataggatatttgtatggtgccaaagcatcacatcacagattatatatcaattaccacaggaaaactgtatgtctacaatggggagatttggcagtcacctccttctttaatcaagtgttaaaacgtagcatcacaaaccacagggtaaccaaccattaagtgcctggtgagctgatgctatatgaagtacacagtactgcctatgaaatattcttgcccaaaatgtttaacctgaacatgcctgtagacctaacttcttgtctacaagtaatatatatggacaaacaagttaaattatatcacaagaaaagagagacatctaaaatgtgggccagctagtcgtggtggcacaagcctgtagtcccagctacctgggaggctgaggcaggaggattacttgaggccaggagttcaaggccagcctaggcaacatagtgacacgccatctctaaaaatatgtatcttaaaatgtgggcccttctagatgacaattgggctgactgcttcaaaaagtcagtatcacaagtgaaggagaggtgggtaggctgttcttgttaaaagagacaaaggggctgggcatggtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgaggcaggagaatcgcttgaacctggaaggcggaggttgcagtgagctgagatcacaccactgcactccagcctgggagacagcgagactctgtctcaaaataaaataaataaataaataagagacaaaggaagcatattcaaatgcaatgtataaatcttaattgctttggagcccctcaacagcgataagagacatttggaggaaatctgaatttaaagtgggtgcctgataacattagagaattattgttaacttttaaagatgtgatcggggtattgtgcttatattggaaaatgtccttatttttaggagatgtatactgaagtacttaggggtgaaatgtcgtgacatctgtgagttccttttaaatggtgagcaaaaaggtataaaaatgcaccctatctatacagaccaggaaaatacgccaaaatgttaacaattgtctaatctaggcagtaggcacacaggcttcacagtaagttaaaaaaaaaaaaaaaaaggtttggctgaaataaagaatttaacagaagggatagaaaataaagtcaggaggctgggtgcggtggctcacaccactttgggaggctgaggcgggcggatcacttgaggtcaggagttcgagaccagcctggcaacatggtgaaaccccatctctattaaaaatacaaaaattagccgggcgtggtggtgcaggtctgtaatcccagctacgtgggaggcagaggcagaattgcttgaacctggaaggcagaggttgcagtgagccgagatcaggctactgcactccagcctgggtgacagagcaagactctgcctcaaaaaaaaagaaaaaaggaaaaagaaaataaatgcaggagatcttccaaaattcagagcaccccccaccgcccaataaatgaaaaatatgagagaagacagaagaccaatataagaggtccaaagttaaacagtagtccccatagagaaaatgaaagcatgtaaattagtaatttttttttaaaaaaaagagttgacaaaagtattcagattgaatgaccacagtacaacgagtgaacaagacacaactctagacatattctcatgagatttcaggacactaaaaataaggagacgaaatcctaaaaacttccagggaaggaagagaaaagaagggcacctacaaaagaaccataataagattggcatcaggcatttgttgcatttgttactctgcatactagaagagatgcctccaaagttaggagaaaaaatgattttcaacttggaaccctatactcagccaatcaagtgtaagagtagaagaaaggtatttcaggcatgcagtgactcagaagacctatctgttacaatgcttttggttacaagtaacagaaaagaaaactgaagctggctcattcagtaagaaagtccatcctatctgagtccctagctcaggtaggacaggccccagccacagtgcaatcaccagctaagcaacggcatcaagacccaggttcttcccgtttctctgctccgccttccttggtgagcaggctttatcctcaggctttgtccctcagtctgaggttacagaagagcccccagcaacacctttctcacttactccagtgagagaaaaagagaaagtcttccctgaacgtgccatggaagtccttcccttcagtctgagtgaaccaacttagatcgtatgtccatccttgaccagtaacagttgccaaaggaatgcaatgtgtggaatgacttaaggatcctttctgaagttgggaataaggtagaaaggtgaataatatcaggattctgttaggaatgggcaaagaagaaatggatatggggtaggtgacaacggtatccactacagtttactccccatgcactctatctgagcacattatttaaggatgcagtccagaaaacgagggagtaaaccatgtgaaaggaagatatgggttttaagacacgggctccaacccaagagcccagtgaggagaaggtccaggtacagctgtatatgcaaccttaaatcaaagagcagatacttgcccagattgcagaagggcagaggccttccaagagaaaggtcttcagtggggaaaaagccgaatcgtacgaaataaacagcactgctaatagcattttacaacataatcaaggaggaatagtaaacaaaataaaaaggcaactagaaatggtgggcaaaacaaagagctatataagcaagccaaggtttgaatatgaagtagattaaatcctagcaaggattttaagcaggtgacagagtctaagaaaagggaatccatttgaccttgattggtcattctcctttgagtggtccagatctgtaaagaaggaaatgtaatcctgggcacattcattatttggtctcgccaagaacaatactcacatgtgtaataatgtaaataatgttattttcgactttagaattaagctacaacttggctgtggttgcagggcagaacacacatgttaacaaatgcaagaatgggtatggtcaagtacagcttttaagacgcagaagttaaggagggaaagtggaaggaaaagtagggttattaatatccttatcttaaaaagaggggaactgacatatggactaaaatactgtttaaaatttacagagaaatgtgggcttggcatggtagctcacacctgtaatcccagcactttgggaggccaaggcaggcagatcacctgaggtcaggagtttaagaccagcctggccaacatggtgaaaccccgcctctactaaaaatacaaaaattagcccagtgcactggtgtgcgcctgtagtcccagctactcaggaggctgaggcacgagaattgcttgaacccgggaggcagaggtttcagtgagccgagatcacatcactgcactccagcctgggcgacagagtgagactccatctcaaaaaaaaaattacagagaaatgtgaatatgaatttcaacatggggaggtaacgtaagctaagtcattctctttcatttcagggagttaacacagttccctaaagttggcaaatcaagaaagatgtataagcatatgatttaattttggaggtaaccatcaaaggaactaaaatcagaaacagttaaaagctgtcatgtctgagtcagggaagggaaggggaaggggtagactgctgtttttacgatgacctcttttgttatatctaacttgttgccgagtagttgcaatattttgataaaaattcaaaacccaaaccaccttacccttcatgttttctatcgctctgatgttaacattcaaaatcctgcatgatccagcccctgttgacctctctgatggcccggaccctttgccactctcccctaacccctcgttcagctcctgccacacaggactaagctcttgccagactgagggccttcacacatgctcttctccatctggaaagcctttttcctctctgcaccttgcccacttctgttcaaccctcggttccctgcatcggcgttgcctccttggggaaggcaggctgagctgttcccccattgtacagtcatgagtcgctcaacaacagggatatgttctgagaaatgtgtcattgggcgatttatttgtgctaacatcagagagtgttcttacacaaatctagatggtgtagcatactacacacctaggctatacggtatatagcctattgctcctgggctataaaactgtacagcatggtactatactgaatactgtagatcactggaacacaatggtaagtatttgtatatctaaacatagaaaaggtacagtaaaaatatggcattctaatcttatgggaacaccactgtatgtgtgctctgttgtcggttgaaacgttgttgtgcagcacgtgactgtagaggactggagtggctcccacctccatacttgtccttctgaacacttaagtactggtacaattatctaagatctgtctctgccgctaaagtcaagctccatgaggacaggtaccaaatctgtctaggttaccccatccctgcctaacacagggcctgaggtactatagataccttacttactcaattgtggaatgaattgatggactatagcctgatgtactgcaaatccttcagcatgcagcaggaatggaacttggtgtttaaactaaactataatggctagatgaaaaagagactaaatgtgaaataattccatcattcagaattgagtgttggtataacaaacagacccatgaaatatgtagcgtttcacaaggatatcagtgaggaagttgttcaatatgtcatccgaagtcccgttgcataatgatacttgcacacgcatgcttatagcagcacaattcacaattacaaaaatatagaaccagcccaaatgcccatcaatcagaaagtgaatagagaaattgtggcatatatatacaaaggaatactactcagccataaaaaggaatgacttaatggcattcacagcaacctggatggaactagagactattattctaagtgaagtaactcaggaatggaaaaccaaacaccgtatgttctcactcataagtgggagctaagctatgaggatgcaaaggcatcagaatgatacaatggactttggggacttgagggaaagggtgggagggggtgagggataaaagactacaaattgggttcagtgtacactgctcgggtgatgggtgcaccaaaatctcagaaatcaccattaaagaacttactcatgtcaccaaataccacctgttcccctaaaatctatgggaataaaaaattaagaaaataaataaaattttaaaaggaaggtcatccctacacttcaagttataaaataattctaccgtaaaaaaaaaaaaaacacacacacacacaacaacaacaaagtcctgttgcgtacctctgagaggtgttttgtggcttggactagcatactggcagtgcagatgctgagaagtggttggcctaacaggacttgctgacagatcagggatgatgagagaaagagcagaatcagggcgggtgcagtggctcacgcctgtaatcccagcactttgggaggctgaggtgggcggatcacaaggtcaggagttcaggaccagcctggccaacatggtgaaaccccatctctactaaaaatacaaaaaattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatttgagacacttatgagcaactcaagtaaatgctgacgaggccatcaaatctggagctcaagagagaggtttgaaatgcagaaacagggttgtagccatcagcaggcagacatatcatcattcagagtcatgaacatgcagaaataatggaaatgcctcttaattaaatgaaggcatagacatacaacgaaatgttatgtgattactaaaaatgatggtagaaaaacattatccagaagttatctttatctgtagatgacagatttatggacaatttttacttttcatctttgcatattttctgaaaattttttgtccattgaacatgtattacttttataataagaaaatgcaggctgggcacagtggctcacgactgtaatcccagcactttgggaggccaaggcaggaagatcacttgaggccagcagtttgaggccagcctgggcaacatagtgaaatcccatttctgcaaaaaatattttaaaaattagccaggcgtcgtgacatgtgcctgtagtcttagctatcttggaggctgaggtaggtggaatacttgaaactggaggtggaggctgtagtgagctgtgacatcactgcactccagcctgagcaacagagcaagagcctgtctcaaaacaaaaacaaaaacaaaaaagaaaatgcaagttaagttattttcattttagggaaaagtgaagatatacgtctatttttatggacatggatatttacaacattttgttgaggaaaggtagcaagttacaaaagtacatatatgatctcattcatctaaaacaatatgtgggccaggcacagaggtgcacacttgtaatcccggcactttgggaggccgaggcggaaggatcgtttgagcaaaggagtttgagaccagtctgggcaacatggtgaaactccgtctctacaaaaaaaatacaaaaattagctgggcatggtagcggacacctgtagtcccacctacttgggaggctgattgggaggatcacttgcacccaagaggtcgaagctgtagtgagctgtgattgcaccactgtgctccagcttgggcgacagaccttgtctcaaaacaacaacaacatgtgtacgtgcttacaggcaaataagaaagactctagaaggatgtttaaaatgccaacagcaggcccagcgtggtggctcatgcctgtaatcctagcactttgggaggccgaggtgggcagatcacaaggtcaagagatgaagaccatcctggccaacatggcgaaaccctatctctactaaaaatacaaaaattagctgggcatggtggcgcgcacctgtagtcccagctagtcaggaggctgaggcgggagaatcgcttgaaccagggaggcagaggttgcagtgagctgagatcgcaccactgcactccagcctggcgacagtgtgactctgtctcaaaataaataaataaataaataaataagtaagtaataaaataaaatgccaacagcaaaagtaacttttaggctattatgcaccaacaaatttatgtgatatcgagaagtgttaaacagttttagttgcattacactttgcataatatacacaaaacactaaacatgttaataaatgtttgatataataagatgacctaagtttaagtgtaattttgactccttttactgtacctgtgttttcccccactaactgactagtcaagtgctgactggtttttaagagatggggtcttgctctgttgcccaggctggcctcaaactcctgggctcaagtgattttcccacctcagcctcccaagtaggtggaactacaggtgtgcatcaccatacccggcttaacgtctgtttttatatttgtagccacatggtacaaagtacagaacaggtgttcttaacctttttctgccatggacccttttggccttctggacccctcctcagaagaatgttttgaaatgtgtaaaatgcacagaaattaacaacatatttcaagagttcgttctcaaataatatgtgcttcttcagtaaatcattaaataaccagatctagagatgggtctaataattaccttaagtttgaagcagtgatggacatatatatttcaaaatatctgtaacaactataatatgatatgaaagtatctttgatctctactggtgacagtcactgctattctaatactaccatgatctgttgcttacaattgtcattgaagaaaatgtggatttttttttttttttttgagacagagtctcgctctgtcgcccaggctggagtgcaatggtgtgatcttggctcactgcaacctctaccttccgggttcaagtgattctcctgcctcagcctccggagtagctgggattacaggcgcccaccaccatgcccggctgatttttgtatttttagtagagacaggatttcaccatgttggtcaggctggtctcaaactcctgacctcaggtgatctgcctgcctcagcctctcaaagtgctgggattacaggcatgagccaccacacccggctggattttttttttttttaaaagacagggtcttgctatgttgcccaggctggtctcaaactcctgggctcaagtgatctgccctccacgggcttccaaagcactgggattacaggcacgagccaccatgcccagctaaaaatctgggttttcagagacattagtgaaaataaagagtgaatgtttttcccatccaaggtcacagacccggctgaattctcaaccaaagttggaggccttggtctagaaagatacataccaaatattaacagcagttttttttttttttggatagtggaatcgccagagtgattctattttgttttatgatatttttgtagagatagggtctcaatatgttgctcaggctggtcttgaactcctgggctcaaaagatcctcccaccttggcctcccaaagtgctgggattacaggcgtgagccatggcatgcctggcctaattttttatctttgtacctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggctgcagtaagctatgatcatgctgttgcactccagtctgggtgatggagtgggatcctgtctctaaaaaaacattaaaaaaaataagtaaaaaatttaaaaactggttaaataaattgtggtacatccataacagactatttaaacccaacccttaaaaggaatgatacggctctgtatgaaccgattctaaataatctacaggatacattaaaataaacaaatgtgcacaatattttatagtatgtgtaaaaacacaacgcccacatacccttgtgtatttatacacacatgtaaaatatatacacaaacctaaacacacaaaaatatgtccaatagagacaaagagtagaatagtagttgccagagggtggggtgggggaaaggggagaagtgggagttagtgtttaataggtatgaaatttcagttttgcaagacgaaaggttgtagagatggatggtagtaatggctgtacaacaatgtgaatgtactcagtgccactgaactgtacagttaagatgattaaaactgtaaattgttatatatatcgatatatattttttgagacggagtctcggtctgtcgcccaggctggagtgcagtgacgcgatctcggctcactgcaagctccgcctcctgggttcacgccattctcctgcctcaggctctcagagtagctgggactacaggcgcccgccaccatgcccggctaattttttgtatttttagtaaagacgaggtttcaccgtgctcgccaggatggtctcgatctcctgacctcgtgatcagcctgcctcggcctcccaaagtgctgggattacaggcgtgagccaccacgcccagcctgttatatatattttataataaaaatttaacacacgggtacacacacgcttttttttttgagatggagtctcattctgttgccaggctggagtgcagcggcgtgatctcagttcactgcaacctctgcctcccaggttcaagcgattctcctgcctcagcctcccgagtagctgggactacaggtgcccgccaccatgcccggctaattttttgtatttttagtagagatggggttttaccatgttggccaagatggtctcgatctcttgacctcatgatccacccacctccacctcccaaagtgctaggattacaggcgtgagccaccgtgcccggccacaatttttttttttttttaaagaaacaggtaatagtggctgcctccagggaaagaaatgaatgtttggggcagggtagcagagatactttacaatataactcttttttttttttttttgagacggagttccgctcttgtcgtccaggctggagtgcaacggcatgatcttggctcactgcaacctctgcctcccaggttcaggcgattctcctgcctcagcttcccaagtagctgggactacaggcacgcaccaccacgcttggctaatttttgtatttttagtggagacggagtttcaccatgttggccaggctagtctcgaattcctgacctcaagtgatcaagctgcctcagcctcccaaactgctgggattacaggcatgagccaccatgcccagccccatataacttttttctattattatttttctgagatggagtctcactctgtcgcccaggctggagtgcaatggcacgatcttggctcactgcaacctctgcctcctgggttcaaacgattcttctgcctcagcctcccgagtagctggattacaggtgcataccaccaagcccagctaatttttgtatttttagtagaaatgatgtttcgtcatgttggctaggctggtctcgaactcctgacctcaggtgatccacccacctcggcctcccaaagtactgggattgcaggcgtgagtcactgtgcccagccccgtataactttttacaccacctttttaattccgtattgtccatctaactattcaaaaaatcatttaaaaaaccccggccttatacaagaagtcttttccttaatcgtgtcatttattctatccctcttcctttaagtaaaaaatattttcaatcaaaatcagaattcgacttcagctttgagggtatttattagattcaaataatgcaatttataaaaattacacttgctaccctaaaaatatattcactaaaagccttttctttttttcttttttctttttttttttttttaaagagacagtgtcttactctaaagaacgaggctgcccaggctagagtacaggagtacagtggtgtgatgatggctcactgtagcctaaaactcctgggctcatgggatcctctcacctcatcctcccgagtagctgggactacaggcatgagccaccatgcctggcccctctatttttatcaggtgttacagaaaagcttcaaaatcatcatggaagaaaattatcatttttaccagtacaaaacttttattgcatcccaaccaagctaagatgaatacagaattgtttcaacagaagttaccattatcataattcaagacaaaaatcagccggcaattacatgagttggaaaacaaactactcttatgtcacagtctaccctaaagctccaacttatgtcagaatttaaaatacacacacatatacacaaccctgtggattcctcctcatttatgtaaaacctacttttgtgatgatctgctattttcttgagtcttctggaatgaacactgtagccccactcccggataaggagaagataccacttccagggcttagcactgcccctggcttgaagcagatactcaaatatttgttgggtgaatgaatgattgtctgctgatagggctgcccatcaagcctcataaagaaaaaattcagaaaaaagcaactttatagagaaaataggaaaaagtttaagagatattttgctcacttgaagaaatcagcatttgttaaaggtgaagactggattgactggttcatcaagtggcttagacacaactgactaagtgggctataccttatcccaccccaaagttaaatacaaaacaggtatttttttttttaatcacaggaaaaacacagggcaacttaactataaaattattatttttattttttatttttgagacagagcctcactctatcgcccaggcaggagtgcagtggcgtgatcttggctcaccgaaacttctgcctcctgggttcaagcgattctcctgcctcagtcaccccagtagttgagattacaggtgcccgccaccacgcctggctaatttttgtatttttagtagagacgggatttcaccatcttggccaggctggtcttgaactcttgacctcaggtgatccacccgcctcagcctcccaaagtgctgggattacaggcatgagccaccgcatctggcccttttgtatgtattaaatacgtatgtatgaatataatacatcatcaggttttttaggaagaaaatatagatgactattgatctgttgttaagagtaggaaaggatttcctggcggggcgcggtggctcacgcctgtaatcccagcactttgggaggcagagacgggcggatcacaaggtcaggagatcgagaccagcctggctaacatggtgaaaccctgtctctactaaaaatacaaaaaaattagccaggcgtggtggcgggcgcctgtagtcccagctactcgggaggctgaggcaggagaatggaatgaacccgggagatggagcttgcagtgagccaagatcacgccattgcactccaacctgggcgacagagcgagactccgtctcaaaaaaaaaaaaaaaaaaaaaaaaaaagagtaaaaaaggatttcctaagtatgaaagcaaaagaataaatcataacataaattttatatatcagaaagacaagaatcaagacgtaagacaaaacaggaaaatatctgcatgacaaagagttaacatctttaatacattaagagctatgacaatgattattgaggtttagcctcagtaataatccaagcggcaccaatttaaaagatgtatatccaattctgggacgatatgggaaaatggcactttctcagactgttgtgggaactgggatagccattttggacagtgatgtggtggtatccaccagaaattccaagtctaggcagccattcttcaaaatgactggcacatgaggaatttcaatcctgtagcatttttaataacatagagagacaacgaaatgcatgacggtaagtcagccctggactacactgctatttaaaagaaatgaggcagagatgaatatatgagatggaaaaatgcagaatatgtatatataacaccatcctgaggccaggcacggtggctcacgcctgtaatcccagcactttgggaggccaaggcaggtggatcgcctgaggtcaggagttcgacaccagcctggccaacatggtgaaacccatctctactaaaaatacaaaaattagctgggtgtggtggcaggcgcctgtaatcccagctactcaggaggctgaggcaggagaatcacttgaacccaggaggtggaggttgcagtgagccaagattgtgccactgtactccagcctggatgacagagcaagactccatctcaaaaaaagaaaaaacaaaacaaaacaaaaaccctcctgttaattacaacacaaaaagtacacagtttagtcttagaagacttagaaggatctacattaagctattaacagcagttattctgggtagtgggagcagagattaagcggggagctttcatttttttacctgatacttttttttttttttttttttgagaccgagtctcactctgtcacccaggcaggagtgcagtggtgtgatcttggctcactgcaacctccgcctcccaggttcaagtgattctcctgcctcagccttccgagtagctgggactacacgctcaagccaccatggccagctaatttttgtatttttaatagagatggggtttcgccgtgttagccaggctggtctcgaactcctgacttcaggtgatccacccgcctaggcctcccaaagcgctgtgattacaggcatgagccaccttgcccagccacctgatcaatttttaagtggtttgatttttctataaatccatgtattattttagtaattctttaaaaagtaaaagaagaaaaatagatatcaagcatttatctactaaagacgggtactgtcctttgagaattccctcaaaagttctttgaagctcaaatggctacatctttcccattcataagatactttttaaatttcctctttctacatttctttttaaaagtttattttcaattagcttcctcaggttgaactctctgtacatttcttaggagaaactgtatggtgtcaacactgcctgttttataacatccattcgtaatctgtaatctgagaaaaagactcgtaaaaacccaaaccaccctccaggcctaacatcttccagaagaaacccattcactgcccatattacatttagtccacacaatttctgagacaaagcacaaagcactagccatacaactcccaccagcataaatacgtggagtacaaagaatgtcctgtcagctgggcccagagcacaccccacagcagtaaaagagaatgacaatttgagtcacaggatcaggagcagaatcaaatttgggacttgaggcagtgtgatgctcttctggtcttccgcttccttccacaccttctattctccttcagccaaaccttgccctcacataatccctaagcaggctatttcttatggatgtctacaacagcttcacactgaggtgtcagaaaccactagagagacaacaaagaacgacttagggtctcagtcggaatcacaatggccgcataagtgaaaactcacatttttgcttaggggaaaaaaaatgggaaaattcaattggaacattctgctttaccacacagaagttctgaaatccacatgtcaaaacatcaaatgcggagtgaccactaatcaaaaagacaaaacaaaacaacaacaacaacaacaacaacaaacagcttgagatgttgagcctgaaggttgagaaattaaggaaccattcatttttacaaaactaaagtccacacaatggtgccaagtagttcaaactgcagctgatacagcacctgagtgtcagacctagaatgactggggcccccaggtttttacaaagtactcatcctcctctagagtcccaagaaccagatgtatatctgggtactctctttagttaccatgggaggagtgtagcaagcacatgacattagccatggcccccggtgttctgagacagctttcaggagggtgtccttctagggaaccaaccacataccagttcccatatctgaaaatgcattaccactgctcactaatgttgaccactaagccatttaccccaaaccaaagcaaacacatgctgaagaccgctaaggcaacagcagcagcgcaaaagggctcagtgcaagcgctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaaattactggcacgtaacacacagtgctaaaataaaggaaagattcatgcttgttagaatcaacactatcacaagccttgtcacctctaggggacacttcgacactacaaaagcataccatgagtggcgatttctggcaagtatttcttctaccacggcacacagaaattctcagggaagaatacatgttcaagagaatacgcaacatcaaaataccatccctgaaagaacacatggaacctagaggcagtctcccttctttttcaagcagctgaatgaagttgcaataagctgctgtaacaacatcacataaaggggctttaatcctgagagaaaaaatcagcaccaagggaaaccaagtgctctgggagacccaaagccatcatccaaaacatgcaagtctatttcagggcaatcagttttaagcctctcagatcagtcaatctcgatgttcaacaaactcagttattagtttgatagtttctctttttcttttgaacacatgttcaaaaaaggacttttgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtctcaaaaaaaaaaaaaaaaaaagaaagaaagaaaagagaaaatgagagcagtttatgaaatctaaaaaagaaagttaatatatatataaaacacccctagctcttgggctaggaagacaagtgcatccttactaaggcttggtcctgtcaacttcagaggcaataatgagagcccagactacagtgtctacagtaactgcaaaacagccacacagcacagcgggaacacattcacacgccaggagacccagcatacatgtgcttgaagaagttataagactcaggctttattctctaacgaaatggtcattccccctttgatgtgggggtgggggtggggatgccctgcccaccccccaattccggctcccactcagttatcccacataccatacataccatcaaagtatttaagcaatggcatgcaaagcaagctttcgacaggtttcttgcaagagaaaggcagaagagaacaggtaaaagcagaagagcacacaggtaaaagcagaagagcacaacttctacttaagcccaaagaagagggacctgttcacatcttgtcctacccggaatgatgcacacgcacaggggcttgccgggacagcagtagtttcactggaaagggctggtatggaggcaccgaggacaaggtccttccatcgcagcggtgataatgctctacccaagaaaaaaagattgcgtctgccagccacgcaagactggtctgcaaggatgtcaccatagcagagggcagggaaaacaagcaggtgtcctgccacactctttgggactggccagtctaggagtgtgctttaccccacgcactgaaaacactggttactagaaatatcaaacatttcctgtgattctctcctccaagataactcgggcagcttgagaacaagctgctcttagctaattaaaagatttctgctgatattaacctttataaaagatttcaggttccaggacacgtcatttatcatgcagagtcccaagcaggtacattagcaatggaaaccaggctccaataaggaactaacaattttatctctgttgttctttattttaggttaaagaaatgaacttctcgtttcatctccacatgggaggaatgttctggagggggtaacagcctattaaactcatctagctttttttttttttttcaaactccacagcttgcctccctaccctactagactagattgcacagaggcagggcaggcacgggaaacgactctggttggaaattacaaacatatacacacagaatgcaagcaccataaccctttgaatacacagtggtttgtgccttgccccagacctacctaaggatttaaacagcacagaagtcggagttcggctgactgcatgacactctcctatcaatcgggtgaaacaaagacccagtactctaagcttaaagcattccaggcaaaattttagttaacaggcaataggaaggtgtgataggccagtgctaacaagaaagccacagatgggtttctttgagctgttaagacactggaaagggctggtatggaagcccagtggagccattaggacaatggaaaaggaggtacccctccaccaggcactttgcagagaaaactatactctggaagctgcctgcactgttgatagggctagacgtatgataaacagctaaccggaggggcacccgaggagacaaactgccaactatgaagaacaaagcagagacctcaacttgtcacgtctcaagctcagatgtacaaactttgggatcgtcaagtgaggctcgtgtgtatgcctggggatatgactgtattccagtgatcagccacctagctgacctgccacgaatgggtgacctgtggtgacttactttaatcaactgtagtacttctagattgattgggtgatttaaggttctgacatattcaggcaagaaaataaaagcaagtgtttcctagacttcctcattgggatttgaaatagaaatcctgaaaagcccataaaagcctatttccctaaatccttggtggaaattcccaaaagattaaaaaatccagaccctgtcttattatagggacccagcagatttcaaaagactcaagaggtcagcttaatctggttattaactgaaattgctgagatactgatgaacattccagccatggaacccaaaattctctagagtaataattacctattagtgcaatgttactactgaggccgtatatgcttcatttttacagtataacaaaatgtctaaaacttatgagagtcctacaacgtctaggccactcagtatcacatccaagtaggtatggttcctggatcaccaaccaacccctgaattcgatcctgttatctcacagtctggggtactgatcccgcacagcagagacacaacgtgtgaaaggctcggcagagcccattcctgttcctggaaaaataaccagaagcacacatctgcctgaccatgagtcaggaatatcaattttgtggtggagcccatttctgctgtgaccaacccacacccgaacacactcgcaacagaagcaaccgccacagagcaattccagaatgagctttttccccctcggggtccatacttagcaatgtcataaacggtctcccctgcgacagcaatccttttacactcttcataatgaccttaagtctttagtgcaaaaccacagaaacattgccactgccatataaaagtcatctgagtttcagtttgggtgattcggtcatgaccaaactgaacagaggataacctttcaggcacaattaacaggagccacagcgtcgcgatgaacttgccccatctggtaccggtgatcccgagcgctccagggcgatgagagcccgttacctactatgtcccactccacttatgtaactggaagatcgccggcgaaggggagggtaggatgggagggtgctcacattccgaggccacagcactccaaagaacctctgagcaccctggggacacgctcgcaccttagagcctctggcgccgaagagcctcgggtgctgctggacgcacagtcccctacccacggctcctgatgggaactataaccacctctttatgatgagttgtgggacccagaacacaatgtctagtcccttttgtggataataatccccacctacttgttcctgctagatggggaaaggagccggtggacctactcgctcgcgggggggtagcggggggcagaaattcatggaatgggcgagaaggagggggaggcaaagcccagagatgggggtgagagctcaggagcccttgtggcgcactctcccgacgggaggcgaagtgcgcacgcgcgccggtgggggggccgagtaacgggagagggggcgcgcgagggagggagggggagagcgcgatccagggagaggccggggccgcgggcgcgcgacggcgccgcggcccaaagccccgagaagggcaggagcgcgcgcagccccgacaggcgaaccccggcgacaggggcgcccgcggggccgggggccgggatgcgcgtcgagggcgggaggaagaggggcgtcaggcgaaggcggctccagggaggccgcgccgaggacggtcacccgcgagcacgggtgacgggccgaggggagagtcgccaccggcggcggcgggagggggagggtagagaggagggacgccatccgccagccgtgtcgtccgaccccgcgggcccctcccgcgccacgtcccgcccctgacccccgccccccggcaagggtccccgcccgcggccacggcggtcccactcacagtctctcctcctcgcctcctcctcctcctccgctcggcgcggcggcggcggcggcggccattttccggacggcttttaccacagccctctctccgagaggagggagcgcgcgcgccgccgacgccgggaccccgcacggccgacgtcgcgccccgccctcttggccggcccgcgcgctgctgcacctgcgcgcccgcgccccgccctcggcgccgctgcgagcccgcccgtcattggctgtgatggccgggctgggacggggaggacgggggaggggggaggtctcagcggcgatgccgtcaattggcgagatttcctgtccatttcggccagggaaaagggggcggacccctccagctgttgattggctgctttcggccgtcgtttggggaaaagaggcggcttgggcgcggagggactggtttagtgggcggaatttgaatgttaaggattaatggacccttgcggatgctggggcaagtgaaggcctaggcttgggacgcctgtttgcgctgctctgaggggcgattgaccctctgtccacagatgcaccgagtgcgctgcaataagcgtttcattgcacccacattttctcaatatcactatcttcggcagaagcagcaaagttgcccaccctggagcctgacgttgccccagctgaggggccttggtttcagaggcctactcaatgcattatttcatccgagcctgcccagtgctcacactctcatagaggcggggaataaactgacaacaaatcgcaaccctggctttcgcagaactctggcgggggaagagagtgcatgccaaggcctcgtgacacctgtcactgttggatcagatggtttggtggaggtgtgaataaggggcaatgttagctctgcctggaagatatgatttgggagctgagatccagcaatttttcactttcctagaagagttgatttggagctgagatccagcaattgtgttttgggaaaataagagtatgagaaaactgttagctaaccaggtgttcaggacaggagtgtttgttaaggggaccttaccctgatgccagtcattatccaatccattcaatgatccttctgttagttctatgcttagcaagaaaacctgattctgatttggctgcttgcccccattcatttattgactacctgctatgtgccaggcactcttccaggctctggatgcacggtactgaacagacagcaaactaacattcttgccgggaagattcatactagcatacaaataagtataatatatcatttcacatagtgataagggctttgagaaagataaactaagtgaagggggtgctatttagatatctgctggttttcaccctcattttactccctcatatgaatatctggggaaagaacattccaggcaagttcaaaggacatgaggagagactatgcctggcatgttggggactaacgaggaagtcagtgttgctggagagtggtagggaatgtgattggaaaggcagctggggccactatgagaactgggagttcattcttttttggggggggtggggatggggtctcattctgtcacccaggctgcagtgcagtggcgcaatcttggctcactgcaacgtccaccctgagctcaagcgatcctccctcctcagcgtcctaagtagctgggaccacagatgcgaaccaccacgcctggctaagtttttgtatttttgatagagatgggagttcaccatgttgcccaggctggtctcaaactcctgagttcaagtgatccgcccgcctcggactcccaaagtgctgggactacaggcgtaagccaccgcacccggccagaaccgagagtttattctaagatgagaagccctcagaggattttgagccaggagctgtctgatctatgttgcaggtgtagagtggagaactggacgtgatgaaacaaaactacagcacaaggctagttgcaaggccctggaacagtctaggagaaagagttgatggtagctttaactagggtggcagcagtgcagctctgagaagttgtgagattcaagatatgttttcagaactgaacaaaaggattggatgtagggcatagagcaagggaagaaacaaggatgattcctgagattggggcctgagcaactggggaaataagggtgcttttcaccatagtggggagaactacaggaaaagtacattttcagaggtgcagatcaagagttctgctttggctgtattaagcttggggtgcccagtggtgtgaaagtggagatgttgagtaagccattgggtgtgcgatgctgaagtatagagatgcggctaaagcagtccaaaagtcatcacgctgaacatccaattcaagaagccataaagaaatgacagagtaagcctgcaaaagtagaagaaagaaaaataaggatgaataaaacttaatgaaatagaaacaaatgatggagaggattgagaaaattttaaacctgcttctttgaaaagctgaaaaacaaaagccaaccctctaacaagctggatataaagagaaaagagaaaagtaaattatgttactcatgaaaaggttttattatgcactgtgtgtcagtaaatttgaaaacataagcaaaaggaatacattcctaggaaagtacagcttaccaaaaccgactttagaaacagaaaatccctgtaaccacaatgaaattgactatgtatttaaaaagctacccatcctcctacacacagacacagacacgcagacacacacagacacacacgcacacagagagagagagagagagagagagagagaaacagaccaagagggctttatggatgacttctaccaaatctttaatgagtaggcaattccaatcatacacagaaaagaaataaatgtctccaaacttattttactagactaatatatctactatgatgagccaagaaaagtatgacacaagatgtggaaataagttttaaaattctagacaaataaactgaatcctgcagtatatgatctatcacaaccgagttgagttttatcctaagaatgcaaatatggtttaaaattagaaacccaaccttaacaaacttaaggggaaaaacactacataattatttcaatagatgcagaaaaagcatttgataaaattcaacatctacttatgattttttttaaaaatcagagaactggagttcaagacaagcctgggcaacatagcaagaagcaagaccccgtctttacaaaaaaaatttaaaaattagacagacgtggtggcacacacctgtagtcccagctccctggaaagctgaggtggaaggatcacttgagcccaggagtttgaggctgcagtgagctatgattgcacattgcactctagcctgggcaacaaagcaagaccctgtctttaaaaaaaaaaaaaaaaaaaaaaaggtgaccaggcacgacggctcacgcctgtaatctcagcactttgggaggccgaggcaggcggatcacgagatcaggggattgagatgatcctggctaaaatggtgaaaccccatctctactaaaaatacaaaaaaaaattagccgggcgtggtggcacgcacctgtagtcccagctactctggaggctgaggcaggagaatcgcttgaacctgggaggtggaggttgcagtaagccgagatcgtgccattgcactacagcctgggtgacagagcgagactccatctcgaaatagatggatggatggatggatggatggatggatagacagatagatagatagatagacagacagacagacagacagatagatagatagataaaataaaaggttaggagagggcaaaaaacctgaatagacatttctcaaaagaaaacatttaaatgaccaacaggtatatgggaaaaatctcgccaggcaccttggctcacacctgtaatcccagcactttggtaggccgaggtgggaagatcacttgagtccaggagttcaaggccagcctggttaacatggcaagaccactgtctctaaaaaaacaaaaaattagccaggcatggttgtgcacacttgtcatctcagcttcttgggaggctggggtgggaggatcacttgagcccaggagtttgaggctgcaatgagccaggatcgtgccattgcactttggcctgggtgacagagtgagaccctgtctcgaaaaaagaaagagaaggaagggagggagggagggaggggaaaaaaagttcaacatcactcatcatcagggaaattcaaatcaaaagcccaatgagataccccttcaattcagttagaatggctttaatcaaaaagacaaaagaagacaagttggcaaagatgtggagaaaagggaatactttcatactgttggtggggtagtaagttagtatagtcaactatggagaacagtatggaggtttctcaataaattgaaaatagaactaccagcaatcctactaccggtatatatccaaaggaaatgaaatcagtatgtggaagagttatctgcactcccatttttattgaatgactattcacaatagccagatacagaatcaacttaggtgtccaccaacaggtgaatggataaagaaaatgtggtacatatatgcaatggaataatattcggccataaaaaagaatgaaatcctgtcacttaagacaacatgaatgaacctggaggacataaagttaagggaaataaaccagaaacagaaagacaaataccacatgatctcagtcatatgtggaatctcaaaaacaaaaaagagttgatatcatagaagcagagagtagaacagtagttaccagagactggggagaggatcggggagaggaggatgggcagaggttggtcaacaggtacaaagttattattagataagatgaataaattctggtgttttgaccaggtgcagtggctcacgcttgtaatcccagcactttgggagactgaggtgggtgactcacttgaggtcaggagcttgagtgcagcctggccaacatggtgaaaccccatttctactaaaaatacaaaaattagctgggcatggcggcgggtgcctatagtcccagctgcttgggaggctgaggcaggagaatcgctcgaacccaggaggcagagcaacctggtgagctgagatcacaccactgcactccagcctgggtgacacagcgagattctgtctcaaaaaaaaaaattatgttgttctattgcacagcagggtgactatggttgacagcaatatattgtatgttacaaaatacctagaagagagacttttgaaagttcccacaacaaagaaatggtacatgcatgagctgatggatatattaactaccctgcttggaccattgtgcaacataaatatatattgaaatatcaaattgtactccctaaatatgtgtcaattaaaaaacaaaaataaaaagccccacatacatccttcttccattctcttttaaacctcattcttggtgcgtctctgcggggagaaaggcccatttcaagtcagttccccggtgttaggatgcaggcatgtaaacacgaccagtaataaaaagctggaaaatgtaatgagggaaaaaagattcaactcactctcactacaaaaattataaaacagctgggaataaacttaataagaaatgtcaaaacctgcatcaaaaagctataaaactttactgaaaaatctaaaagaagacctgaagaaaacaaaaacaaaaacagacgctaccgtattcctggaggggaagcattaacattatagaaatgttaattcttcatcaataactctggaaattctttgctcaatcaaaagtcaagaagtttcatgggctataacaacttaaatctagattggaaagaataatgtacaagactagaactcaagaagtttttgaaatattaaaaaataatgaagagaatcttgctaaattccttaggttgaatagaaggaacttaagttatacagtttcacacttgccattgaaaagtagaaaaatatactataatcggctgggcatggtggctcacgtctgtaatcccagcactttgagaggccgaggcgggcagatcacgaggtcaggagatcgagaccattctggctaacaaggtgaaaccccgtctctactaaaaatacaaaaaattagccgggtgtggtggtgggcgcctgtagtcccagctacttgggaggatgaggcaggagaatggggtgaacccaggaggcggagcttgcagtgagccgagatcgtgccactgcactccagcccgggtaacagagcaagactccatctcaaaaaaaagaaaaaaaagaaaaatatactataatcaaaattatttactattagaattaaaaatcagtaatttaaaaaatgggactgtaatagtttaaggtcctcttaaaaacaggactgtagaagataaaaaccaggaaaatctagtatagatggtaattgacagaaagcccacaaccagaaggattttatcaatatgacaaacaacacaaacttttactccatttgtctaaaaatctcttaaactgatagagaatatatatatttcagaagagctaatccaggccaggggcgctggctcatgcctgtaatcccagcactttgggaggccaaggcaggaggatcgcttgagcccaggagttcgagatcagcctgggcaacaaagtgagaccccgtttttcccaaaaatgaaataaattagctgggcacgtgcgcacctgtagtcctagctactcaacaggctgaggtgggatcatgccactgcactccagcctgggagaaagagcaagcccctgtctctaaaaacaaaagaaatgaccaacattgagagccctacatattaaaacctaggagataaggctacagaggtcacctagaaaaattaatagccttaaccatatttgttagaaaatagataagaaatgaataaattctgatataagacaccatgagcaggcacagatgtgcatgaacacacacacacccagacacacagacacacacacacagtcacatacacagacacacagacacacatacacacagacacacacacagacacacagacacagacacacacacacacacacagttttccttctttactcatagaagtgcactaaaagaagaatgtcaagaaacagaaaggaggcagggtgtggtggctcatgcctgtaatcccagcactttgggaagccaaggagggtgaattgcttgaggtcaggagttcgagaccagcttggccaacatggtgaaaccctgcctctgctaaaaatacaaacaattagccaggcctggtggcacgcacctgtaatcccagctacttgggaggccgaggcaggagaatcgcttgaacccaggaggcagaggttgcagtgagccgagatcgtgccattgcactccagcctgggtgacagagcaagactccgtctgaaaaaaaaaaaaaaaaggaaaggaataaacccaccagagtgaagagaatgtggtgaggatgagaggttatcatcaaaggacaacaactttatagaaagcatatgggaattgattgatgaataaaataggcagtaaaaatccaggtgagaatatttgacaagggagccacagaagaagtgggagtgagtttgctagatataacaccagacaatcagaatcagtaggcatgtggtagaaaacgatagaattaaataggactgaacacatggggattaattgaaggcaccagtacagaatgactgtaccagttggaacctcctctccccaccagacagctgagctgggagctggcacagacctacagggaaaacacctgacagttctgtaaagaaattgattgaaatgtcggtggagagctaaggcttccagcatggatgctgacaacccctgaacaattgtttcctcattccggcatctaggggatactctgttcgtcacctccctgtcctacacagagaagagtcacagcaggaaaacagacctatttgcccaacagcagattaaatccacaatacttatccagtccttccttattaaatataaaccagtcagtaaatattatcagaaatttgatgaaagccttcaacaggaaaaagagtcaagataaacctgtagaaaaaatataaacttggaattcaagaaaattcagggaatgtatcaaaaaatttaatttaattaacatatctacagaactaaaagaaaatgctgtattcataaaacaagaacagaatattatgtaaaaagagcaatcagagaacaagaaggaattattgaaattcaaatttcaatagaaatattggaaaataaaactgaagaagtctcccagaaaatagaacaaaacaatagagacaaagatatgagagaaaatatgaggactttgaggagtgatctaggaagtctggcaagcaactaacaagaattatggaaaaatgaaataaagaaaaaggaacaggaatcagagtagcaccagagttcataacaacactgaatgataaaagatcacaggacaacaagaaaagaaaaagataatagggcaatgctttccaaattccaagggaaaatgattttccacatagaagtacaccatccaaaatatccattatgtgtgataatggaataaaaatgtttttagatacacaagagctaagaaaatttgcctctgaaatgtactttcttaggaagctacttggggatgctctgcagcaaatcaagggtgcaagccaagaaaaaggaaaatgtgggatccataagacaatggatctaatccaggagagctgtgatgggaaataccagggatgccaactgggcagaaagcctggttggcaatcagtccaggttggagtaggagaatggtaggctctgggagagaggactccaagaattaaatatatatgtatagccgggtgtggtggctcacgcctgtaatcccagcactttgggagactgaggcgggtggatcacctgaagtcaggagctcgagaccagcctggccaacgtggcgaaaccccgtctctactaagaatacaaaaattagccgggcatggtggcgggtgcctgtaatcccagctactcaggaggctgaggcaggagaatcgcttgaacctgggaggcagaggttgcggtgagccgagcttgcgccactgcactccagcctgggcgacagagtgagactccgtctcaaaaaaaaaaaaaaaaaaaattgtgtatatgtgaattcaacatattagatggtgtgattgggagtctgaagttggatacgatgatggcaaatagtacaagaaaataaggaaaagcaattaaaaataccagaaggaaagaactatacaagaaagttatgatccgcaaggagccgtggctcacgcctgtaatcccagtactttgggaggccaaggcgggcggatcacgagttcaggagatcgagaccatcctggctaatgcagtgaaatcccatctctactaaaaaatacaaacatttagccgggcgtggtggcgggtgcctgtagtcccagctactcgggggctgaggcaggagaatggcgtgaacccgggaggcggaggttgcagtgagccgagatagcgccactgcactccagcctgggcgacagagtgagactccatctcaaaaaaaaaaaaaaaaaaaaagaaagttatgatcaaaacaagaagcaggccgggcacagtggctcaagtctgtaatcccagcactttgggggtccgaggtgggcagatcacttgaggccaggagttcaagaccagcctggccaacatggcgaaaccaacatgtccctactaaaaatataaaaattagctgggtgtggtggtgcacacctgtgatcccagctactcaagaggctgaggcacaagaattgcttgaacctgggaggtggaggttgcagtgagccgagattgcaccactgcactccagcctgggtgatagagcgaggctccatttcaaaaaataaaaataaaataaagaaaaaagaaaaaagccagaagtaaagtaaaatagatcataattttcctaattcatggtaagaagagaatcattgggacctgggtgctaggaaagttctcttttcaaatgactcagggactatcgaattagacgtataagaaagaaatataatcctagcattcctcttcttgacctggcactgaaaatatttacatagactttctaatgtgaatttttgtttttgcttttcaggttttagcgtcaacctatacacaaaacatggaaggataggtttttgttgctggatgggacacatttctctcctctttctgtgtagcaagagttaactccagcaggcctgggtgttcctgcaggtggtattggggacccccacacctgatatatgaccatgtatgtaacaccatccactgttatctttagttctttgtatgtttaaataatacatttaaatctcttgttccattagctttcactagtaaagttatctttgaccattttgcatcagctacactttaattttacattgtcggggttacttttttttttttttctttttgagacggagtttcactctgttgcccaggctggagtgcagtggatggtgctatctcggctcactgcaacctatgcctcccgggttcaagtgattctcctgcctcagcctcctgagtagctggggctccagggtgccacacactcttaaacaaccagatctggtgagaattcactcactattgtggggatagcaccaagaggatggtgctaaatcattcatgagaaacccacccccgtgaaccaatcacctcccacttggccccacctccaacagtggggattacaattcaacatgagatttgggtggggacacatatccaaatcatatcagtctccaagtgactatttcatcagtttagagtcgccccaggaaaacagaaaccacttcgacttagggcactaaataccagggaaagggtacccaggactacttggaggttgataggggatcagcacagcccacccgaggttggggggccacagagagaaggcctagaaccacaggggccttttggtaggagctgcagctgccgccgagctgctccccccacttcttcttccctctagtctccggctcgggtctcctatggtcaaacccagccagaaaccagctgagcctggatcctgggacaggcaggcaacaggacctgcccctgcagggtgagggagagggaaggccagatttctttttaaagactttatattttagagcactattaggttcacagcaaaattgagaggaaggtacagagaattcccatattctccctgtttccatagttttatcttttccagaatgtcatagagttgaaatcctacagtctgtagcctcttcagattgccttctttcactttgtaatatgcatttaagcttctttcaatgttttttcatggcttgagagctcatttctttttagcactgaatgatattccatcaactggatataccaccgtttatttatccattcacctactgaaaggcatcttgattactcccaagtttgagcaattatgaataaagctgctataaacatccatgtgcaggtttttgtgtggacataacttatcaactcctttgggtaaataccaaggagtgtgattgctggatcatctggcaagtgtatgtttagttttataagaaaccaccaaactgtcttttagggtggctataccattttgctctcccaccagcaaggaatgagtttccattgctccacatcctcaccagcatttggtgttatcagtgttctggattttggccattctagtaggtgtgtactggcgtctcattgttgctttaatttgcatttccctgataatgtatgatatggagcatcgtctgatatgcttatttgccatctgtctatcttctttggggaggtttctctaaagattttcgacccaattttcttgtttgtttgttttttgtttgtttgtttgatttgagacagagtctcactctgtcgcccagattggagtgcaatggcgcagtctcgtctcactgcaacctctgcctccaaggttcaagcgattcttctgcctcagcctcccgagtaggtgggattataggagcacaccactacgcttg

SEQ ID NO: 3 - DNA, 82772 bp, Mus musculus
taccgacaagtttaaggatattccccactttctgttctattagattgtgtctggttttacattgatgcctttaattcatttggacttgagttttgtgcagggtaacaaatattggatctattttcattcttctacaggcagacctccagatagacaagcaccatttgttgaagatgctctcttctttctattataaggttttggcttctttgtcaaaaatcaaccacccatagatgcatgggcttatttctggatctttgatgtgattccatttatcatcatgtgtgtttctataccaataccatgcagtttttattactatttctctgtaatacagcttgaagtcagggggtggggatacctccagaaattcttttattgtacgagatcattttagctaccctgggtttttgtttttccatataaagttgagaattgctctttcaagttctgtaaagaattacgttggaattttgatgggaattgcattggatctgtagattgcttttagtaagatggccattttcactatattaatcttactgatacatgagccagggagatctttccatcttctgatattttcttcaatttctttcttcagagacttgaagtccttgtcatacaaatatttcacttgcttggagttataccaaggtattttatgttacttgtggctattgtgaagagtactgtttccctaacttctttctcagcccatttatcgcttgtgtagaggagggctattaattcctttgagttaattttgtatccagccaatttgatgaaaagtcctctggtacaatttttggggtcacatatatatatatactatcatatcatctgcaaatagcaatactttgacttcttcctttctagtttgtatccccttgatctccttttgttgtctcattgctccagctataactttaagtactgtattgaagagatatggggagagtgatcagtgttgtcttatctttcctggatgtgtcatgaaccttttagactttgcattttctttgagtgatatattgatgagattctctcttccatttcctgtattctgttggtgatgcttacatctgtagttcctgttctctttcctaggttttccatcttcaggattgcctcagtttgtgttttctttattgcttctattttatattcaggatttggacagttttattcatgtccttcacctgtttgattgtattttctcatatttctttatatttatttgcttcctcattttttaaagatttatttattttatgtatgtgagtacaccgttgctctcttcagacacaccagaagagggcatcagatcccattacagatggttgtgagccaccatgtggttgatgggaattgaagtcaggacctctagaagagcagtcagtgctcttttttttattattatattttttattacgtattttcctcaattacatttccaatgctatcccaaaagtcccccataccctcccccccccactcccctacccacccattcccactttttggccctggcgttcccctgtactggggcatataaagtttgtgtgtccaatgggcctctctttccagtgatggcttactaggccatcttttttttttaaaagatttatttatttattatatgtaagtacactgtagctgtcttcagacactccagaagagggagtcagatcttgttacagatggttgtgagccaccatgtggttgctgggatttgaactccggaccttcggaagagcagtcaggtgctcttaccaactgaaccatctcaccagcccccatcttttgatacatatgcagctagagtcaagagctccggggtactggttcgttcataatgttgttgcacctacagggttgcagatctctttagctccttggttactttctctagctcctccattggtgggggccctgtgatccatccaatagctgactttgagcatccacttatgtgtttgctaggccccggcctagtctcaccaatcagtgctcttagccactgagccatctttccagcccggctttctctttaaaaaaaaaaaaagatttatttattttatttatatgaatacactgtggctgtcttcaggcacaccagaagagggcattggatcccattatcatgtggtcgctgggaactggactcaggacctctggaagagcagtcagtgctcttaactgctgagtcatctctctagctccttgcttcctcttttaatgcctctatctgtttgaatgtattatcctgtgtttctttaaagaatgtatttatgtcctctttaaaggcctgcatcatctttataaagttggatttgagatcctcttgttgtgctccagtttcattaggatatctagggtttgctgtagaggatagctgagctctggtgatgccatattgccttgagtcttgttgattgtgttcttacactgtcctttaggcatctggttttccctggtactggcaggatgatcctgatagcagcaggacttcatgaggaggtgggggaagccataggctagaaaatgtaggtcaggataccctactctgttggctgtgtctcaggcagacaccactctgcaggctttttcttgagtggttactactctacagggtgtgccccagtcagacccagctagggtgtcaggcagctccaactaggatgggtgttcaggcagggttccaagctggttagttttggggcccccaaaggtttccacaggaaggcaggatgctcttggggtcctgtgtgacttctccagaccaaggagcaagactagatctaaacagtggtgctcaggggacagttctcaggccaagttctactatgcagatgcttgctcatgagcttcatttccacagagagaggtgtatcaaggcaaatgtgtctgatcttgtctgaaagcatggactcaacttgctttcttgtagaacccaagatcactagtgcagagatggcaccacccacaatgggctgggccctccattctctcaccactcactgagagagtacacagttgtccacagctggatcttatgaaggtattttcataattgaagctccttcctctttgatgattctagcttgtcatgttgacataagactaaccagcacacacacacacacacacacacacacacacacacacacacacacacattaaaacagtgctctgtaacagattctgaatgataatgacgtgtcagtgtagattcattgaatatataaaagtctcactctaatgggtgttgataatgaaggaactgtgcatcttgttggggcagaaggtacatgggaattttcattaacctcttctcaattttatcaacattcagctactctaaaaacaaatctaaaaacaaaataaaaacaaagctaaggatgaccttgagtttctaatcttcatgctttcaccactggagagctggaaccacaactccctgtttgtgtggtgctagggaccaaatccagggctttgtgcatggtaggcaaataaagactctaaaactcatccttcacctctctcatatcctgcagggtggcccacactagatagtagatcttgcttagcatagtggcaagggggttcatagaagagccagagactaatattaaggcccaaaaatgaccctcaagaagtttcaaaattagaaaagaaacaatgaacaaaaaggggatctactagaattagatttaaatttcagttgaaaacaatcaaagtttgaaaatatgtagaacactggaactgtgagagcagaggaagtaccaagtcaataaacagagagaggcaagaaaattaataccaaacttggttctttgagtacataaaaagaaaacataaagagaaagtagcagtcaacctaagcaagcaagaaaacaaacaataaccagagaaaaaaatatttaaaccaaagctggaaaatagcagatattgatgaaatatctaatctcacaagacctcaaaaacgtgtttggtagctaactgacttatggccagacatcctctgccttctccaggctcaccctgatcaaggggagcagaacagctgcagcttccccaaatcccccagtctactcaccctcacctttcattggctagaactaggtcctgggccacatttctgtgaattaagaaaatgagtgggtgagggaatagaagcagggctggccaacaagctgctggagctgctcaacactgtacttggctccctttaagaatccatgtgtttctgttggctgtctgttttgacagcaaacctggatttgtttcatctctgtatttccatagcattttaaattatctagttaaaggaaggtttcacttcttgattgaacttgtgtttactgaagaacctttaaataagggatttttagctgaactttgtgtgtgtttgcttattaagttccactacaactcagtgggaaaaatgggtatcatttatcagggtctctcaaactctaatatccttttgttctactttcttctgttcttttctttttttttttttggtgattatcttttcatattttacatatgaaccccaacaatgtaaaattgaagtctagctgatacaaaactgtcaaatgtaatattgatattgaaagttagtggcatgagaaattaaagtgtgttgtttaaatttaccacaactaagataaccacataaggctgggaatggtggctgacacctgtagtctcaacacttgggaagctgaggataaaagcattgctgtcagtttgagaccactctgggtatagactgaagagacctcatctcaactaaaagaaggatgaggaaagaaaggaaaaggacgaggagacatgttagagttgtgctgcattttcacgagtctagtttgatgactcctggacaacttaagaagatagcactgtcccattatgctattttttcttatgtgccataaattagaaaattatgataaattttgctttgctaatgatattgatcttggtgtgttctaagactgagaatgaccttgaacttctaatcctcctaactccacacccttagtgctgtactgtactgtacaggcatatactatcacccccagtttatgtggcactggggatcaatcccaaggtttcttgtatgttaggcaagcagtctcctaaccaaaccacatcctaaacccatatccagcttcttcaaactcttaatcacaccttctaaaacattgaattcacaaacatatagctaatttgtttttaattcttggatctctctctctctctcatacacacacacacacacacacacacacacacactgagtttgtcatttttctgcccagttggcatccctgtgaacccccaccttgtggatcccaccacttcttttttggcttatatctttgttttgcttcaaaacatcctcaagtaacttcttaagaaaatgtatttgagagaaatttattagttcatatatctctataactccttatttcattgttatacatgataaatattttgacttgtacatgattctattgcttatggacaagcattttcctttagaatttttggggggtaacaagcaaggttttattgagaaataaataacctcctggatcagaaagggatccctaacacttgattgcctctcctacaattttaaaagctttgccctattgtctatgttctagttgccctgttaacttttgtctggtgctagtctcataactgtttcttttcctcagcttttatttttttcacttgttttttattaatcattttatttgtttacatttcagatgatatcccccttccaggttactcctccacaatcccctatcccataccccctctccacaccttttgcctctatgagggtgctcctctacccactcacccattcctgcctcacccctttagtatccccctaccctggggcatcaagcctccttcccctcccactgatatcagataaggctacatagcagctggagccatggatccctccatgtgtatacactttggttggtaatttagtccctgggagctctgggtggtccagttagttgatattgttctttgtatggagttgcaatccctttcaggtccttcagtccttcctctagctcttccattggggtccccagactcaacccaatgattggctctatctcaatatgtattggtcaggtgctgctagagcctctcagaggacagccatgctaagctcctgtcagcaagcacttcttggcatcagcagtagtgtggacgtttggtgtctgcagataggatggatctctaggtggggtggtctctggatgtcctttccttcagtctctgttgcttttttttttttttgtccctgtcatttctttggacaggatcatttctgagttaaaagttttgagatgcaggggtggccccatctcccaactgggggccatgcttatctactggaggtggtctctacaggttgtatcccccctttgttggatatttcggctaaagtcatctccattggatcctgggagcctctcactcccgtagaatctgagactttgtaggttttgctcagtttttaattttcaaattcttgttaagctctcgaattccagaatactcctcaaagttctcatttttctcctctttttaagaattactttttgtctctgaatgctctattatataatgttctgttcttatttatagatgcaatatgtgttttttttttcagtgttgggcattaaagccagtgttttgtacattttagacaagaccttgaatttttgtgtgtatggaaggctcccgtctatttctttttcatgtttaagaagacaggttctaacaatatacctctggctgacctgaaacttgtggtgattcttctgcctcatggcctcctcagtgctaggattacaggtataagacaccacaccgagctctttctctcaattttttatggtacttagtaattatttataattaataaagaagagttcaatagctattgtggatttaatgttctgttggagatctgctttcctgatccaaacgacctctgtgagggcaggggctggaagagtggagatcatagagtctactggctaaaatgaggaagaaattactcaggaattgtcagcatccatgctggaagccttggctctctacagatgttcagcttctttatagaacagccagatgttttctctttaagcccttgttggctccagctcagctgtctgcttggggagaggggtgttccaactgaaaccatcatcctgcactgaatccctgtgtgtctactattgttttatttcattttttgtatataacgtgcctccagattcagactctttgttgtttaacctgcaaactgccccctatctcttctgcagctgcctggtcaaatattttcagctatatttttccagctaccgtatttttcaaataattcttctctacattctcattctctctctctctctctctctctctctctctctctctctctctctcttgtggggtgtgtgtgtgtatgcaggtatatatgtggatattgatgcatgtctacatgtacatgtggagacaggagacaaccactagtgttggacctcaggaaccatcatgggggtctctgtaagctctactgcagggaaatgaactgcaaggggcagaaaggaaatctgtcttagccagtgttggttcaaaattctagtctgaccctgtgcggtttattttaaacttatttaagtatggtgcaattttgggaaagaaaagttccctggttacagttttctcaattctgtgtagaaaatgaatatttgggcctaactacatggaaagtcttttgcaaagtttaggtgacctctaccgtgaggatgcattctacagcttagggccctaggatctggtgtggtttctgtcatgcagatagtgttgaggtcaccaggctataaaatacttgttgacatctcagtctactgactgagaacaaaactgcggatgaaggtctagggagggagagtctgatataaactgggggaggggggatttgggtgtgacctgaccacacaggtggcgcagaccaccaggctattaacaaaatccactcccagccttctgggtggaaaagaggcatatacatcccttctgttgaagagacaagcctgcctgcatgcttcacatccctggtttctatattccttgtctatgagcacagagacttcatgccctccacatccatcatatttaaaggtgatttaaagagattgggcctatcacttgcatgaaactcaccaagtaggctgggttaggctagtcagctagcctcaggattctgcttgtttctgactccccagtactggaattacaaaattccaaacacatggctccatgttcagatttaaaaaaaaaaaaaagttttgaagattgaaatcagattctctctttttgtttgtttatttgtttgttttgttttttgagacagggtttctctgtgtagccctggctatcctggaactcactctgtagaccaggctggcctcaaactcagaaacccacctgcctctgcctcctaagtgctgggattaaagttgtgcgccaccaccgcccggcttgaaatcaggttctcatgcttgcaccatcaagcattttgccaacagaactttcaccaaagtttctttatttccttttaatcttaggcacttttctttcattgcaaaattttgtctgtctgtctgcctgtccatccatttggattggggagaaggaaagaatgagccatagcaagtatgtgaataaaggtcacaggacaatttatgggagtcagttttaggtactgggacttggacttaggtcatcaggcttagcagcaggagcctttacactgtccatcgtgccagccatggtactttttttgagtagttttaagagtaaaaaaggaaagctttgagagcatgtacatgcaagcataatttattgtctttttctattttacctttaaatgtgtatttatttttattttatgaatataaatgttttcctgtatgaaagagattgggttttgttttgtttatgagacagcatctcatgtagcctaggctggctttgaattcataatgtagccaaggatgactttgaatttctgatgttcttgccttttacttcctgtgtactggccttataattgtgcaccaccatgacaggtgtatgtaatgctacgggttatcccagggctttgtacatgctaggcaaacactttaccattgagcaacacttacagcttctgggacacttgattggtgtgtatgatggatgaatggttttgggagatattacataagtatcctcaagtcaaattgtgtttatacttgtgtagcatcatatgggatgtgccttcagtattttgaactgtgtcatctttctcatttttctttgtcattttggaattaaaaaaaaatgtcccaccactcccacagatttttggatagagtggatgtgtgtgttctattttccatattgctaaaattcttcagtttgttgagatatatacatgtagtatactttcctggttgtaattgccccactttttatgttggggattgaatccagggctttatgagtggtaggcaagtgctctaccattacgttttatcctcagactctatctccccattttaaaggaatattatttttaaatgctacactctcattttttaaatggctccttttaattctactgctaaaatacttttggtacaatatgcctttttttctattttttttttttagtgcaagtataaaatatgtcatttaaatctcttttatctaatttaaggaacttaagattttcttcccaaaatttcacaaggtaggaaaatgatgtactttatttttgtgaatgatattgcactgtagatcttgctgtttcttgctttgttctcaattaaatatcatgtttcctctacagctttatagacattttgatcagattaaggacattctaattatagttctttaaggtgtttttaaaatcatatgtaggtattgaattttattaaatgctttttcctgcatgtattgggatactcacatgatctgttcttaaaattataattgatttctaattttaaaccatccttgcattcgtggaataaaactcagcctgaaggtgtggctggagagatggcttgttgctcttgcagaggacccaagttcagatcctattctctgtatatgcaaatacctgtattctcacaccccaacatacacacacacacacacacacacacacacacacactaccactcttacccacttgttttttacatttctatcttagtattttatgtgtataagtgttttgcctggtgctcactgtggtcagaagagggcacaggattccctgagactagaattacaaatggtttagaatggccatatgggaaatcctctagatttcccccactgtagtaagatattcacttaggtgatcctgtcccaaagtcagccatcatccttattttttttctttctttccatctgatatccaatacttttggctcaatttttaacataaatcttaactatcacaacttatcagatttcaactgctactgtcctggttaaagccttcatcatctatctttcttcaactgctgccaggacctctggaccagccagttcttcattcttcactggcaacataggttttatggtgacagctagtgactcaaatatttatcaagggcttctcatctcaaaataatctcctagttcttttggtggcctaggtctctctccagtcacactggcctccttagtaaggcaggcatagtccttccttagagtgtttaaacttgcctagaatgttttccccaattacccatattgggagacgacatgagggcaaaagctagagggtatcataatagcacttcttttgtccttgccctatctatttcaaagtctttatctctgtgcaaaattttaagttctactttcttgtatgtttagtatgactcttccttaccaggagtctagtttgtctccttgttcagtactaaaacagtgcctagcaaataaatgaatagagaggggagccaaatttgaatcagaaagtctcttgttgcatagtgtttaaaaaacaaacaaagaaagaaagtctcttgttgagcatttgtttagcacaaagagcattggatgctgactggtatcagggtaaggctgctttgacaatgctccctctggcctcactcccttttatacgtacttccatcaaaccatctgattcaacaatgacagaccgatctcttatgggcttggcacacaccatctgcccattataaacgtctgcaaagaccaaggtttgatatgttgattttactgtcagccttaagagtgcgacatctgctaatttagtgtaataatacaatcagtagaccctttaaaacaagtcccttggcttggaacaacgccaggctcctcaacaggcaactttgctacttctacagaaaatgataataaagaaatgctggtgaagtcaaatgcttatcacaatggtgaactactcagcagggaggctctaataggcgccaagagcctagacttccttaagcgccagagtccacaagggcccagttaatcctcaacattcaaatgctgcccacaaaaccagcccctctgtgccctagccgcctcttttttccaagtgacagtagaactccaccaatccgcagctgaatggggtccgcctcttttccctgcctaaacagacaggaactcctgccaattgagggcgtcaccgctaaggctccgccccagcctgggctccacaaccaatgaagggtaatctcgacaaagagcaaggggtggggcgcgggcgcgcaggtgcagcagcacacaggctggtcgggagggcggggcgcgacgtctgccgtgcggggtcccggcatcggttgcgcgcgcgctccctcctctcggagagagggctgtggtaaaacccgtccggaaaatggccgccgctgccgccaccgccgccgccgccgccgcgccgagcggaggaggaggaggaggcgaggaggagagactgtgagtgggaccgccaaggccgcgggcggggacccttgctggggggcgggtaggggcgggacgtggcgcgggaggggcccgcggggtcgggcgacacggctggcggatggcgtccctcctctctaccctccccctccctctgccgccggtggtggctttctccactcgtctcccgcaatcgcgagcgacggttctcagcgcgatctccctggagccaccttcgaatgacgccctcccgctgcccgccccatctgtgcgcatcctaggccccagctgtgcaagcgcccttgtcgtctgggcttcgccagttggggctgcgcgcgctcctgcccttcttggggctttgggcctcggcactgtcgcgcgcccgcggtcccggcctctccctggatcgcgctgtccccttctccctcgcgcgcccccactcccgttacttgctcccccctcacacacacagactggcgcgcgtgcgcagtccatctcccgttgggagagtgcgccacaagggctcctgagctcttacccccatctctgggttttgctccctcctcctcctctcccattccgtgactttttgcccccactgcaagcgagtcggtccatcagctccattccccacttggcaggaacaagttgagggttattgtccacccacaaaaaggactagacattatgttcctaggtcccacaactcatcataaagagatggttgtagttctcatcaggaaccgtgggcaagggactgtgcgttcctcagcactcgaagctcttccgtgagaccatgcccgcagggtgctctggttctttggggatgctgtgctgtggcttcggaatatgagcgtcttcccaccctccctcccctcccttcgccagcgatcatccagttacataagtggaatgggacgttgtatgtaacgggctctcttcgtcctggagcgctcaggatcgccagtaccaaatggggcgagatcatcgcatcgctgtgactcctgtcacttatctttgaaagttcattctctttttagtttggttatggctgaatcactgaaaataaaacacaggtgacttttatgtggcagtggcaatgtttctgaggttttgcactaaaggtttaaagtcatcatggagtctaaaaaagattccctctcacaagagagaccctggtatgacattgttcagtatggacccctgaagggcaaagcttgttaggggatacctctatgctggttccttgtatgttcgggtataggttgatcaaaacaaaaatgggctccaccacaaatttgatattcctgactcatagtcaggcagatatgtactcttggttaattttccaggaacacaaatgggctctgttgagtcatttgcatgttgactccactgtttggaatcattacagtgaggcagtaggctcaaatacagggtggttgatgacgatcatgaaacagaatggactaatttatagtgctaagtgactgagatgttgtaggacaagttctagatattttgttatactacataaatgaaaccaatttgggcctgggtagtaaaatttcactaataggtaattattactgtagaggagaattttgggtttgtggttggaattatgtgaatctcagcaatttcaattaataacatgattaaactgatatcttaggttctttgaaatatgtcgaatctctataaaaagataaaatttggattgttaggtccttggggagtttccaccaaggatttggaaaaatatatttacagacttttggtttttcgtttgtttttaacttcaaattcaagtcatactcagaaagcctaggaaacacttgcttttattttcttacctggatatgtcagaaccttaaagagtccaaacactgtaaaagtacaaatgatctaaaatgagttaatacacatggccgacagagtgcattcactttcacaaacacacccaagtcttgcttgtcaaaaaattccaaggtttgtacatctgagcctgagctcagagttggaacctttactttgtttttatattcttacaacaggtttgcttcctcaggtgcccctctggttatctatttgttgtacccatagctctttaaacatcgtaagcaacttctagaacacagtttcctttcaaagtgcctggtgacatctgaagctagtgtgtcctaagaatttgaagaaactgtatggctttcttgctagtattgatctatcacatatgcctattttctttccatgagaatgtgtcttgagtactttaaagctacagtaacaggtcactatttcactgaagaagaaagcatcatgttgtccattgtactctaaggattatttttttccttttttttttttgttattgttatactggtggtcaaacccaggacctcatgcatgctaggcaatcactccacatccttagccttctactctgttttttgtgctgtttgactcctgaggtacatatgaccacaaagactacacatagaccacaaagattttggaaggttatgatatgtttttgcaatctgtgtattttccagatagagtggttcactctacctgatctgcttctatgaagcctaatctattggggatagggaggcaaagctatggagtttaaggagaaatcagctaaacccttgttccagtgccccaactccacccatgaactcctgagaagttttttttttttttaaacctaaaataaagagcagcagaggtaaacgtgttagtttgtttgcatggtaaatgatatatcctggaacctgttatcttttctaaaggtaattgtcagtgagaatctttttttttattcattattctcatatattgcatcccaactgtattttccacttcctcctctcctctcagtccctcactcctcccttctccttccccatccactcatccttttccctttagaaaaggcaggcctcccaggcatatcaatgtagcatggcatattaagtttcaataagactagtcaccttccctcatattaaggcagcccactaggaggaaggggatgccaaaagtgacagagctccccactccctctgatgggagttccacaaaaacaggtcactcggtggggaatgttttaattggctaagagcagtttaccaccagtgaactacttctgggaagcatagactgatggacaatgacatttctagtagccagtgtttttaagcgcagcctagactagagaattccaggaagtgtggcagaatatctcattttaatcacctgctctggtaacatctgtgcagcaagccatgtggctaacagaaacaatctttttagttgggtagaaaacactattgttcttccaagggaaggacattgtcctcagtgcccatcacagccatttttaatcactccgctgttgtccaatcagagtgctgcacctgctcatcatttcagggagtccagtggctccctacttctggggctagtttatacagaaggtgtgtgtgtgtgctcttctgctttctacagctctcttctgcctttctctcccaaggaacattttcctttgaaagtttgatttcaatcacttttatgggaaatatagtgtgtggaatgtctgaatggtggcaagactcaagagaaggcagacgagcctactcccatgttaaagggggaaatatgaccttttcctggacactgctagcatgtgaatgtctgctcacctagctggtactatggatgtctggactcttgttactggccaagccttagtaaaagtgtgcttatcttttcctaaaagcagggggtattttagtatgaatatttttgttggattttcacctaactgaattcatttttaactttttttttcatcaaatctcaaacttttttaagagcttagaataaagctgagttcagcttctagtgaaataagggctgaagatatagggctcagtcagtagtgtagagcatttgcttcacatgctcaaggcactgatttcagttccatccttacaaaaaaataaataaataaaattgcaggtaggtaaaactagtcttgagaagttgtgactttgcaggccttcttataaacaaggcactggtttgagtttttttattaggctgatatccaaaaaacaattaactttgggatttcaaactgttccatgacttaattctatgatttaaggaaattatagaaatgaagaggttttgctgagccttaaaagagaactgtaagcatcgtctaggtaaatagcatacagctgcaaaggacttggttgctgttgcctttcctctggattcaaccccatgagtgactataatagacttaagttgtatagtataagcttttcttttagtgtaaagataaaagtgttattgctgggagagccaggtatctaaaattaggtatttaggtagctaaggctttaactaggaaacgatggttagcttggtggcaacagccttatttgaacatgtgtgcaaaaaaaaaacaaacaaaaaaaaaaaaaaacgagagactgaagccggaagaactgagtttgaggacagcctgaactacataacgagactgcctcaaaaacaacaatggggggagggagagcgctcagctgtttagagcacttgtttatcttccactaccttcatagaggctcacaatggtctaattccagtccccaggacccatcttctagcctcagcaggcactacatgtgggtagtgcacagacatacattcagacaaatgctcatgcacataaaataaaaataaataaaatctcaaaaattttaaagaaaaacagtaacaaaaaggtcaaaaggatcatcaactctgtgttacagccattgagatgtactgaattgagagggttacagaaattggttagagaaggacttatagtttggatgatggctttggatctcctggtgttttgtcttttatctcagggtgaaaacccctttgtgatgttagagcagttccttgcagctttgactgctggaagcagaagagagacttttgcctctggatttggttgtgttctttttgaggtgatgtgtgggtgtttgggttttttgtttgtttgttttggtttttggttggttggtttttgttttttttggggtggggggggagttggttgttttgttttgatgttgcatatactcttgaacacattctatccttgacttttcctgtatagtgtggtggaagaagtacttaagcagaagtcaccacttgtggtgtgcactgtagttccaaagtgttccccagaggtgtaaggacctctgatagtgacgcttctgacagccataactcttgtctttattttagcattctgtgttttgtggcagtaatttgcagtttattctttgcttctaactagctgagctgggaagtaacatagtatgttgtctgtttatcttcagaatgttccaaaaagccttgggaaaaggtgcagctcaatggggactttcaacttacgattttctttgttttaggctccataaaaatacagactcaccagttcctgctttgatgtgacatgtgactccccagaatacaccttgcttctgtagaccagctccaacaggattccatggtagctgggatgttagggctcaggtaagtaaccttcctttttttttttttagtatatgtcctggtttggccatctgtttttaaaaaaaaaaaaaaggaaaaaaagatatactattcttggacagtatgaaagtaccccaaagacaaaaaatataactgggccaaactgtgccatataataaaaaaaagtcacttccctgagccctgaaagttcagttcagtttgggtagagttacttggtagccacagtgtgatctggggggtgggtgtcagattagagctggaactggtgatctgcagcttcagttcaccttgaagcaggagagtgcttggcctgagctcttcacctgtgctgctgctcttacctagtggtcttcagcatgatgctttctttgatttggtttgggctaaatgacttgcaggtcgatgttagcaagcagtggtgtgctgcattttcagatataggaactggtatgtggtccccttagaagagcacctttctgaaagtgtcacggcacaatggagcctgtggttagtggtgcttgcttgctgacctctgatggatgcatccagacagatgtgcgactctcgggattctagagcaggaaaagctggaaagcccagttgtttttcagacctgacaaatctgtactgtgaactactgcggtaccattgtgtggactttagtttttgcaagaatgacttgttctgtaatttcttatcctttatcaggctcaaacctctcaagctttttttaaattagtaattattctacatttgatagtttgtcacctgtatttctgtgtgataaaacagataatgccaattgacttttcctatcttctacaaaagaaaatgttgactgttcacacatgctgtgttttgattgtagcagagatccccagttagcattttctgtatctctaaatgtattacacactgtacagacgcaacacacatgtacacacacacatagctgatttatggggggggggggtaagttttgggtggaggagaatagaagaaaatgaagatttgattctgcttctgatactgtgacgtcagttgtcattctcctcactgtcatgaggtatgatccagacctgaccgatctttgtgcttcacacatttatgctggtgggagttatatggctagtgctttgtctcaagaattctactaaatgtaatagaagcactgatgggtagatgttaggctgggcgtggtttgcggtttttaaagtctttttctcagtttatgaatgactctgggaaaaagacagtaatgatactatacatgtttctccagagaaagggtggattttttttttttagaaaaagtcttttttttcttttatttatttatttttattagatattttctttatatacatttcaaatgctatcccgaaagttccctataccctccctccgccctgattccctacccacccactcccatttcttggccctggtgttcccctgtactggggcatgtaaaatttgcaagaccaatgggcctctcttcccagtgatggccgactaggccatctactacatatgcagctacagatatgagctctgggggtactggttagctcgtattgttgttccacctatagagttgcagaccccttcagctccttggctgctttctctagaaaaacaaccatttcaggtcaaacaatacaacttttttctagaaaaatgtatatcttttcttcttaattaaaaaaaaaaaggaaaagaaaaagccaagcatggtggtgtacaactttaatcccagcacttgggacacagagataggtagatggatttttgtgagcatgaggccagcttagtttacatagcaagtttcaggctagccaaggctacatagcaagaccttgtatcaaaaaaaaaaaaaccctataaactttaaattagaacttcttcatcagctagtcattttgaagaatggctacctagacttggaggtactggtaggtatcacctttctgaaattcttgggacttcataattagatacctattttttaaatcagtgttctttttgttattactgagctgtatctcagtaattattggccatttgtatctggcctatgtgaactatatgttcatgttctgtatttattattccatcaggatattttttattaatttttaattctttgtgtgtgtgtgtgtgtatgtgtgtgtgtttaattctttttctgtgtctgtggggctcacgcggaagatgaggggtgcatatgagttcaggcacctacagaggccagtggtagatcctcttggagttatagttatggacagttgtaagctacctcacatgactgttaagaaaccaaacacaggtcctctaccagagtcacaagtgatcttgacttctaagccatctcttcagcccccaagatacttctttttaagtgggtctgtaagaagccaggagctatactttctagatctactgaactgaatacctaacctgtttgtccttctattatataaaatctcaggcagcccagtgattagcttagtgggttaaagatgcttccatcaagtctagtgacctaaatttgatctccagaagccatatagtggaaagagagaaccaactcctcgaagttgttgactccaacaagctatctttagactgtagcacacatgtaacatggacacttaaaaaaaaattaagatttcatttgctcctagaaagtgttttctggaggctggagatactgtttagtggttaagaacataggaacacttgctgctcttgcaaagggcctggatttagtttccagaactcacaagggtacgtaactcttgttccatgagatccagtgccctcttctggcctccacaggcatcacacatgcatgtggtacataaacttacaccatacaaaacacataaaattaattttttatacaggaaaatctttttcttctaggagttagttgatacttccattttttttctgaaaagattgatgtattttcaatgtatacatatttaatgtatcataagttcctgtttgtccacattcctttttaagttgtttttttttaagattttatttatttattatatgtaagtacactatagctgtcttcagatctcattacagatggttgtgagccaccatgtggttgctgggatttgaactcaggacctccagaagagcagtcagtgctcttaactgctgagctatctcaccagcccttaaattggtttttaaaattgtgtgtgtgtgtgtgtgtgtgtgtgtgtgtgtgttaggctaatggatcattaggcttagtggcatgcagcccttaggtagtttttaaagttagcttataaaaatgatggtcttattatggtattttcatatatactctgttctgttgctcattcttccccattccttttcctgttctcctgccttatccttctggtcctcactacagaaccaccaccaccccttctctagtttcatgtcatatgttacctgtttccccttaagattgccctgtgttttcccaaatactggtttttatatttaactttgagatgggatgatttccggagtatgcttgagtttgactttggtaaacttgtcattcagttttcaaattattattattgccttccacatccagatctcttttcttttataatgctgcagttctatgctcactgaagactaattttcgcttcttgcttcatccctatcctttgctaaaacactctcctactggctgtcaataccgtctagtgccttactctgaatgtttatgcatgtgcattttatgtattttgtatgtttacacatatacaaaaagtatgtgggagtatatcttttacttgaaccataaaatatggcacatagttgcaaagcttgccttctagttaatgtatcttggcgattatctggaattagtttatacagaaccatatcattctttttaactgatgaaataaaatagtctatttatggggtatgctataatacatttgattttctattaatggatgtttgtgtttctaattgtcaaaatgtcatttatcctaccatggtatggtggcacatacctttaattccaatacttgggaggcataagcaataggattattgcagatttgaggccaacctgttccgaccattcagagctacatagaaaaaccttatctacctcaaaatgttgatgctctatgtgttagttagggttttattgctgttaaatagggcttattgcatggtcaccatgaccatgacagctcttatacaggaaaacatttaattggagctggcttacagtttcagaggtttagtttgttataatcatggcaggaagcatggcagcctacaggtagacatggtgctggagaaggagtcaagaagagttctacatattgattagaaggcaaccaggaagagactcattccacattgggcagagcttgagtataagagatctcaaagcctgcttacacagtgatgttacttcttccagcaaggccacacctacttcaataaaaccctgccttctaatagagccactccataaggccaagcattgaaacaaataaatctatagtgctcaaacctattcaaaccactatactatacattttttcctgtatttagctcagaggcaagtttatctgtaagatagagttctagaagtggaacttgctagatcaaaggatatatacattttaaattttcaaagtatttctgaacaaaggggtagccatttagttgtagacttttagggggaaaactataaatagataaatacacgaatttatgactacagtactatttttagagattagagtgtagttgggctaggaggaagttgtttttagcagttagcactagaaaccaaactttggaggcttccatttcataaaatatgatcttgtgtaagcagggcatttcaggcaagacattttacttgatgaggggaatttcagctagttcctatttatgaatcttgaagaaaatcaaatggttttttattttggaccattctaagttgtggtagctcctttggattcttggctggagagtatccctcagatgctggaccttctgcctacatcctgttttaatttgcacaaagaatatcctgtaagtatttgggaccaagttgctgttgctttatttatttatgaatgttgtagtgtatatagcagtactttattcatgtgatctctactgatcgagcatctgttatgtgtgctaactactgggactgtccttaccctggcctaatgtaggtacggatgggcaaatgggctctgattttccaaggggtagacaattatgattgtgaagagtgtctgccactgagagagcacataaaatgttagatttagctgggcggtggtggtgcatgcctttaatcccagcacttgagaggtagagacaggtggatttctgagttcgaggccagcctggtctacagagtgagttccaagacaggcagggctacacagagaaaccctgtcgcaaaaaaaagcaaaaaaaagttagatttatgggatggaggcagagaacagtttagttgtctttttcttaaatggcagtcagcatctgcacagtaaggaaactttagctgagtccaggagaaagcatcagtagaaaaagatgatgagtcttaaaaatagacaagaatgcctggtagctgaggcaggaaagaatatgtgtctggctcagtacacagacataggcaggtgtgcatagtcagctggggcctgaagatgggagctcttacgttttggggcatgtagtatgatgttcaggcagctgtatactagtcacacaagccaagatacagcatactcttaagatactactcttatcctcagagttaccaagcagtgctctgtccatttatcctgtactatttccacaatgaatttattctgtacttactctaaggacaatttctgtaaccttcccattctacctattggagctccagggttcccattatagatctccttacagaacctccttcccctccatacttttgtcccaggagattggtagacacttaagtaggacagggcttctccttccaacatattctctattaacattattctctattaccatagtaacactcaatagtgccagcctatgaggtagtccagagcttgtacaggagcaaaagctatctttggtattaaatgatacttctcttgatatttttttattctatgaaaatactttaccactaagtcatacctgcagccttaaacccttactgatttccatcagttttttttttaatgtgtgtatatttttgtttttgagacagagttatgctgtatagcactggctggcctagaatttgcagcagtctttctccttctggtttccaagtgctgggattacttactggtgggaaccactatgcccagttatttggtttttttttttttttttgagacagtatcatatagcacaggctagccttaagatcactatgtagctgaggctagtcttaaattactagtcatagtcatcctacctctacttcacaagtgcttagattagaagtgtgtgtcacaatccaggcgtggtggcgcatgcctttaatcccagcactcgggaggcagaggcaggcggatttctgagtttgaagacagccagggctacacggagaaaccctgtctcgaaaaacaaaaaacaaaaacaaaaaaaaagtgtgtgttaccatagtaggctttattatttttttgaacaagactttgatagtaaaggaagtgtatgaacaaacttgtttctttcctgtcatggactaggtctatcctgatgagccaatgttaacagcagtcctctaattctcccaacctgacctcagggactgaaactagaaccttctccagatcctctgaactttttgctcttctgttctccctaggtcattctgtggttgttttcccagtctttttagcccttgtaccctacccacatgtggtagctacttacatactttttgacccaaacataagtgttagcaatctgcatgcgtattcatgccagcctccttctgtagaacccagaaacagtcccagctaaactccaactcatggtaatttccctgcctccctaaagtagctagtctactaaagttgatcaggacacattacattccctgcaaggttgtgttgtacatatagcatattctacagtgcaggatgctattgtatgcaactcctttcttttttaaagtatggttatattgatctttgcagaccttcttcatttgtgtttccttttgctatggaaacatttttgtaacagaaatctaaccagagttttcactgagaatagattagatagaagcaaggattggtatttgctttatgtttgtatcctttggtcttgttaaccagaagttgttacatttctatgtttataaaatctttccacacacacacaaaaattgcatctatgtctagactttcctccttgtctcctttgtaacctctgtatttctactaaaccatgaatttaatactttggcagcgcaatcttaattttctccatgtaagtcaattttgaaaatcttgaaatactttttggcttgcttgaggcttctaataataccttggtattctcctctaacctggggccatagctgatgcatttttataaatgatttgaacagtttatactaatatatatttatgcttacttgcctaataattgacagttgttcatctttgtccagttcctgataatcctatatcttcattagtttgtaccttataaatgaacagattaagtataccaaactactaagggaaaaatacattgcttgaggtatgtattagcattgctttgatgtgttgtattctaatttttcctacacacatttggtaatttatttttaaaatatatggttccatgtgtttctaggttttgtgtttttgtaaacagcagaaggtattagagcatattaagaactaatttgctctaatatttttagctgtttttggaattattcttggcaaaaaaattagacaaacgtctgcaagttgtgacagtttggcttttgtttgttcttttaaattccaagataaatagatatagtgatttttttttttaggctagtaaaactatgggaatgataaaatccaagtagttaggacagttgaaagttgtatttttttaatattttttatgtatatgggtgttttgcctgcctgtgtatctgtacacagaatacatgcttggttccttgaggaagccagaagtaagtttcagacaattttgagtcaccgtgtgggtgctgggaattgaacctgggtcctctaaaagagaagccagtgttgttagccagagccaactctagccctgaaggtgtgttttaaaatgttaatgtcgcttataagtacttgtataatatttcttagatgttcttccagattaatataaaacaaacaaaaatatgatacttttaagctttttgagctttggtttttttttaagtagcatgtcatgtatcccagacttctctcaaactccctatatagctgaggatgaccttgaacttctgaccctctttcctccacaactgctgagattatagacatcaccccacaaagcagagctctttatttttcattataaaaatggaatattatagtaagaaacttggaaaatgcatataggtacaaagatcaaaagttaaaaaaaaacatcctgctgagcctggtgggacatgaatccaggactggggaggtagaggcaagatgggtctctaagttcaaggccagcatggtctgcatagtgaattccaagacagccaggacttcaaagatagccattctaccttatttttaaaaatcaaaacaacaaaagtaaaaaatattctgataattcaccaaaggaaactgttattcatgtgctcagagataaggttgtagctcagtagtggaatgctaacatggtcatagacctgaatttagtcctcagtaccacaaggaatatctttttagatttctagattaagggctttgagtcttagctcaggggtttgtgacctttgatgggggaaacatttcattgttattcactgacagttgtagataatagattatttatagtactgttgggaatagctctagctttgtcatgtagctcagtggtagagcacatattcagcatgggtaaggccctggatttgatctctactaccaggaaagtatgtgattatcaccagtagagaatagaaatctttgcagcttacactatatttattgtagatatttgaaatgtcatatgtgttcataattgtttgtaactttggtctacctttggatctgattaatgatttaccaaagaagtgcattttattctagcacaaatttgtcataaatcagtgtctatatattttatgtatttcaaatcatttcctgagaaggaattcagaaaacaaaaagggttcttggccaaaaaaggggggtttacaaatacccatctgaaagtatagcttattggtaggatgcttgcctggcatttgtgagatcctgagttcaatactgaaatcttggaggtagggtggggagatttagatggtgtgtttattatcccatgcagcaataaacttttaaaaaattatgtcgggtttggtcagtacttgggaccccatcataaataaataattaaatgaccagtcactttgaaaaatacctcaagaaaactttagaatcactgggtaaagtgcttcattcatatatatatatatatatatatatatatatatatatatatatatatatatatatatatacacacatacatacatacacacacacacacacacacatacatacatacatacatacatacatatacacacatgagaatctgagttctgatcgccaacaaacagatatggcagagatgaaagcaataggatcccaggggccctctgactagctagtctagtcagtctgtgaggttcaagtttggtgagagacactttctcaaaataaggtggaggatactgaatagaacactcagtggttaagagtgctttctactcttgcagagggcttggttcagttcccagcatctatagcagctcacaaccaactgtggctctagaaccaagatatctgtcaccttcttctggcctccttggccacctgcatattcatgatacatgtacatacagacatgcacataaaatagtcccttaaaataataaaaaaataagctgggacgcaatagaggaagacactacctgctaacctctcacttctgtatggcatgggtatacacataaataagtaaaacttgtaaaataagttatcaatgggccagaaagatggtttagcagttacaagagcacccatatctcttattagaggacccaagtttgaaccccagaacccatgttaggtagctcacaacaacttgtaactctagctccagagagatccaacatctctagcgtccatgagtgttttcactctataccacttaaaaataaatctttttttaaaacttaaggtatctgttgtggtttggtctgttattgtatattgtaatgctaaatgtgggctcccaagacctggttgtcccagagataagagacccaagtgatgctatgtgaccttgcccccaagttatttctgatttgtgaatagagatgcctatagcctatagctgggcagaattgagatagacagggcttggtgttcctggccttgtgggtcagagcagaccacaaggagagagagaagaaggtggagagaggagaaagacaccatgagttaggagtcaagaaagcatacccatgagagttggccaattggagttaagaacagcacagatgaaacatagtaaacataataactcagagttatctataggaaaataaattctaacaacatagagggtagacagctgcccaactctagtgcagattaaaacttattgtaaatcataaaagttatgtgtcttttatctgggaactaaatgatcaaaggcaggatagaagccctagattgatattagatatttctacaattggtattagtacccaactaagcagttatatagggaaaagcacaggtatacgaaaaagacaaaggaactggagagatggctcagcagttaaatagcacatactactcttgcagagtgcctgggtatggttcccagcatccatgttaggtgggtcaccaactacctttaaatcaatctccagagggctccaaatgctttcttctttcttctatggatactcatactcacatgtgtgtattaattacttctatcccctacttcataattataatttaaaaataaatattttttggtttttatttttacaaaatgaaatttaaagcttcatctttttattttgagatagtgcctcactgtgttgaagtagaaacttaaggtttctttggaaagtcagttgttttggatgatgttttactggggcaatcacatgaaggaacattttgttgaaatggacgcagaagaaaggatgttttgctaaagcaagcacatgaaaggacatgtgatgaaggattctttgcaaacgacacacatgtattggtccaccttacgttacacagttgagctgcatttgttggaactccatagagagaaccgcaccaaaaccttctgatgatgtgctacagtgtcttgctacttccacagactcagaatgattggcagagtggtgtcagccgagacagatgcatgtgctgaggcaagacatgtgaaggatacgtgatgtgtggagggtataaataggactctacggacagtgatggagcccgagcttggcttgcttacagacagagctacttgtgccacacttgttggtctcacatcttcgctgagaggcacagctgagaacttctcctggcgtccctccaggtccctcctgctgacttatgccaaggctgaggccgggctttctctgctaggtgaatcgtttttgctatcctgcgttgtgtacaagtacatttacctgctgagccacctcagcaatccaaaaatctgttttgagtacttaatgccacatcaatgacttaatatttaatagcctaaaagtttatattaatagcctatgccattgacattttaggtggatttttgttgtttttcctttctttctttgaaacatctcaatgtgttgcacaggctgacctcaaacttgcaatctttctgcctccgtctcttgagttctgatcacaagtgctattggcattttaaactttcttctagttttccttttccttcctgcatacataacattttagggagtgagctcatctaacatgtaatctgccttttttccttaacatacctctgcacagcagtaaaatagatggcgtgaactctttccactaaaataaagagaagctcaactgcatttcttactctaaaaataatagtgtatttgaacttgtggtcctcctgcctccaaaaataaaaataatatgcacttgatagaaaaggtttcataaaatatagaaagaggaaaagtagatattgtccataaatttgccatagattggtagctaacagctgaataagatttttatagtactatttttggtccccacatatcatttcaatgtcattttataacttgtcaagactgtgccatcagtaagtgacatttctattgtttctgccttttcattactctgaaatgatgatgtatcagcaagccagtggaaccacctctacctgtacccaaaccttccgaagtctcaaatgtaatgagttctttagatatacttgagttgcccattaaacttaaagtcctaaacataattcttaacttcctctttaaccttgttccatctgctctttactccattttaggaaataataccaatatctaaccagttaatccagattcaaagagtcagtcttgattctgctctttctttcaccatcttttaatagcacttcatatgagtcaagctgcttctcatcatttccactgccaagatctcagtccaagccacgaatcgcctctcagatggatacagcagttctttggatgacatgtcaaacagcatcctcattgacatccttataaacctaggtctcttggttatactgacacttattttttacataatgaactttttgcatattccatgctgaagcatatgcagtacattaagttactatcattcattcatctgacaatggagtgaaatgtctatagtggcccaagcactgattttaggcaataagatttttatagtactattttatagtactattttattttatggataggatcaccatgctaggtttttgtctttctgagtctggcttattttaggtctcatataagtgacctccttttgtttttccttccctagatttttagaatattctctttatcctctgtgttctgaaatttaaagggactgtgtctttcatttcattgttctagagattgctcagtcagaatagttttgtctattgttgtctttttaaaatcttaacttcttgggccagacagatggatggcttagtagttgagagcacttgttgctcttgtagagggcccaggttctattcccagcacccgcagctgtctgtaactccagttccaggaagatctaatgtcctctgctgtcctccatgagcactgaatacatggggcacaattacttggaggcaggacagtcctgcacataaaataaaaaaaaagagatatatattctgttcttttctttttaattttggaaccttgggttgctcctgtatcaacttttctggaactctctttgtaggcttggctagcctggaattcagagatctgcctacctcttcctccctgggtgctgggatttaaaggtgtgtgccaccaccacctgacttctcaatatttttttaatttccatttattggagtatgtacaatttttctgttgtaaccaacaaataatctacatggtttaagcaccatacaaatatctttgtttctaacaggtattcacttgatgactttagcattcattcataattcttacctgaatccattattttactatgtgctgcaaaattatggtttatctaattctgtcatctcccagttgccatccctctgtaaagaattatccgtaaggaggaactatttctcccccaaaaggtacagatttttactggattgattactaaatttcaaagtagaattagtgattattagtgacaacatatttgttgatacgtttttcatgttgatggactcctgaagttttatttattagaaattttagaattcagccagtctatggtgacacatctttaatcccagcacacaagaggcaaaggcaggtggatctctgagtttgagtccaggccaaaactatacagagaacttgtctcaaaaaaaaaaattaggccggacgtggtggtgcatgcctttaatcccagcactcgggaggcagaggcaggcggatttctgagttcgaggccagcctggtctacagagtgagttccagaacagccagggctatacagagaaaccctgtctcaaaaaaccaaaaaaaaaaaaatagaaattttagaattcagctacagtcattgttttgtcatcaaatcattctgaatttggacattgaagaagctctttatattgatgcctgtgctctcttgtcacactcttattaactagtctttgagcagttctcttgttttctaacaccaaatattgcatcccaacatgtgcttttttggtcccagaattgactgcaagaatcgctggttcattatagtggtaaatggtatttagatccccaagtgtgtatgccagatgtgatttatttttactgggttaacagcacatctagaccctttgggtgagcaaagctgggaaaattatttaatttttttaaaaaaatcatgattgtataacgaaatcaaagaagatatgactgaatgtcacgttgataagaggtggacttgtggttgtcaacttgactacatctgtgattaagcagctgggcataactgtgagagatttttttcaaagacagtttttagctttcagtagtctttaacttatgcccatattttttttcttcactgaaaatgttgatttctaacaatgctaatattcacacttactggctttgttttgtaatatgtataaaataattacaagggacagaagagatggctcagtgatgaagagtacttactgctcttgcagaagacctaattctgttcctagcatccacaaggtggctcacaactatctgtaactccagtttcagtggatccaaatccacccctgccagcttcaagtactcatgtgatagatgcatagacagacatgtaaaacattcatatataaaataaaaatataaaattataaaactaatagcagtattaacaaaagttgatgcatcaggtttttttttttttctgttagaaatcttactaccgatgtaaagtcaggatatatgcataaaaattacctgctatacctgcctggcctgtggtgatacaggcctttaatcccaaaactcgagacacagaggctgaaggatctctgtgaatatgtgattaccctggtctatatagtatgctccaggactacatagtaagaccctgttttaaaacaaatcatgtggagtgtttgcttttgttaatggcagagtaactcgtttgctctacttttcttacaaaaactctgatacaacatacatacatacatacatacatacatacacacacacacacatacacacacacacacacacacacacacacacacacacacacacatatatatatatatatatatatatattagtatgtcttaacagactgtggtcctgctagttcagcaatggctgtctaccaacagaaggtccaagaatccagtagttgttcagtccatgagacttgatgtctccactggtcattagtatatgccagaatctcatagaagtaagttctaataccagtgaaagaatggacttgccagccagaggggggacgagcagtcaaagagagtaagcttccttcttccatgttctttatataagcagccagcagaaggtgtggcccagaataaaggtgtatctttccacctcaaagatatggattaatggtgtctctttccactttaaatgataaaattatgaaaaaaaaaacacagttacgcccagctgcttaatcatagatgtagtcaagttgacaaccaagaagatcgaccacaagtccacctgtccacctcttatcaatgtgacattcagtcatgtctccttaagtcatgcttaatttccaaatgaaaacaataaccaggtcataattctaacataactatcccttctgcaaccccaaatgcattataaatttttgaataggtggcaatgtcccttgagagatactcttttagtatctcaaacttaagtataaccactaatattctcttaattgatgttgcattacatgataaagaaataaaggaaagaaaatgcaaatatacaaagacattttaacaaaatttgacagaaacactaaggtcagttataattctaatttctggaactgtcatgtggccttatatttatagcttccttcctctactacccattctgtagttcctgaacccttgttaagaactcatcaggtctctcttcttggaggtgtgacccataccttcattcttgaagggtctgtaccctttatcatcctgcctgcattaggtgttatactttgccattggctttaaacacggggcactgtagctccaagagatgctctcaaggatctttagcacttgagacaatctttattaactccattgtggagaaacagtccaatccctcttggtaaccagtcactcttcctaacactgttagtcctttcttagctattagtttaagggcatcagaaacccaaaatggccagagggaagtttgaacttctagtttaatgaactatttcttacgtctttaggcaggagcgctcctgactcaggaaccaaaacttctaggtcagcagaacttaatgtcatgggaacaagaagcaaaaaatttttctagtaggccactagggggaatagtgagtggaactattccttttacccaccccttcatttctgtacctgtggatcctgggtatgggagataccataccatatattggttgctgacttccgtgctgctgccacttagttggcgctgtgactgcatcttcaaaagccatgccatctttctatcagaccagctgctttaggatggtgagaaacatggtaagaccagtagattccatgatcatgggcccactgttgcacttctctggctgtgaaatgagttccttgatcagaagcaatactgtatgggataccatgaggatagataaggcattctgtaagtccacggatggtggttttgtcattacgtgtaagaaaggcaaatccatgaccagaataagagtatctactccagtaagaataaaatattgccctttccacggaggaagtggtccaatgtagttagcctgccaccaggttgctggctggtcaccccaaggaatggtgccatacctggggctcagtgttggtcttgctgttggcagatctgacattcagctgtagtgagttttatagtggcatgacttgtatgaacttttggtactgtctaatttacttagtcatggtgtttctagacatgaaatagataagcctattgaatttttgtttgatctatataagtgggaaaaaaaacttcaaacatagcctatatatttgatggtagcaaaagggagtcttgtaccacaacccaatttccagacttgagacggtatgcagacccagaactccctgaaggaagggatggccaagttatcccaaggaagaaccttgatactgactctgatttggggagaccccaagaagcatcatgtccttccagttaaagtaagggcttggggatgtcaaataatttatggagttttggtgaagtctgacatacaataggtctagcaggtccctgaattcatcctgtggttatttccccagcctcaattgggatagatatacttaaaagttggtaaaattctcacgttggttccctgatctgtgcattgagggctattatggttggaaaagctaaatgggagcctttagagttgtctctgccaggggaacaatgagttaaaaattataacacatccctgggggaattgcagaaattagtgccaccaaggacttgaaaagtgcttgaacatggtatacagatattagtagagcaaatgcccttttttgttacctgtccataaagactaccagaagcaatttgctttcagttggctgaccttgccaatatacttttagttttacctcaaaggtatattaactctccagccctgtgtcataacttattttgaagggaccttgatcttctctctcttccacaaaatacacattactttaccatgttggttggacaaagtgagcaggaggtagcaaccaccttggacttgttggtaacacacatgtgcatctgagaatgggaaataaatccaaccaaatccaagggcctttttcatcaataagattattaggagtcaaataatgtgggaatgcagaaatagtcattctaaagaaaagagtaagttattgcatctgtccctgccatcaccatgtaaaagccgatttttggtaggcttatgtggattctagagacagcatactcctcacttgggtgggttgctccagcccatataccaactaactcagaaagctgctagctttgagtgggccctggaatagaaggctcttcaacaggtccaaattgcttgagcaggctactctaccacttggactatatgatctagcagacctgatggtacttgtgtatcactggcacatagagatgaagtctggatccagtctttggcagaagagacctttgggaattcgatgcaaggctctaccatcatctgcagacaaacactctccctttgaaagacagctctgggcatgctattggactgtagtggaaactgaacatttgacaatggactaccaagtttccattcgacctaaattgcccatcatggacccaccaagtcataaagtaggacatgcacaacatcaatctattattagcacctgagtacaccaggacttggtttactgatggttctgcacattatgcaggcagcacccagaagtggacagctgcagctttacagtccctttctgggacaaccctgaaagaccccagtgaagagaaatcttcacggtgggcagaactcggggcagtacacatggccatccattttgtttggaaggagaaatgtccagatatgtgattgttagtggattcatggattgagctgatggactgactcaatagtcaggaacttggaaagaacatgattggaaaattggtgagaaagccatgtgagaaagatgtggatagatctctccaaatggaagcatgtgaagatattgtatcccatgtaaatgctcatcaaaaggtgacttcagcagaagaggagctcaataatcaagcaagtagatagtatgccctgttctgtgggcagtcagtctctttccacagccatccctgtccttactcaatggacacatgagcaaagtggctatggtgggagagatgggggttatgcttaggctcaacaacatggacttccattcaccaaggctgaccttggtgtctatgctgccagttatgataactatgatcactttacctttggcaattcagtgctcccatctggtccctacaactttggggcccaattaaacccaccacatttaattaatccaaatgagcaacaatgtctctaacctgaagatctggcataaggaaatgggcaacaacaaagctcttcagatgtgttgtacccctctctccattttttgtcttataggatcagtgaagtgtatatcttctgggccttcccattatgaaggattaggttttacatagcatacccactctagcattgcaaattccctgaaccttaaaatcccgtcatcaatgctaagccaagggatatcaggcatctcccaactcctttttcagtaggccatcttttgacaaatctaactgtgcagtcttccatatctaacctagaatcttcacttgatggtccccaaatcagtaaatgctgcctgacctattaacccacacccctagaatccattcctacacatatttcccagaattctgcttggatgaattagcaaacacattaagttctttagtagtgtagtacacctcctcatggagtacactttctgtctcccctttaggagcctacttaccccttagtttacttataggtctagaggcaactattggtgggccctgaaggacatagtattatcagtattttcttcagagaaaaatcactgctggtttagcagtcagtgaaggatcaattttcacagtcaaaggcagaaaatgcaataattcaggttttggggttgggagtacatcttctgctgagggtggagaaactacttaaactacttactcggatgagattaactcttttttttttttttttttttttttgaggtaaactcttgagagttagtggcaaagtagcccattttgctctacttttttttaaacaaatactcaaaactcatattcatatatatatatgcatatacatacacacacacacacacacacacatgtatatgtatgtgtgtataaaatttattagaatgtcttacagactggtcttgctggtccaacaatggctgtttaccaacagaagttccaagaatccagtagttgttaaatccatgacacttgatgtttctccactggttattagtttatgcagaattccatagaagtaagtttaatgccagtgaaggaatggacttgccagccacagagagaaagcaaacagtaaagagagttaagtttccttctttcctgttctttatataggcagctaacagaaagtggggccagactaaaggtggatcttccctaaacctcaaaaaatacagattacaagtagtgttgacatttagtctaggctctgttccagttacctggcaacagccaggtgtgcctgactcactataaaagaggctgcttgccccctcctctctctcttgctctctcctcttgcttctgctccccctatcttcccattcctctcctccctctccacgtgctcatggccagcctctactaccccctgcctttctctcaattcccctccccagtgcctgaataaactattctatcttattccaggtccttcaagagaaggaatgcctcagcgtgggcccacagaggcaaggtcttaccccacaccatacctcgcctctaccaaacatattccttcctctttattttttttataaaacataacaagtaggtcttcctacttcaaataacttatttaaaaaatccttcacatatgtacagagggtcttgggttttgattatttctagatatagtcaagttgacaaccaagaatggccatcacactaggtacagtgatacataggtatcatcatggtacacaggagatagaggcaaaaggatctgaagtttaggcttgtccttagctaccctaataaattcaagggcagcctgagatacatgaggttctatctcaaaaaaaaaagtcacagaaatttaaaataactacttagggcactggagaataatcagaaacacacagaagctgatgccaagtggatcatttgaagaaggaaacttcattggaatgaattttctctttatattgactacttacatgataactgtccagtcagtattcactcatcagacaagctttcttggatagaagcacagagtcttggattgagaaatcagaattcagagtagctaccattcttaggatctgagggtaggaatcagccagaagcaagaggctccaattcttccttcacatagactccaccaaactttaggtaaggcagaaaaactgaagagtctcagctctttgttgcctaccaaggtaagacagtttgaagtatgagttgaaccacgataactactaaaatttaaaaactagaatgcttgggctggagagatagtttagtatttaaagtgctttgagttctcctatacccatgtaaaggccaggtgggtatggctgctggttatctcagactgggaagacagaatagccagattagctatatccatgggttctggatttttatcaagagaccttgcctcaatgaataaggtaggagagcaatggaggacggttcccagcatcaaccttagaccgttacacaattgcatacacacactcaaacccatgcagacaccaatacacacatgtacatcatacacagatgtgacaagaaaatagaaatcagacttctttattagaatataacacatttctgtagaataggaaagtgcatctatgtttaggcaagaaaaaaaggggaaatgtaactgttactcaagcaggagtcaacatttttcccataaacagttatttttagctcatttgatttgttgcagcttacacaactcactattgtagatgcaaaagcatggatatagctgtagcaaaaaaaataattttacaaaaaaagtcactgggtccaattaagcctgtaggccatattctgctcacctttgttcaaaagaaaatatagtcattgagacccaccccaagacagccgagatactggaatcagcagagaaagatttcagagtagctattatcaagacataaaagaaaaagtaaaccatgtctgcaatgatggaacaaatcagtagttctagatccattcatattaccagtcacattaagcataaatagactgaacatttctggcaagaagcagattatagagtacattaaaaagcaagacccaaggccagacaaggtgatgcatgtagttttaataccagcactcaggaggcagagtcaagtggctctctgaattcaaggccaacctagtctacgtattgggttccagggcagtcaggtatacatagtgagaccttatcttaaaggaagaaaaaaataaggtataggtagttacaagccacccaatatggatattgggaactgaactgaatccttcggaagagctggacaaactcttaactgctgagtcatctctccagcctcaagataattttaatatgacaaaatgagatttaaagtgtaatgctatccacaagtaaaggaatgttggggtgacaataataatatgaaaaaagtagacttagttaacatagataacaagacatattttaagagctgggaatatggtaggacacttccttagcatgtgctaagccctggttcaataccagtactgaaaaaaaaggatgtgttttaaaatgataagggtcaatttattatgaagacattaacatttatgaatgtatatatgttcaagtacagagctacaaaaatggaagaaaattatgaagattaaagaaagtatataaacccacaataattctgcttgggaattttaattcccatcttggtaattggtagaactgcgagaaaaattcagtgagcatataaaaggtcttaacattaccagtcacccttaatctaattacagtttacagagtaataaattcattgactacagagtacccattattaccaaagggtaataaaggtaaagaccttattctttactggactgtaaaacaagtcttattaatttgaattttgattgtattctctaatcagagtgaaattaaattgcgaattgtaactataagacatagaaaaagcctcagatatttgaaaattaacacattcctaagttactcatgagtcaggaaaaaacacaaaaattagaaaagataatgtaagatttgtgggatatgcacaaaatatcacttagaaggaaaattaacagctttaagtaaaattttaaaacaataaaacatggccaggtggcagtatcacacaccttcttctaccacacccacctggcattttatgtgagcttcggggaatctgaactcttatcctcattgcttacctgcatggcaaatgtggcaaacagttaaggaaaacgtaatggatacttcatgaaaggaatatatttgaatcataacataggaattagtgaaatgtagattataagcacactgaaatgcctctgtacctccactggaatgatcaaaattaaaaactgataataagggctgggcttttttgcttagtggtagagtgctggcctgacatgtgtgatactataggtttgattcccaaacaaaaatccctgacaacagctgggcagtgatggcgcacgcctttactcccagcacttgggaggcagaggcaggtggatttctgatttcgaggccagcctggtctacagagtgagttccaggacagccaggactacacagagaaaccctgtctcgaaaaaccaaaaaaaaaaaaaaaaaatccctgacaacaccaaatgttgctgataatattgagtaggggtggcaagaaagatgccagggaacttcccattgttgtgtttgtcttatgtcttggtaggagtgtctgttacacagctgcatacacttagcaaaagtcattagatggtacacttgatttttatacacctcagtgagtttaagttttaacttaaaatgaaaataaaaatttcagcattaaataatgacatgaatgctaaagtgtttgtggattgtcttagggtttctgttgctaaaatgaaaccccacgaccaaaaagaaacttggggaagaaggtgtttatttagttcatatccacacatctatcatcaaaggaagctaggacagaaactgagacagggcaagaacctggaggcaggagctgattcagaggccttgagtgggtgctgtttattggcttgctcctcctggcttgctcagcctgctgcttccttatagaacccagaaccaccagcccaggaatgaatgacacaacctacaatgggctggtccttccccatcaatcactaattaagaaaatgcccttctctggatcttagggaggtttttttggtttttggttttgttttttgtttgtttgttttttattttttgagacagggtttctctgtgtagccctggctgtcctggaactcactctgtagaccaggctggcctcaaactcagaaatccgccttcctctgcctcccaagtgctgggattaaaggcgtgggccaccacgcccagctgggaggtattttcttaatgagttccctcctctcagatgactctagcttgaatcaagctgacattaaaactagccaggacaggaatgaagtgatttttgtgatgcattaaaaatgtataagaaggctgaagagatggctcagcagttaagagcactggctgctcttccaaaggtcctgagttcaaattccagcaaccacatggtggctcacaaccacccgtaatgagatctgacgccctcttttggtgtgtctgaagacagctacaatgtacttagatataataataaaataaaatcttttttttaaaaaatgtataagactctaagttcaacctccaaaattaaaggaagataatctgattgattgattgattgattgatgggtgaacactgtgctcagttttttttccagtttattttcacttattcttcccacaccccatcagcatagtgatcttttcttcgggctttaagaagctatattttcattcttcccattgccaactcccttgtataggtgaggcagcactttttcagcctggcagttcctgtgaatggacttttgggtcattatagacttctcttctgggaaatgatggcatactggaaaacactgtacagcacatgtgttgtacctaacctatttttaatttctgaacacttttatcatgtttcctcgttgtatatgattctcttgtgggatttctctaaaatattttctgctttctctagggacagaattggagtctatatgatactgattctctgagcctccaatcctgccctgaagagcctctggggttggagtatggagtctacatggtctctctacaaagggagtctggaggcaggagttctgtggagggcagggcaggttgacagactccagtttaggaggaagcagtctagttaaccctcagaggccagaaaagatgagcttcacatagaggaagtttgctaagtatacctttcttgatagtttgtaggtctcttacggtctttgttggagatttcttccttttgggatgtctgcacttaaatttcttagggtgacgggccaggttgcaaatacacttaaacagttagcctctagcagaaagggcatggctctccactgagacaaatcatattagtcattattttcttgctgtgaagagataccatgactcttacacagaaaagcatctaattgggagcttgcttgcagtttcagaatcttagtccattattatggtggcaggaagcatggctgcaggcatgtgtagtgctgaaaaagtagttaaaagctacatcctgatctatgggccaagtgagactaggaggccttgcctgggctttttaaacctaaaagcctacctacccccagctacaaactccctccaataaggccatatcttccaacaattacacctcataatccctctcaagtagtatcacttcctggtgactaagcattcaaatatatgagcccatgaaagctattcttatataaagcaacacacaagagagttactcctttgtggggggaggatgagaacctatttcacaagttccttaggaatgctgggttttagctaatcaccagaaatctgtctataatccattctgagctcatttctaggcatagactacctaagacctaacatatgtatgtgtaccatgtctgagaatagtgcctgtggagatccaaaaaagaaggcataggatcccctgaagctggagttaatagatacttataatctaccatatgggtgctggaaattgagtctgggtcttttttttccattttgtattaggtatttagctcatttacatttccaatgctataccaaaagtcccccatacccacccacccccaatcccctacccacccgagtctgggtcttctgcaagagcaacaagtactgttaccctaagctttccttctgtccctgtcaaaggcttttaaaatctgcatttgctctgtattaaccacatctttatattctttctcaagcattcatagtgactagtgctagttcaagtatcagaaaatttagcccagttcatgttatttttttcttttcacttcattttattttgtatatgcatacatgcatgtgtatcacactaagtgttttacctgctgagccattgcactcgctttcaaatcttgtatctgcaaaagcagagatcctcttttgtgtttcaagtttactgcctgtaatgtccaattccaatatgctcattaccttggggatacttataattcatatttgcttgcatctttaatctgaccatacctcccactcatctccccagtttcaatgccatggtcatttgtttgtacttggtcaataaagcaccagctttggcgaagttcagttatctcccttgtctgctctacacacaatgaatatgattactctttaatacactccagatgaacctcatgttcacctttctttgacaggtatactccagttccccgtgtctctatttgttccatctcctttggccatgtctgtctatacagcactatgacaaatatatgaggaaaacttaaaggaggattgtattttggctcactttccaaagtctcccttcatagtcagttggctccattgtttctggacctgtggtgatagaagattgttagagaagctcttcttcacagtggccaggaggcaggggaaagctccgagtagaggacaaaatacatctctccaagacatgccctcagtgacctaattcttctagctagatcatacctaataacatttcttctgcctcccagtaatgttgtcaagttatgaatccatcagagctctcatagttcagtcacctctcaggaattggatccatcagctcagggtcaaggctttggccaaagagtgaagaagtaaagttggggaaaagggatacttcctatcatttataacaggctgtcatacccactcttgtctggtaactgctgtgttagtttccagagagcagggaaacagtccaaagagaatgcccacagactagcattgcaccctcatgctctcaaacattctcccttatgatgtgagagacccagctctgcactcttgcttctgtttcaagatgtgtctctagagctctctgatatcaggccctcctcccagttccctagaaatctgttcctacttcttccacctcagtggcactgtttctggctcctgctcccttctagcttcaccacttcccttttcctttccagtgacactatgtctctctccatactttcctaagctctttgctgccaaagctagggcatgctacacagtaagggttcatcaataatgaccttcatattgttcaatacagttccagttttgctgatccttttctaggacatttcagcaccatttgatctaatgtctatagaagtcagtgcctttctgagtatctgcatgaatctctaccttctcatggagcctaccatgactgggcttcttttcctccaaccatagcttttgtcattttttaacactatgtagctgacagtgcttacttggactatcagcccattgtagcatatgctactttaaggcagagctgtccacttgattcatgatatgtcccaagcatttagctagaacaatggctggtgtctaatgtagtcattcatctgctgcatcagggtcaggaaagtaacaagggcttcctggatccaccctgacacatccctgtttgataaagaaaagaatctgttttaggtccttgacacacacacacacacacacacacacacacacacacacacacacacacacacacacaccccgcgctgtcttctgttcctggtatcacacatatagcttgtggggtttttttctttttttttttttggtttttcgagacagggtttctctgtctagctctggctgtcctggaactcactttgtagaccaggctggcctcgaactcagaaatcctcctgcctctgcctcccgagtgctgggattaaaggtgtgcgccgccacacccggctttttttttttaattatttgtttatttatttattatatgtaagtacactgtggctgtcttcagacactccagaagatggcatcagatttcgttatgggtggttgtgagccaccatgtggttgctgggatttgaactcaggaccgttggaagagcaggtcggggctcttaactactgagccatctcaccagccccggggtttttttcaagtctattcaaggatcacttctactatgaccctctctggccacgttcttctaggtcaaagtcttctttctccaccccttcactgccaatcctgatatttgtcgacatctgctacaagctgaatatttttgtttgtactctcctccccatactacagtctaagccccatgaagacagaggattggagtatacagatactgctacatatctctagtacctagactcagacataactacttagcagatgaatagttctgcattgggactttgccctaaggtttttgtcttaaaataagctggacagaataaaacagcctgcactgctattagttcatcaacttttgggtggccaactattcatgagctaatcaaacctgtcagaggtgcacagaaaagggaaaatatgtgagtttggggttattttggggggagttgtagtcacccaaagcaaaataaatcaatgagaatctaagtagcatccacacattcttcctccttttaaatataagtgtatgatttaacagcacagtttctcagttcagctttgcaaaacaagagacatgaattttaaaggctatcaggtgcctgtgcaatctgtaacttcatatttgtttaacaacatttgtgttttgccaacagatgtaccatttaaagtacccatgagaatagcctctgtggttttctgtttcactagagggaactttaggaaatgatgaatgcacagagactggcactacccccagctccaatactagggaatttgccactctgcctgggttctggctaacccctgtaggcatttcttactgccccttcctggcacattgttctgccttccttcatgtttaatgtgttccttgagcacaaaagtgcacaggtgtcttcccttcgcttcccctatataggagggcccgtgtgttgaggtacccaacaactagtcaatgaaaagaaagtatttgatagagactcccaggatgtctaagggaaaaaggaaaggcagaaattctgtctcattccttaaaatctggccattgcatctaagtaagtaagtatgttacctgtgcttggtttccaggctcaatcacaaggcttcagctgctttccttcatttgtaggtgactgctgtagcttggaagtgtgttttctgtggctaaatgaacttgctgagtctcagcaatttaaacacgtttagttttgttctgataaaattgaaaaggaagagtttggtattaataggtttaaactttttatagttttttagtaaagcacattttcttcgaataatgatgctgtaaggttacttcctaggagacataatgtttatacagtacaatctgaattatctttgttttgtttcttggattcactaagaaccaattcaaaagctgatttgggttttttttttttgataatatataggaagaaaaatctttaactttatcagttttttatttgttttgctttaatctatgtatatgtgtctatgtgaatatatcccacatgattgtgggtgctcacagatatcataagagagcatcagatcccttggagctggagttacagatggttatgagccatccaacatgggtgctgggaaccaaactcaggtagttcagttctataagagcagaaaatacttttaactactgagccaatcccacttgtcattttttttccagtgggttgaattatagtaattgtgatatcttagtggaaaagcaatatttcaaataaatctcacatacggtctatcattcccatcttttgttttgtttctgttcatcttgatatctcatttgtattgtaggaatgagcagacatacatgtaggcaaaacagccatacacgtaaatttttaaagaattcccttgctagacatagtagtacatgtctgtaactccagctctctaaaagctgtggcaagtggatctttgtgaattcaaagccagactggtccacatagttctaggtgagataagctgtgtagtgagaccttgtctcaaaaaatgaggggaattggctaatagaaattatgtcttattttttgttcctgtggtaaaacaccaggaacaaggcaacttataaagaaagcatttaatttggaacttatggttttaggaaggtagagtcctttctgcctctaatatgtagaacaagatgttagctttcagatgtccttgccactgtgccctgctccaccatcatgaactctaatcttctgaaactataagccaactaaacactattttattaattgcattgttcatggtgttttgtcacagcattataaaagcaactaagacagatggttcagtcattaaagcacttgctgttcttcagaggacctgagtttgattctaaacaccctgctgggtagcttacaacttcctataactcaagctagagaaaggggcaaatgatacctctggcctccatgggtacttctactcaattacacattccccacacagatacacacataattgccaggcctggtggttggcatgcctttaatcccagcaagtgggaggcagaggcaaatggatctttgtgaattagaggcagcctggtctacatagcagagctatgtagagaccctgtctccaaaaaaaagaaaagaaagaaagaggtacatgtaattaaatttttaagatatttctccattgtctacttagcctaaaaacagaatttggagttgatattgcacttatctttcatgtaccatgatatctagagataggtttcctaggccactagtagtttacaaagtaaagcccctcagtaggtgtattacctcaccaggatagtgttctagctattacacccatctttctagactagagaaagggttgggttttttgttgtttttttttttttggtgtggtgttgcatgtatatgcaaggatatctttaaacatttaagaacctaagacattttagaagaaattaccattctaatgaattaactcattaactatcatatttttagaaattgtaatcaaaaaatcttagtctaaacattgcgtagcacagtgcaataaatttcatagcagtagaaaccccaattatgacaagtttataagggctcctttctgcctatatcattaccaacatgtagtagctcaatagcatcatggtgaaagaacctaatatagtgataccagtccttgcaattggttgataactacttgtgaccttacataaaacagtcatgggccttgctgtcatcctcagcctcttgtcagtccctaaacaggcttgggtttcagcagacatcccattaggtagtcatagagaacactgaaagaaattaccaaggacttgtttgactctatggtagaaagaggctaacatgaagtatgcattttgtcagattttaccaatatttttattagcatatattaattttacaaaataatgagttttctttatgatattttcacataggtgtatgttgtatgcctgttatctctctcccccactaccttctggtttttttttcccctcctccttgtgcccttccttggcccaaaaatagtacctgataaagctttggtttggggttgtttttgttttgtactcttctgcctcttctcaactcactgcctgccctacgacccaccaggcttcttcagaacaaactgggtaaataagaccacacaaccagatgacatgtgctctgctttcagtccgccaggctggacactcttctgcctatccctacagtaccaatatttagggagctgccaagctgtgccatactgtccttctctttttcccatctttcccttgagcccttctaccactgtcctgaaccaaacaccctcttgagggttcctgtgaccttgtaagctttcctatagatacctggctttcacacaatctctgtagtcagattgatctctcccctgctttaaacccaaggcccctctagtgtgaatcttgcttttctttctagactcttccctattcaggttagagtcccttttctctgtacacccacacctcatgccaaatttgcccctcttccaacagcagctggttgattgtttcctatcctgtgtactttagaaacagaacatttttacacccatagcttctatctctttgtctcagcccctctcatcctgaaggtgactatattgaacatgttgacaaccttcctagtgtcagactttccatctccttgaccacctccattccagtgacctcaggcacacatcctcatactcaaggactggactttgtcataactaaaacctgttccacccatagagcctaatgcagacctcatgatgacaaggatttcctgtctgtccggcttgtggtgtctactgctcttccatgtccctgggacttcatttgtattctctcctctcatgaatcacacttatcaccataaaaatgtgttttagaatttcctgcttagctatgcaaaccttctttagcctctgtctaatctctactctgtccccttttaatcaaactctcccagcattctctgttcatggacccttccctcacctcctataattgggtccctcacctcctgtaatcaactttataaagacatataaacactcctgtgttccatgaattggccttatcagtctccagtggaccttcacattgttatggccagtaacaagtcgtctttttttgacattatgttcagttctttagaaaactgttatcttgtacctcttctgtgactccacagtctccaggtaacattttgtgtttggagaacttctcgctctaccttaggagtttgagtggaggccaaataacttctataatcactgaaaataccagttgcttgtttacgtagcttctcttcaattaacatagcagctggtgaaccacatccctagagttagctctggctcactgcctgatttgatttggtttatttgtgacagtcttgctacatagcccagattggcctctaacctctgatcttgctgcctcaatctccagagtgctggaattatagttatgtgtcaccatacctggcctgccactgcttgttttttgcatataaaattctactagaactcagctcatccatttctttatgcattgtttttgtctatgtctctgctacagctcataagttgaatgattataataaagactgtgtagctatcaaaatggaaaaaaaaaaaagaactcctgtgcaaggatgtggatcaggctctgccatcgttccctcacctgataagaggagtgggcaggctgccagaaagatgagctccaaagccaaagttctgcccagtgtttcctgcaagcagagttgcagaggcaaggacagctgccccagatcagattggcaaaaggacttagagtgtgtctacttactgagtgattttagggttagggttaaagagactcttgtctttaaaataccaagaagagggttggggagatggcttagcagttaagagagcttgctgctcttgcagaggacaagacttcaatttatagcactcacattaggcagattttgtctcctgtaaccccagctccagagaatccagttccagccacacatgcacaaacccaaacatgggcatatgtataaatacatttgttattatttattatctttaatctttttttttacagtccagtttttatccccctcccgatcctccttcctacagttcctcatcccattcctcctcccccgtctccaagaggatgtccctaccccatcaggcctccccactccctggggcctcaagtcttgagggttaggtgcatcttctctcactgaggccagaccaggagtcctctgctgtatatgtgttggggtcctcatatcagctgctgtatgctgcctggtcagtggctcagtgtcttgagagatctctggagtccaggttagttgagactgctggtcttcctatggggctaccctcctcctgaacttcttccagcctctcccttacaggagaccctgacttcagttcattggttgggtgtaagaatctgcatctgagctgggtgtggtggctcatgcctttaatcccagcactcaggaggcagaggcaggcggatttctgagttcgaggccagcctggtctacagagtgagttccaggacagccagggctacacagagagaccctatctcgaaaaaaaaatatctgcatctgtctcagtctgatgctttttgggcctcttagagggcagccatgctaggctcctgtctgtaagcacaccatagtatcagtaatagtgtcaggccttggagcttcccctagagatggatccaaatttgggcgggtcactggacctccttttcctcagtctctgaactacaagaagaggaggagaaacctgttagaacacagaatcaaaggcccaaaggaaagtgaggaaacagaagttgcttataatataggcttctcaaaagctagaagagaatatcaggtgccctgctctgtcactttcttctgcctttctcccttgaaacatggtttatcaatgagcttcctgaatctgaatctcaaaagaaggaatgaatgagtgagtgaatgaatgaatgaatgaatgaatggaaaatgtttgtataaacagtgattctgacattttccctcttatctcatttatgaggtcagtctgtgggaaagacaccctacctgaatcttttgcctttaccaagtttgtaatcttggcctgatttcccagtgagtcctagagtagccattttacccctgttctggagcctttctggctacttgatgagtcttccctagctcctggcatctatcttttatgtttaccaaagcttttattttggaataccaaccatatcagaaaaagcagcaacagatgctttatgcaggtagagtcttattgatggcccaagtgtaagcatgaacaagatacattgatgtttaagggacattggataatgcatgagtgagtgagatgaagcaacacataatgttcctaaaagtcttacactactggcatgtactaccataccctggttctaggatcacttctatttaaacccaccactagctactgagcattcaagaagcatttctgccaccccactttacttctatctagttccagaacatttgaagtacctctaaaggaaaagcagtctggcagcttctcagaaggttaaacataagagtaaccatgtactgtagtaatcactcctaggtttataggtagaagagaactaaaatgtatgttcacataaaacttgtatgtgaatatttcatagaaacactattcctaatagccagtgtaatggataatcagggaattttttaaattgtatatagatggtttgtttatgtttgtgtaggtgtgcaggtctgtgtagccctgagtacatgtgtagaagctagaagagaatatcaggtgtcctgctctgtcactttcttctgcctttctcagttgaaacatggtttatcaatgagcttcctgaatctgtatacctccactcccatcaccaacatgcaaaggcaagcagatgtctatgagttcaaggacagcctgggctacagaattccaagacagccaagactatataaaggaaccctgtcttttaaaaaaatcaaacaaacaggaataaaattctaatccatgatactctaaagacattatgctttatgaaagaaaagagccatgagtcacaaagggccacaaaatttatgatgccactgtgaataatgaaatacataataggccaattcagtaacagaaaaagataagtagttgtcaaggactgaagggaattagaaagttagcaactacctatgaatacagggtttcctttgagagttaccaaaatatgcaggagctagatagtagtaatgattgctagatgcaactaatggtaagctttatgcttgtgtttattttaccacagtttttgtcataatgaactaccctcaggatatttagctaataatctataacctgaccaaaacccctagttgtgaagcttcttgaactaaattcctttctgggggccctgcaatggtagtagatacctattgtatcagcacttgggaggcagaagcaggaggatcataaattgcggttaacctgtctttaaagcatagcaagaatctgttttttttttttaaaaaaaaatgtgactgggaatatggctcaattagtagagtatttttcctggcatgtataaagtcctgattttaatcttcagcaccatataaataggacacggtggcatacacctgtatcccagcactcaggagatgaagtcaagaagatcaaaaattcaagatcatcatgttatggatatatattcacacgtgcaaacatacataaaaaatatagtttagtctgagtctagtggcacaggatggtaatcccagctactctgaaggctgagacaaaagaattacacatcaaggcctgtctgggctacagaaacctgcgttgaaaactttttgtaagaccctatctcaacataaaaattttttaaaagagctaagaatttagctactggtggagcacttgcccatcacaaataaagcctgagttcaatccccaacactgcaaaaaataaatgaatatagtatacaattcaatggcatcaagtatgtttgcagtgttgtggaaccatcatatatagcaattcccaaacattttcatctcccaccactctgggggggggggcagactctcatatccatttgtaatcattccttattacccacagccctggcaaatgactttctgttactatggatttgcttgttccaagacagggtttctctgtgtagccctggctgtcctggaactcactctgtagatgtcccaagtgctgggattaaaggtgtgctccactactgcccggccagaatgttttcttgagactcgtccatgttatactgtatcagaattcctttctgttttaacgttaaacaacatttcgttgtcgtgagaggtttttctccattcatccatcagtagacacttggattgctcccaccttttgattcttaggggtcagggagctgcaaacattagcatataagtatctgattgcaggcctattgtcagttttttggaatctgtacttcaaaatggaattgctaggccataggaactttatatgtaacattttggcctcagagttgtcaagactttttcactacagaactttttgtgttgttttgttacagttttgttgatttgaggcagcccagtctcaaacccactgtgtagtcaaggattgccttgaacttctagtcattctgtctctgcctcccaagtgctaggattacatacaggtgcatgtcatcactcataggagtgggattttattgttgttgtttcttaactgacatggtggatgtgacaagctggatgtgatgccacacccttgaaacccccagcactggggaggtgaagaaaggatgatccctgggactcagtgaccagccagagtagcctaactgatgagttccaggccagtaagagaccccagaggaggtaggtggcatccttgaagatgacactcaaaattgtcttctggctttcacattcatgtgctaatgcacacacacatacaccccaacacatacaagcattttaaaaaatggctgcaaagctggacatggtatatacctgtaatcccagcacttggggggcgagtgggactcaagagttccaggctaacctggactttgtgagaccctatcttgcacattgcaactatcccttctcaccataaccagcctgctcgctttctcatgtagcttcaaaagatcctggatgtcatttgctcctgggcaggcaagttcttggagcccagactaggctacctttggcagtgctttttttcttaaacatgaaaactgtagctttatatttgttttatccccatgttggagcttcaccaaatacagtgtagtgttgtggttaggcattatggcagtttgagctactaaaagaaagtgcttcatcaaggtttccaggtgtttctttttgttatgcttaaaaaaaaaaaaatcaatctgtgcagacctttaatcccagcacttggaagacaaaggtgaatctgtgtgagttcaaagccagcctggtctacgtatttcattccaggacagcaagagctacataatgagaccctgtttgggaaaacaaaactaacaagaaaaatgactaactgggtatggatatgtagtgctagctagcctagaattcatcatgtatgtaatatgcagcctgatctagtattgttttcttgtaacacaaagttactctttcttaaaagcttgcttattacttcttgaaaatactactcttagagctaaggatatgactcagtggtagagcactgcctagcataaccataaaaaaaacttccatcgggtggtgtacactttaatcccagcacttggaagacataggcaaggggatttctgtgtgttagtagccagcctgatctacatagtgagttccagaaccaccaggactgcataataaagagactctgtttcaaaagattttaattgccataaactagtagggtttctgatgatattgatgtcatttcctcttttaaaacatgttataacattgacactatacatatcccttccacccctgaatccccttgagagttggaagtcatcttgatgttcaggtataaatatttgaagctgactttcctaatagcacacagcataactacaacagtccggaagtttagtaataagctaatgtaaagcattattcacatttccccaaatgtctcattaatgctctgtgtgtctttaaaactagaatccagtccaggattgtgtgttaggttcgaatgttctttctcctcagtcttcttattctttagtctgtatagtccttccttccttgtcttctctacgatatttatttggttcagcatttttaggtgggcactgcggtctgcccacaattaacttagttctgccttgttgattactctgctatacagatctcaaattcattactgcctacatacttggccatgcctaggctattgctaaaagtttttcttgactccccctcccccacccactgtttttgtactcccatccctagctttactggcactagaggatgccccagaatcagagtcaccaattttatctttgagctggtttagtgtatatactgcccctagaatattactgttgactttggaatatatcccaccacagaagtactatgatcaaaagttagtcttttttgtatagtaacagttaagctcctttgttcctgtttgcatgcattatattatagttttgttactttttagttgtgtaagtatttatgtgattcattagtcaaaaatatattccgagaagtgttcaacaagagctcttacctagttttcacctactctagactttgttaattttctaggctagcctacaatcctgtacacctgatccatatgggaaatgtgtctgcagtttgttttgctttgatttgatttgttttgttttgttttgttttgtttgttacatcaaaaaagatcatgatactcatctagctgcacaaccttccaatatgtaggcatcccgtagttgattctccaagtctccttggtcatgaggacctgagaggcctgcattcttaactactgaaaataaaactgtaatgaaaattattttatgccttggttgttagattttctagaaggtgttcctttgctcatatagtttatatttgatggtggttaaaatatttaagaatacaagtgagaattccaaagccagcctgccttgttactctagtagttttctcaaactcaagttcagaatcaggggagcagccctggtgttcaaaaggggcctgtgaagttatatgcacatgatgggtacctgttggcctttgttttgccagctttgctggtgagtatccccttcttttcttctgtcactgagagcttctgaataagccagtctgaagattgaactgtgaacagaccacaggcttccagatgcacatcatagccctaacctaattcttctcttagttttagaccaataggcagctgctacttctttccaaaccttccttagtctggcctgtagctcagaggggcagtgcagtgtgaccagattctagtcagagaaaggctcactgtgtcgcactacagtggtaattaaaagcatccaagacaggctttgaaccctaaagtacatgaaggaaccccaaaaaagaaccaaaacccatagaaggaggctatttctgtctacaagaaagaataggcaggtgtccttggatatggtagttgctaatggcctatacactgttctattacacctttctgctaaggatagggtttttggttttggttttggttttgttccccaccctccagtttggtttagttttggttttggcatttagggttttttgggggggagtaatatcttgtggtaaagacccatgtgacccaagataccttttttctcatactggaaccctaggcagcagttgctatttccctgagttagcaatagttttacagtattttgaggccttttgtccataattctcacggaatgcctcagggatgagattagctgctgttgggatgaggaaattgggttacaccgctgaaatctcttgctggggcccttgttttgaattggaaagtcaggaggctggaacgaaggctcacaagttaacagtgccagctgctcttccagaagccctggattcagtcccaccaatccatggcgggtcacaaccatctgtaacttcagtcccaaggggtccgatgccctcttctggctttgccctattattttatttatcttatgtgtttttgtcttgtcatgtggcaagcccagggggccattgggtgcaacttataaactgacttctgtatgttaagaagccaaccatacagtgcttacattccagaaaaaaaatgtgccactttaacagcactagaactagggtttagagaagtatgataaaggtcaaatatgtttgaccaatatcaccagcaacctaaagctgttaagaaatctttgggccccagcttgacccaaggatacagtatcctagggaagttaccaaaatcagagatagtatgcagcagccaggggtctcatgtgtggcactcaagctcacctatactcactactgtgcagacagctgtgttctctgtaatacttacatatttgtttaatacttcagggaggaaaagtcagaagaccaggatctccagggcctcagagacaagccactgaagtttaagaaggcgaagaaagacaagaaggaggacaaagaaggcaagcatgagccactacaaccttcagcccaccattctgcagagccagcagaggcaggcaaagcagaaacatcagaaagctcaggctctgccccagcagtgccagaagcctcggcttcccccaaacagcggcgctccattatccgtgaccggggacctatgtatgatgaccccaccttgcctgaaggttggacacgaaagcttaaacaaaggaagtctggccgatctgctggaaagtatgatgtatatttgatcaagtaagtaagagcaagtcttgtgtctatagaacaagaaggccaggtgggtaggaaggctaggatggaaaagctttattgcactgaaatggcttcccaaaaaggctggacaccatgccttggttaaaatggaggaatgttttggtggtggattaggtctgggtaccaaccaaagatattcagtctagcccaatgacccccaagtactagacctcactccttcagtttaaggattgtggaaaagccagggagtacagaggagtgggcttgaaggccggcaggtcctctgttttcagatccagctgttttggcttctgagcaagctgtaacatggtttctacccatgcatctggcccggttgtgttccagtttgttccttgttcacttacaatgtcttagaagaaagcttgtcagcatattttctatctcagtctctatgttgtcaaaaagcttctgactattgtttgtgtctctctgtttgtttctacagtccccagggaaaagcttttcgctctaaagtagaattgattgcatactttgaaaaggtgggagacacctccttggaccctaatgattttgacttcacggtaactgggagagggagcccctccaggagagagcagaaaccacctaagaagcccaaatctcccaaagctccaggaactggcaggggtcggggacgccccaaagggagcggcactgggagaccaaaggcagcagcatcagaaggtgttcaggtgaaaagggtcctggagaagagccctgggaaacttgttgtcaagatgcctttccaagcatcgcctgggggtaagggtgagggaggtggggctaccacatctgcccaggtcatggtgatcaaacgccctggcagaaagcgaaaagctgaagctgacccccaggccattcctaagaaacggggtagaaagcctgggagtgtggtggcagctgctgcagctgaggccaaaaagaaagccgtgaaggagtcttccatacggtctgtgcatgagactgtgctccccatcaagaagcgcaagacccgggagacggtcagcatcgaggtcaaggaagtggtgaagcccctgctggtgtccacccttggtgagaaaagcgggaagggactgaagacctgcaagagccctgggcgtaaaagcaaggagagcagccccaaggggcgcagcagcagtgcctcctccccacctaagaaggagcaccatcatcaccaccatcactcagagtccacaaaggcccccatgccactgctcccatccccacccccacctgagcctgagagctctgaggaccccatcagcccccctgagcctcaggacttgagcagcagcatctgcaaagaagagaagatgccccgaggaggctcactggaaagcgatggctgccccaaggagccagctaagactcagcctatggtcgccaccactaccacagttgcagaaaagtacaaacaccgaggggagggagagcgcaaagacattgtttcatcttccatgccaaggccaaacagagaggagcctgtggacagccggacgcccgtgaccgagagagttagctgactttacatagagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcggggtgggagtagttggagcattgggatgtttttcttaccgacaagcacagtcaggttgaagacctaaccagggccagaagtagctttgcacttttctaaactaggctccttcaacaaggcttgctgcagatactactgaccagacaagctgttgaccaggcactccccccaacaatatcctccctcttccccccccccacccccgccccgtgtgctcgttagggcaattgagaggacactcccatttttggtgccattgatgccctgtccataatagcttccctgacttttacaccaccccaactcccaatctgaaggactgggaggtgtgatgcaggagaaactatgggactcttgggagaagactatggagttggccagtgattaaggcccagtaattccaactgtggtagcacagatctggctccacatcaacccaatccaaaactgacaaggatattttgcaaaaaaagaaagtggcacctgtctgatccagctctgacatggctagaggtgagtcctaaactgatggcttataaactagcctgagccacagaagagtatggcccagagtgaagtgtcatcatctgttcacaaggcatgctcccctagaagataatgctaaagaggtgccatggaggcagcaggacaaagtacaggcaggctaggtggagtcaagccaggcctagtgccacagaacaagagagcagtctgactagtaattaagagggaagaaaggaaaatattcttccaattactttccagttctcctttagggacagcttagaattatttgcactattgagtcttcatgttcccacttcaaaacaaacagatgctctgaaagcaaactggcttgaaatggtgacactgtcccacaagccaccagacatggcagtgttcagaactacctgtatctgtatatacctgcgcttgttttaaagtgggctcagcacataggattcccaagaagctccgaaactctaagtgtttgctgcaattttataaggacttcctgattgctttctctctcgtccttccatttcttccttccttccatttcatgctttcatttcttcccctagcttctagttgtttcttctgttccaggcagctgcagtgctgaaccacatggttacctaacagcagtcagctgcagccctaggattcttcctgccctttaacttcccattgccagtgccaggtatcatatttaaccttgagcaagagctgggctcttttgagccctccctaacctctgtgaagaagaacaagaaggtaggaagctcttgctcttgctaagaaaaatgtcaaaaggctttcagaccttaaacaatgagccttttcaccttttactctagaaaagtggactagaaaatctgggtcacattgggtagctgaaggagatacagaggcccctatggcctgccagagtcgttgcatggcccaacaggggctccatgcccactacccttgaccctactcagaaatctaatgtcatacttagtgtgggcaggggacctgtcaggacagatgcagacctaagcagggagtgacaccagggcccttggcccttcttctgacaaacatacacatcccaagtctttttctagtggaattcttaacctcttgctcactggggactgggaagcatcagcacatcccatatttcaaactctgctccataagtacagtggtgaattttatagacttgactttgctgtggggttttaattggtcagttttaatttgggatcccaaagttttaacctccattcaggaagtccttatctagctgcatatcttcatcatattggtatatccttttctgtgtttacagagatgtctcatatctatcgaaatctgtctgagaagtaccttatcaaagtagcaaatgagacagcagtcttatgcttccagaaacacccacaggcacgtcccatgtgagctgctgccatgaactgtcgagtgtgtattgtcttgtgtattttcgttaacgttccccagcttccttcctgcggtgtaatcatggaagagtgaaacatcatagaaatcgtctagcacttcctggccagtccttagtgatcaggaaccgtagttgacagttccaattgatagcttaagataaaaccatgtttgtctcttatggaatggttagaactaagtgagagatcttgccccattctgtttgccgaatcatagttggacttttagtgtatttgtatccatttccttgtgctataaaagcaaaccctgcaaccagctttctgtcaggcagtccttttgcctgctctgcttttgatcctcttagtcttgcttctggttcctccctggagagggaggaggggtcagaagaggaattctggaggatccaggatatgtccttctgaactcctgcttcttccagtgacaaaaggcccctactgccccaccccaacctgccccatgcactcctctaggacacctttccatacttttcacaacacctagccaggttgacaccaagttgtttattgtggtctgcttggaattttacctgttaggcttacttagtccaatcaaatggactccaagttgggtatccctcatctttggaagacaacctaggctgattagatatttacttttgggattgcagcactttgggtgccgtttttcttttacttgggttttatctgcagctccctcaccaccaccaccaccccccacttacctgtatgtagaactgatttcaaaactgcaggtggtggtaactgcagcttcttagggttttcttcacttcttgcttctttccccattccctcatccacaaataagggcatcacaagtcagtctcctttaagcaggcagctttggtggggtttttcccctggaagccagggaccctgtcaggctgcctctgccttgtggtcaggttgacaggaggttggagggaaaagccttaagtcatgggattctcaccagctgtgtctggctcagacctggaatgtgacctttattttgttgtatttgaacattgtaaagtgtgggtggtaccttaaactgaatatgtgaagaatccagaaactgaccaacagctttcagatacctggggctaggtcactaaggtcacatccagtcttccctaccctgttctagttgttagctactacctctcccagatagattgctgtatatcctccaactatgatcatcctggcccaagcttgcctgttcttgagtctgtcttaaccagtggaactgctgcccttggtgtgcagtgagttgaggactcttggtcacagccaggctctagtagtacagctcctttctgctggtgctgtatttccatatcaaaaggcacaggggagatctagaaatgccatctcccccagtccatcagtgccaaacaagcccatgatcccagcatgggtacagacaactctgttcagtgctatcacaacagactagaggccatgaacattggacgtgggaaccagagcaacccgaattgctgctgctttattcagctttccgttgctctgacaatgataaaacaaggcagtaacttaaaacagactgccaggtttggcagagaaaggaaattccttagctgacagcacctctggattttaaataggttgtaataagtggctcaaacccatccaggaaaaagcaaaagggttagaactgaccagatgagaccagcctgatttcatgcagcccaaatggagtccagctgtctgaactctgcagcacttctctactacagtctcctagagcattccagccaggctcttcaggctgaggagacatcacaggtgccagttcttcaagaagacttttgtgcatcagttcatagcctatatctttgcccaagattgtagattcaggttaacactacagattctagggcagatgactgagactcagaaaaaaagcccctgtggactgtggtatagcgaagtacaaaaactgaagggggctagggcagatgccgcatgcctcatgccagagccaagccctctgctccatccacatccttttctggctccttcttcctgctctctgcttcagtgaaccagccccactctgaagagatttgttgattctctccatttttatgtctttctcttttaggtactatatagaaaaggcttagtctaattgttataaattgctagaatactgcctcccccagggtctaaaaatatatgctaaaggggaaaacttgaacactgaaaccagttctgaacaatttagaaggaaaaccttgaaaacatttaacaaaaaattatattttaatgtttatgaataagaggaggcttttgaaaaaatgttgatctataaatacttactttaggcctgaggtgtctaatgagtgaactgagcaatgggaactcaaggctgaagcctcctgcatcagaggaggtagaaccaggagcctcttgagatttgaggtgttttagcattggaaagccactctttgggtagctggccccagaaactacttctgaccttgtcatttggaatggaggttagtggtctgccagatgccaaagctgcatgagaccagctcttggtttatcaatttgaacactcagtaacctagaaggcccagcacaaagtgtctgctctcttcttaactgagcctgccccagcactactgcacaaattagggagggtctacttcctacagagcatccctccctgggccccctcccatcctttgtactctacctacctgaccttcaggatcttggcacatacgaaatggctgtgtagcaagcactttggcatgccctcctaaacttaccccagagcctctccctgcctccttaagccagtctgcctgtcttctggggaggtgttagagcccatagaatggagaggagaaagaaaagaggaagaggcaggcaggtagtaaaaaggctctgggaggaaagacagcctcctaggctttgcacaagcaggactcagccccttgtgggaactaagtgccatcttggagtttaagaacatttggacaagttgcaaatgacctttgctccttgctcctctcaccttttatggggccctgcttagcactgaaagcaaatgcgctgaaaaggcaaagaggtttggctcctgcccactgatagtcctttccctgcagtgtttgtgtgtcaagtggcaaagctgttcttcctggtgactctgattagatccagtaacttaagagatttgtatgcataggtctgctttgactcttctattctgggcttttgatttgtttttcagttttgcttttagttttcctatttttattttatgcaccaactagacacacaaagcagttgaatttatatatatatatatatatatatatctgtatatttcacaattataaactcattttgcttgtgacgccacacacacacaaaaagaaaaaccttttaaaattatacctgttgcttaattacaatatttctgataaccatagagtaggacaagggaaaaaatttaaaaagaaaaaaaaaaaaagaaaaaacacatctgtctgctggtcacttcttcaatccaagcagatctgtgatctttcctcgcgtctttcaaagacttccctgtgctaagtgaaggaagctccaggctgcacccaggttttgtgctttgtttctcctctgttgtgaaaggggccccaagattctgggtacaggacagttcatttcagcatggggtcaggagacaagagcactccctttacatgctgacgtacagaacttagtgggaatagcctagtccccacctctagggatggggagctagcatgcatgggggtgacccaactccctccacctttccctggccaggaagagcctgtgtacagtaagtctgacaagctttccccagttagcagggctcagagcatttaaaaaccctccaaactttgctgagtctagggactagagagaagatagaagatttggtctatctccaaggtgtgtaagctgtaccaggtagaatgccagggaccccagaaccacatccaacagcccaatgggtctcctccagaaagtagtgaagactccagaaacatccctttctcttctccctgctcccatgagtaactgcatttgcttttgtaatccttaatgagcattatctgctaaaaaaaaaaaattagctgtaacagttctttttgcaaaaggatcattcttaaataattaaaaacacccccccccaaaaaaaagtccagaaccttgttcttccaaagcagagagcattataatcagggccaaaatctgtcccacacctctaccccatctcctcatgattgctgcttctaaggccagaatacagcaaagatatttgtaggccctttgggtgactgggctacccttggagctcttggaagatgggctggggaagcctctgagaccctatcctagggccttgctctagggagtaatcagtattagtagagtgtcacaacattattccccagccggcatgagatgggggcagaagaagccaaagggttgtctccactgctacttacttggccactgacaggtaggtgaccatgtatgtccatatgcatgttttatggctgatgtgagatcagcacccaagttagcttcacctggtgacctctaaccctgcctggatggagcaggccacctggttcaatgtttctgggcagctggacaatggagtgcaaaaggcttacagaacttgaagccttttccttactttgctagcacggcctccttttccatttgatttgtcactgcttcagtcaataacagccgctccagagtcagtagttgatgaatatatgaccaaatatcaccaggactgttactcaacgtgtgccgagccctttccttgtgctgggctccctgtgtacctggacactgtaatgtgtgctgtgtttgctctccttcctcttccttccttgccctttccttgtctttctggggtttttctgttgggtttggtttggttttatttttccttttgtgttccaaacatgaggttttctctactggtcctctttaactgtggtgttgaggcttctatttgtgtaatttttggtgggtgaaaggaactttgctaagtaaatctcttctgtgtttgaaatgaagtctgtattgtaactatgtttaaagtaattgttccagagacaaatgcttctaggtacattttcattacaaacaaagcatttgaagggagggaagtggtgaataagacaagaggggcaatctgaattgatccctgcccagatcagccagaagctaccaaaagttaagcactggttttccattccaagtcaagagactgaagctgatgttttgccattttcaaagtcaaagcaaaaccagcttttccacccaatggattctttgcttctccttcccagattattactactgctgtaataatctaggagtgccaggagggaaaggagtattaacacagagctgtgctcactgagtatggaaaggcttggtctgagttttcaggaggatgacccactgtggacatggggagaagacagaagataaattagccgctccctgcctaagatacctcttaatagataagtcaaggccatggacattattgtctacaaggcatgtttcaaagacatgaccagtcaggacacttctgtcatactccatgttgccccctagtacacagtactaatctgatatctctgttcccgccatgcctgggggataaaatgatagcagagactcctttccttcaatgtgatctaattcccaacaaaatctgggcctgagataccacctgtttctatggcaaacatcctcagtaaagtgttattctcattgcagattgttccagcctaatgtaagaggaacagagcagtgttcccttggagcctcatgtggacagttctacctgtagtgaccagttggctatagtagttattagctggaacaaccagacagggtacatgccccctccaaaatccatgttgtactcccctctgccagccagggggggtgagatctgtagaatagtgcagccagtgacaagccaccttgtgtttgtcaccagctcaaaaactcatctaaggttgggagcaggcagacaaggcagagagaaagatccaggacagacctagctgggctggaggggtcttgaaaagccctctgtcgtattcaccttcagtttttgtgctttgggacaattactttagaaaataagtaggtcgttttaaaaacaaaatattgattgcttttttgtagtgttcaaaacaaaaggttctttgtgtatagccaaatgactgaaagcactgatatatttaaaaacaaaaggcaatttattaaggaaatttgtaccatttcagtaaacctgtctgaatgtacctgtatacgtttcaaaaacacaccccactgaacccctgtaacctatttattatataaagagtttgccttataaatttacataaaaatgtccgtttgtgtcttttgttgtaaaatcaagtggtttttcataaggttcttttactatttgaaaagatgggcagcacgcggtttcattttatttttgtaagttttttaatacatgtgaaagcaaagaatactcagcatgcctttctaagtgatgcgtttgcaccttttgttgggaagtactgtatcctgtgctgttagcattctcgataaatctctctgtgaaagtgactcaaggtctgggctttcattataagtcaccagtcccctccagctcacctgacagcatgatatgtttgattcagctatccctgaaccccagtagcctctctcaggataggtgtgggagggtagggaagcctatttcatatactggcatcctccttagtttgctctgtgtcaatatttttcaagcatactacaccagcattcgacaggaaggcctgacacaagtgtgcctagagcatagcttccctctcctgaccagtgtggcaggggcagctgctaggtcctggtgtgccatagtgttaacactttcctcccaactatgaggaactgcccaaagggagtccttgtgtcactggtttcctgtaagaatatgagccttctgcagccacctactccataggttgatatggcctggaggagaggataatggcatgtcacaaataattgtgagcatacctagaagctatcttgaagttctggcctcaaatgttacatgaaaggattgatgattcaacctatagacatggagaatacactgagtaccaggtgtgtaccagacactgagagtcccccgtccataaaaaggaccaaatccctgcccatagagtttaacatatatacacatgataattttggataatggagttggcacatcttaatatagactgacccatgagaaaccactggaagctcagcatatggttaacctcttgggttgttttggttttagtcagggtccaacttctactctaggctggcctggaactgagtatgtagggtgatctgcctcagcctcccaagtgctggaattacagatatgagccaccatgccaagctttgttttataataaggtctcactgtgtagctctggctgacctggaactatgcattgtaaaccaagctgcccttgaaattttagttatcttcctacctctgattctagagttctgggattacaggtatgcaccaccacatctagtttgacctcatcttgagagtggccacaattactgtggcttcaaagaagaggccccagtgggagccagccatggatcttgtgtagacctttctgaagacatactataagttccttagaggtcaggctagtgagagagaaccctttgtagttaggattgatatgacaaaaagtgtttgttggggaaactggtcaggagaagaaagctgccgctttacaagcatgctttcagctggccaaacaaggaataccaagttgctgcctgtggatcatccctgggcagtgagaagtgagaaaagtttagaggtacagaactccagcaagctcaaggtgtgttcaagagaggagctgggtttaggaagttttccccacagctgtttatgttcaatcttatcaggaatggctacagcaggggtgtatatgcaaactcaatttcagaacagaataagttcttttcaggacacctactaaacagggtttgggttttttgtttgttttgttttttgtttgtttgtttttttcaggtttggtcttgatctgaggtagggttgcactttgtatccctggctgacctggaacttaaaccatgctaacctcaaattcacagagattcacttgcctttgttttctgggtgcaggaattaaaggggtgtaccaccaagcccaacatctaaagagttctatctggcttaaggctgttggtgtatataagttcaggtgggtggacagaggctggctatgccatcttcctaacagctcttttaaagagctgggctttagtgatttgtacttgaggaagaccacctgagcagggagcactatccaagccatacagtctgtgcaggtgagtggcaatggctaatgctaagagtagtgcactcatatgaagaggacttcagagagcataatgagaaagtagtgtgcgctgagatgtgtgtcatagtgaccaaaaaggccaaagaaaaccctgaatggagaacagtagaggaataggcaagagacactcattcatgtggctaaaggtcacaacaggtggtatcaccaacaactactctagaaaggggtaggagaagctgctagaccctactatccttatggagagaagtgcaaactaagataaaagtgtgacagaaaaaggaaagggacatttagagccgaacaccatgtgtatgttaagagacataaatgtgttagttggaaagctaattagaatcctgcacaggcagattctgtgatctaacacttgctggcccagctgctggaaggttcctgggggcgtggtgggggcatggagatctagcacacaagcagtagcatggtatacactcttccagaccattctcagggcatccatccttatcaccaaatgactacagtctgccagagggccattttgttacccatatttaaccctgactgaccaacaatttggctggctctcaaactgctccccaactaaagcgagggtagcctctccgtgactttcaccaggcttggcataaactgcctttgtagaacatcgtgtaaaaacatcgtgccctttgtctctagaactggaagtcattcttcatcctgttcagccctattcagatgtttgtgtaggaccacagacctcggttctcccattagggactccctcctacgtagcagagctccttccccgcgtcaagggcggcgcgggacgcccccgtgtggcggaaggccgcggagggcaagatggcggcgggtcgagcgccgcctcttccgcccggccgggtgtcgcacgaggccggcctgaaggggaagtgagtcagtgtccgcggacccggcccgctaaggcccgcgcccgccgaggccccgagaggcctcggcccgggggcggcggcggcggccatggccggggggccgggccccggggagcctgtggttccaggcgcccagcacttcttgtacgaggtgccaccctgggttatgtgccgcttctacaaagtgatggacgccctggagcccgccgactggtgccagttcggtgggtgacggcaggccggcgtggggtggtggactcaggcttctggagctgaagcctgatgttccccatcccgcagcggccttgatcgtgcgcgaccagacagagctgcggctgtgcgagcgctccgagcagcgcacagccagtgttctgtggccctggatcaaccgcaacgcgcgcgtagctgacctcgttcacatcctcacgcacctgcagctgctgcgtgcgagggacatcatcacagcctgtgagcgagcatagccccagggaccctagggatgggaacccaagaggggtgacgggtacagagtttcctgagacagggaaccatatgggaactcccccccccccaccccttcacttagagatagagagctctgagtcacaaccctcctttccttccttgttatcccagggcaccctcctgcccccgttgtgcccccaagcaccgctgccccaaggcccagcagcatctctgcaggctctgaggccggggactggagcccccggaaattgcagtcctctgcctccaccttcctctccccaggtaaaaagaacccgggtgttgggcttgatatgcctgaggaaaaggccaccatgactgctgacatggctgtagactgctgctggtctctgcctctcactgccatctttatgaagcttttccaggctcccagacccattctgagtcagagctcctccaggttccactccctgtttccctcgggccaccactaccatcttcagccccttcctccaccaaggtaggtgtctcttaacccccagggaattttccagacaaagaggaagaaacttaacctttggtgtaccacagagcccaaatcagcacagccaggtcatctgagagacaactagtgttgaagggagctttcaacctggaccaaagggaatagatagggtcctcgcctggtccatggtctcttccagcagtcaagcccagagagcccagtgtctggcctccaaagagcccatccctccccgttttgctggcccttctgtgagatttcccaaggcacctgcaacttctctgaagaactcaggattggagagggtggttttggatgtgtgtaccgagcagtcatgagaaatactacatatgctgtgaagagactgaaggaggtaggtgtaacattggggtagacacctggaagacaatctatcagtccttatttgtctagttcctccctccatcagcccctcacttctgcagtctccagcctccccaagcaattccttcaaggaccccaagccttccatagatttgggcctggaaacaactggcaagcttggctcatgtcacctactttccctacctcttaccccaccatgcctggggctacaggaagctgacctagagtggactatggtgaaacagagcttcttaacagaggtggaacagctatcaaggtgagccttgggggtccctcctgtctaggggcacaaggtgagccacaccacggcctcatcagtctttaggactgcacaacacaagatctggctcccttgggccctcaaggcctggcctggcatgggtgagggaacatcaagtgctgcctacctagcctggcctgatgaaaagtagtagaacccagaaaattaaagaactcagactccactctttataacaggtttcgtcacccaaatatcgtagactttgctggctactgtgcagagagtggcttatactgccttgtttatggcttcttgcccaatggctccttggaggatcagctccaccttcaggtagtccttgctgatctggcacctttattggcatagccccttagcctgtgtcaggcaggacttgggcttctggctccccctcaaactcaagatttggcccagggttttctttcttcctttttactggcttgattgtttgagacaatacctcactacccagctcaggctagcctcaagctggcaattcttctgcgtcagcctgctctatgctagagttacattacactcagcttggcccaagattttccatacaattctttcctctgtcctctccccactgttcctctattgggagttattggctttgcaagcagagtagctaaaggatttagtatttagtccacatatagctcttgaggaatgaggaccagtggagacaggctgtcagactgaacccaagcttgagccatgcctgaatgtcatactcacaagccaccacatatacaggataagagcttccttctcaaactgttttgagagaggagagggagaagggcaccagcactttctgttaggtagagctgagcccatcacattttgtcttgagtcctgtgaaatgttcctagctggtatcccagctgtagagtgcttgccaaaaccttcggtatagctttagctaccacttgctcgtgaattaggtcatagacagtcttactcctcattctccagaggctcagaataaagcttgccccaagccgcacagtgacaggtgaggggaatttggggggggggggtcaaagaacagctgccctgagctgcctctgtgcttctgtctttgtcactccagacccaggcctgctccccactttcctggcctcaacgactggacattcttctgggcacagcccgggctattcagtttttacatcaggatagccccagccttatccatggagacatcaagaggtgaggaggggctcagaagagctatagaaagtcatatggccagggagacagtgaccctctgctcaatgaacagctctgttctgagtgtccctgtgatattcttcctgcccagtcctgtgaatatgggaacaggtgttgcctgggacctcagagctgagagtacttagggctatgagtacccctgcatggtgcaagtatacaaataaagccacggtggtgagcagaagccaaacaatgtgaaggggctcagggactgcgggccctcagacagctgggatgcaatgcagccactttccataagcagtacgcctctagtccagtttatcaggaccatttgggtgtaggggacagaaaaacagaaaggtagtaggacctgaactggtgccattcttccgtttgtttccaagttctaacgtgcttctggatgagagactgatgcccaagctgggagactttggcctggctcgtttcagccgctttgcgggggccaaagcaagccagagcagtactgtggcccggacttccacagttcgaggtaccctcgcctacttgcctgaggagtacatcaagacaggccgactggctgtggacaccgataccttcagctttggggtggtgagccaccagcccttctgttggcttggggagggaaaagcaccagtaagtaaagtcaggaaagcctagagaattctaggcctaaggcagaggtgagcctagtggggagctagcatagctttggccttagggatcaccctgcctcatacacctccctcttcccttgcactaaattgtggtcataatttgcatccttttgcttaagcttgcatcccataacaatgctgcccttgctgggaggtggtctgtacctgcctgttccgggactactttcccactagtcctgatccatgcccatgctacaagcctcttctacacacaatttctccctgctaaagtgatgttgtctatcccccctctaggtaatactggagacccttgctggtcagagggctgtgaggacacaaggtgcaaagaccaagtatttggtgagcctcctaaggtggagcatggagggagggaggggcagctgcagccagtgggtacagccccagagggtgggatggtacagatcctttacattgccccacaatagcctgctactgctgctgctgactcatctttaaaagtgggtgagtcccaagcagtttcttttaccttgcacggaagaacctatctttagtttgtacctagaccttgaggatagggatgtaatctcagtggtagaaccttattgcatgcaaggccctgggtcctatccccatcaaaggggaaaaagaactttgacaggttccccctctgccttggactggggatagagagggggctattccagataccccggggaccaaaccttcagtggaacttagagcagggctgagtaaaggcagtaggaagtaggcaggctgttaaagtagcagctccaagccatcctgacccctacattcctgtctaccttgctgtacactgagatagggctaaggaataagagacctaaagcttagcatctgagtacatggttttggttccaacattcaaaaatctgaggcaggaggattgccaggagttggaggccagctggggctatataacaagaccttctatcaaaaacaacaacaacaaaattagttgattatggtggcatgtacacttaggaggtagaagcaggggggtcagaaatttaaagttatcctcagtaatatagtaagttcaagaccagagtaagttacatggttcactgtctcaaacatacaaagaagctgggcagtgccagcacatgtctttaatcccagcacttgggaggcagaggcaggcggatttccgagttttggccagcctggtctacagagtgagttccagggcagccagagctacacagagaaaccctgtcttttttgttttttgttttttgttttttttaaaaacaaaaaacaaaaaaagacaagagacctgggttttagtcccatcaacacagtggtcatgggtcaaattcttgctcttcattgagcttcagtttcccatatagaaaacagactttaacacaggaacactattccagcaattcctaggcccagaacatgcttggctaatgctgggtcgtcaccttttacagagttacatctcccattgcttctccaggatgaagcctatttttgtccactgttgggcccagtgggggatttaaccaacccaacaaactgaaccagattctacccatccctccttcctttactgcgtccattagcacatcccagctcaagtactggttgttcagaccccacggaccttgctaacagactagtaggtttgttggcatctgtttcccccactgcaatgggatgtcaggactgtaaaacacggcccagagtgtttgatttgtggctgttatcagtagagccccagacagcactaggcacacagtggtgtttaatgaacctagggaaagaagaccagaggactgagtggcagtggcctggaagttttggtggaaccatgctgaactgacagtatttgttttacagaaagacctgattgaagatgaggctgaagaggctggagtgaccctgaaaagcacccagcctactctgtgggtgggtgtagccacggatgcttgggctgctccaattgctgcccagatctataagaagcacctggactccagacctgggccctgcccaccccagttgggcctggccctggctcaactagcttgctgctgcatgcaccgtcgggccaagaagaggccccccatgacccaggtagccctggggaggccagttaaccatggggacatagtggccagcaagaaaactttcgtacttgccctgcttgatagcaatagctacaaagtacctacctgatctcttacagaggcaaaactcccaacattccttgcttgccctttggctctatttggggaggtgctctgtggaactaagtggtaaagggctgctgctttgctggatgagcctcagatcccaggaacaggtagaaggaaagggctctgatcatgcccctaagtgggggtgctgtgccactcactacctttgtctttttgtcttaccttccacctcttctggtgatggttaagaatagagttcctggctttggtggccatgaatctcaatagttcttgggatgagacaaaggaacaaagggcaatgttttctcagctgcagagtgcaccagctttgtgttatctgtcattctgttggctgtatggggcctgtggtattaacctgaacataggcaagtctaggccaacctgaagcagcagagtagctgtgtggtttgaccacagggtgtcagatctaggctgccttgcccagccaggaacccatgctctgcccatcctgagagcctctctctccacacaggtatacaagagactagaagggcttcaggcagggcctccctgggagctagaggttgccggccatggctccccttccccacaggagaactcctacatgtctaccactggcagtgcccagagtggggatgaaccatggcagcctctagtagtgaccacaagagccccagcccaggctgcccagcaactccagagaagtcccaaccagccagtggaaagtgatgagagtgttcccggcctctctgctaccctgcattcctggcacttgactccaggttcccacccaagcccagcgtccttcagagaggctagctgtacccagggaggcactaccagagaatcaagtgtgaggagtagcccaggcttccagcctacaaccatggaaggtaactcggaataggatctcccttcttaacccttctccccaccccatgcctaaaatcaaaagtgtagaattctaggttctgtctaggcagcctgggagcctggtctgtgatctgatctctcccaacctgggccccagaatatactggagaattctgccctgcagccagcatcactagcaggggggagctgggaagactctggaggctagagtgtcactcaagattgcagggacaagccgggcgtggtggcgcatacctttaatctcagcacttgggaggcagaggcaggtggatttctgagtttgaggccagcctggtctacatacagagtgagttccaggacagccagggctacacagagaaaccctgtctcgaaaaaaccaaaaaaaaaaaaaaagcagggacagctaagaagttactatctctgctcaggctcacccacgggcagctcatccctgctgtcatcagaaccaccacagatcatcatcaacccagcccgacagaagatggtacaaaagctggctctttatgaagaaggggtcttggatagcctgcaactgctgtcatcaggctttttcccaggtacctgtggataactctagctcagcttccccagaagagcctcccaccgctgtcatacacacatacaaacatgcatacaaagtcatactctgcagctccagggcatacaggcataattccttatgtcaaccctaaacagcagaacatttgttctggctgcacaattaaggctccacttaccaagaatataggacccagcttttgctcaacatctgtagggagatgcctggctcaatcccttacttcccaccagtagcactcccacatgctcctagaaaatgtgaagttccagcaggaattttctactccaggtactatatgaaaagctgctgtttagccaagcatgttctgggcctaggaattgctgggataccttagctggggataagagtgtacctgtaaagatcatccaaactagcaggccggagagattgcccagtgaataaggcaatgggctgcttttgcagatttacttggctttagtttccagactccacatttggtagttcacagctacttgtaactccagtcccaggggatctgaatccctcttctggcctccgcagatacctttgtatatacatgtatatactttgtatatacatggtgtatttaaaactcacgtagaaacacacatataaaaggaaaaatcttattttcaaaaagcaaactaaaggtataaagaaaaccttggctccaaagactgccctgagctgggcagtggtaacgcatgcctttaatcccagcacttgggaggcagaaacaggcaagtttggggccagcttggtctacagagcaagttccaggatagccagggcaacagacaaaaaaaccctgtgagaaaaaggtggggtggggtagggaattagctcagttgtagagcatttgcttagcaagcgaagtgccctgagttccagtctccttcccacatgctcagtttggagtgggagggggcccacaaagttctgtgctcatggttcatgtcagggtatttgaaagacaagaagttgtccccaacttattaagtgatattttcttttccataggcttggatttagaacctgaaaagagccagggacctgaagaaagtgatgaattccagagctgatttgttcactctgacaaatccctcagactcagaggtcaaagttctcatgcttggaagttctcatagtgtgcaaactcctcagtagcccaaaggcatcaggtgtgggggctcactctggcaaaggagagagggcagtggaccctgctgttctcagaatgtgaacacagacagggccagccaaagaacttgatagaagctgataaggcaggcaatgtgaggccagcatttgtgagcaaggcaagcagagtacctaaggaattgggtagtacaaaacagaagactggggctggtgagatggctcagtgggtatgagcacccgattgctcttccaaaggtccggagttcaaatcccagcaaccacatggtggctcacaaccatctgtaacaagatctgacgccctcttctggagtgtctgaagacagctacagtgtacttatatataataaataaatctttaaaaaaaaaaaacagaagactgctagctacacaggcccagaggacacaagtaggtctgtttgtatggtgggagctagctcccctgagagctagataatatatctgcagtctgtgagtctattcctcagaacttccctaaaacaccaagcgaaagtagctgt

SEQ ID NO: 4 - DNA, 82772 bp, Mus musculus
acagctactttcgcttggtgttttagggaagttctgaggaatagactcacagactgcagatatattatctagctctcaggggagctagctcccaccatacaaacagacctacttgtgtcctctgggcctgtgtagctagcagtcttctgttttttttttttaaagatttatttattatatataagtacactgtagctgtcttcagacactccagaagagggcgtcagatcttgttacagatggttgtgagccaccatgtggttgctgggatttgaactccggacctttggaagagcaatcgggtgctcatacccactgagccatctcaccagccccagtcttctgttttgtactacccaattccttaggtactctgcttgccttgctcacaaatgctggcctcacattgcctgccttatcagcttctatcaagttctttggctggccctgtctgtgttcacattctgagaacagcagggtccactgccctctctcctttgccagagtgagcccccacacctgatgcctttgggctactgaggagtttgcacactatgagaacttccaagcatgagaactttgacctctgagtctgagggatttgtcagagtgaacaaatcagctctggaattcatcactttcttcaggtccctggctcttttcaggttctaaatccaagcctatggaaaagaaaatatcacttaataagttggggacaacttcttgtctttcaaataccctgacatgaaccatgagcacagaactttgtgggccccctcccactccaaactgagcatgtgggaaggagactggaactcagggcacttcgcttgctaagcaaatgctctacaactgagctaattccctaccccaccccacctttttctcacagggtttttttgtctgttgccctggctatcctggaacttgctctgtagaccaagctggccccaaacttgcctgtttctgcctcccaagtgctgggattaaaggcatgcgttaccactgcccagctcagggcagtctttggagccaaggttttctttatacctttagtttgctttttgaaaataagatttttccttttatatgtgtgtttctacgtgagttttaaatacaccatgtatatacaaagtatatacatgtatatacaaaggtatctgcggaggccagaagagggattcagatcccctgggactggagttacaagtagctgtgaactaccaaatgtggagtctggaaactaaagccaagtaaatctgcaaaagcagcccattgccttattcactgggcaatctctccggcctgctagtttggatgatctttacaggtacactcttatccccagctaaggtatcccagcaattcctaggcccagaacatgcttggctaaacagcagcttttcatatagtacctggagtagaaaattcctgctggaacttcacattttctaggagcatgtgggagtgctactggtgggaagtaagggattgagccaggcatctccctacagatgttgagcaaaagctgggtcctatattcttggtaagtggagccttaattgtgcagccagaacaaatgttctgctgtttagggttgacataaggaattatgcctgtatgccctggagctgcagagtatgactttgtatgcatgtttgtatgtgtgtatgacagcggtgggaggctcttctggggaagctgagctagagttatccacaggtacctgggaaaaagcctgatgacagcagttgcaggctatccaagaccccttcttcataaagagccagcttttgtaccatcttctgtcgggctgggttgatgatgatctgtggtggttctgatgacagcagggatgagctgcccgtgggtgagcctgagcagagatagtaacttcttagctgtccctgctttttttttttttttggttttttcgagacagggtttctctgtgtagccctggctgtcctggaactcactctgtatgtagaccaggctggcctcaaactcagaaatccacctgcctctgcctcccaagtgctgagattaaaggtatgcgccaccacgcccggcttgtccctgcaatcttgagtgacactctagcctccagagtcttcccagctcccccctgctagtgatgctggctgcagggcagaattctccagtatattctggggcccaggttgggagagatcagatcacagaccaggctcccaggctgcctagacagaacctagaattctacacttttgattttaggcatggggtggggagaagggttaagaagggagatcctattccgagttaccttccatggttgtaggctggaagcctgggctactcctcacacttgattctctggtagtgcctccctgggtacagctagcctctctgaaggacgctgggcttgggtgggaacctggagtcaagtgccaggaatgcagggtagcagagaggccgggaacactctcatcactttccactggctggttgggacttctctggagttgctgggcagcctgggctggggctcttgtggtcactactagaggctgccatggttcatccccactctgggcactgccagtggtagacatgtaggagttctcctgtggggaaggggagccatggccggcaacctctagctcccagggaggccctgcctgaagcccttctagtctcttgtatacctgtgtggagagagaggctctcaggatgggcagagcatgggttcctggctgggcaaggcagcctagatctgacaccctgtggtcaaaccacacagctactctgctgcttcaggttggcctagacttgcctatgttcaggttaataccacaggccccatacagccaacagaatgacagataacacaaagctggtgcactctgcagctgagaaaacattgccctttgttcctttgtctcatcccaagaactattgagattcatggccaccaaagccaggaactctattcttaaccatcaccagaagaggtggaaggtaagacaaaaagacaaaggtagtgagtggcacagcacccccacttaggggcatgatcagagccctttccttctacctgttcctgggatctgaggctcatccagcaaagcagcagccctttaccacttagttccacagagcacctccccaaatagagccaaagggcaagcaaggaatgttgggagttttgcctctgtaagagatcaggtaggtactttgtagctattgctatcaagcagggcaagtacgaaagttttcttgctggccactatgtccccatggttaactggcctccccagggctacctgggtcatggggggcctcttcttggcccgacggtgcatgcagcagcaagctagttgagccagggccaggcccaactggggtgggcagggcccaggtctggagtccaggtgcttcttatagatctgggcagcaattggagcagcccaagcatccgtggctacacccacccacagagtaggctgggtgcttttcagggtcactccagcctcttcagcctcatcttcaatcaggtctttctgtaaaacaaatactgtcagttcagcatggttccaccaaaacttccaggccactgccactcagtcctctggtcttctttccctaggttcattaaacaccactgtgtgcctagtgctgtctggggctctactgataacagccacaaatcaaacactctgggccgtgttttacagtcctgacatcccattgcagtgggggaaacagatgccaacaaacctactagtctgttagcaaggtccgtggggtctgaacaaccagtacttgagctgggatgtgctaatggacgcagtaaaggaaggagggatgggtagaatctggttcagtttgttgggttggttaaatcccccactgggcccaacagtggacaaaaataggcttcatcctggagaagcaatgggagatgtaactctgtaaaaggtgacgacccagcattagccaagcatgttctgggcctaggaattgctggaatagtgttcctgtgttaaagtctgttttctatatgggaaactgaagctcaatgaagagcaagaatttgacccatgaccactgtgttgatgggactaaaacccaggtctcttgtctttttttgttttttgtttttaaaaaaaacaaaaaacaaaaaacaaaaaagacagggtttctctgtgtagctctggctgccctggaactcactctgtagaccaggctggccaaaactcggaaatccgcctgcctctgcctcccaagtgctgggattaaagacatgtgctggcactgcccagcttctttgtatgtttgagacagtgaaccatgtaacttactctggtcttgaacttactatattactgaggataactttaaatttctgacccccctgcttctacctcctaagtgtacatgccaccataatcaactaattttgttgttgttgtttttgatagaaggtcttgttatatagccccagctggcctccaactcctggcaatcctcctgcctcagatttttgaatgttggaaccaaaaccatgtactcagatgctaagctttaggtctcttattccttagccctatctcagtgtacagcaaggtagacaggaatgtaggggtcaggatggcttggagctgctactttaacagcctgcctacttcctactgcctttactcagccctgctctaagttccactgaaggtttggtccccggggtatctggaatagccccctctctatccccagtccaaggcagagggggaacctgtcaaagttctttttcccctttgatggggataggacccagggccttgcatgcaataaggttctaccactgagattacatccctatcctcaaggtctaggtacaaactaaagataggttcttccgtgcaaggtaaaagaaactgcttgggactcacccacttttaaagatgagtcagcagcagcagtagcaggctattgtggggcaatgtaaaggatctgtaccatcccaccctctggggctgtacccactggctgcagctgcccctccctccctccatgctccaccttaggaggctcaccaaatacttggtctttgcaccttgtgtcctcacagccctctgaccagcaagggtctccagtattacctagaggggggatagacaacatcactttagcagggagaaattgtgtgtagaagaggcttgtagcatgggcatggatcaggactagtgggaaagtagtcccggaacaggcaggtacagaccacctcccagcaagggcagcattgttatgggatgcaagcttaagcaaaaggatgcaaattatgaccacaatttagtgcaagggaagagggaggtgtatgaggcagggtgatccctaaggccaaagctatgctagctccccactaggctcacctctgccttaggcctagaattctctaggctttcctgactttacttactggtgcttttccctccccaagccaacagaagggctggtggctcaccaccccaaagctgaaggtatcggtgtccacagccagtcggcctgtcttgatgtactcctcaggcaagtaggcgagggtacctcgaactgtggaagtccgggccacagtactgctctggcttgctttggcccccgcaaagcggctgaaacgagccaggccaaagtctcccagcttgggcatcagtctctcatccagaagcacgttagaacttggaaacaaacggaagaatggcaccagttcaggtcctactacctttctgtttttctgtcccctacacccaaatggtcctgataaactggactagaggcgtactgcttatggaaagtggctgcattgcatcccagctgtctgagggcccgcagtccctgagccccttcacattgtttggcttctgctcaccaccgtggctttatttgtatacttgcaccatgcaggggtactcatagccctaagtactctcagctctgaggtcccaggcaacacctgttcccatattcacaggactgggcaggaagaatatcacagggacactcagaacagagctgttcattgagcagagggtcactgtctccctggccatatgactttctatagctcttctgagcccctcctcacctcttgatgtctccatggataaggctggggctatcctgatgtaaaaactgaatagcccgggctgtgcccagaagaatgtccagtcgttgaggccaggaaagtggggagcaggcctgggtctggagtgacaaagacagaagcacagaggcagctcagggcagctgttctttgaccccccccccccaaattcccctcacctgtcactgtgcggcttggggcaagctttattctgagcctctggagaatgaggagtaagactgtctatgacctaattcacgagcaagtggtagctaaagctataccgaaggttttggcaagcactctacagctgggataccagctaggaacatttcacaggactcaagacaaaatgtgatgggctcagctctacctaacagaaagtgctggtgcccttctccctctcctctctcaaaacagtttgagaaggaagctcttatcctgtatatgtggtggcttgtgagtatgacattcaggcatggctcaagcttgggttcagtctgacagcctgtctccactggtcctcattcctcaagagctatatgtggactaaatactaaatcctttagctactctgcttgcaaagccaataactcccaatagaggaacagtggggagaggacagaggaaagaattgtatggaaaatcttgggccaagctgagtgtaatgtaactctagcatagagcaggctgacgcagaagaattgccagcttgaggctagcctgagctgggtagtgaggtattgtctcaaacaatcaagccagtaaaaaggaagaaagaaaaccctgggccaaatcttgagtttgagggggagccagaagcccaagtcctgcctgacacaggctaaggggctatgccaataaaggtgccagatcagcaaggactacctgaaggtggagctgatcctccaaggagccattgggcaagaagccataaacaaggcagtataagccactctctgcacagtagccagcaaagtctacgatatttgggtgacgaaacctgttataaagagtggagtctgagttctttaattttctgggttctactacttttcatcaggccaggctaggtaggcagcacttgatgttccctcacccatgccaggccaggccttgagggcccaagggagccagatcttgtgttgtgcagtcctaaagactgatgaggccgtggtgtggctcaccttgtgcccctagacaggagggacccccaaggctcaccttgatagctgttccacctctgttaagaagctctgtttcaccatagtccactctaggtcagcttcctgtagccccaggcatggtggggtaagaggtagggaaagtaggtgacatgagccaagcttgccagttgtttccaggcccaaatctatggaaggcttggggtccttgaaggaattgcttggggaggctggagactgcagaagtgaggggctgatggagggaggaactagacaaataaggactgatagattgtcttccaggtgtctaccccaatgttacacctacctccttcagtctcttcacagcatatgtagtatttctcatgactgctcggtacacacatccaaaaccaccctctccaatcctgagttcttcagagaagttgcaggtgccttgggaaatctcacagaagggccagcaaaacggggagggatgggctctttggaggccagacactgggctctctgggcttgactgctggaagagaccatggaccaggcgaggaccctatctattccctttggtccaggttgaaagctcccttcaacactagttgtctctcagatgacctggctgtgctgatttgggctctgtggtacaccaaaggttaagtttcttcctctttgtctggaaaattccctgggggttaagagacacctaccttggtggaggaaggggctgaagatggtagtggtggcccgagggaaacagggagtggaacctggaggagctctgactcagaatgggtctgggagcctggaaaagcttcataaagatggcagtgagaggcagagaccagcagcagtctacagccatgtcagcagtcatggtggccttttcctcaggcatatcaagcccaacacccgggttctttttacctggggagaggaaggtggaggcagaggactgcaatttccgggggctccagtccccggcctcagagcctgcagagatgctgctgggccttggggcagcggtgcttgggggcacaacgggggcaggagggtgccctgggataacaaggaaggaaaggagggttgtgactcagagctctctatctctaagtgaaggggtgggggggggggagttcccatatggttccctgtctcaggaaactctgtacccgtcacccctcttgggttcccatccctagggtccctggggctatgctcgctcacaggctgtgatgatgtccctcgcacgcagcagctgcaggtgcgtgaggatgtgaacgaggtcagctacgcgcgcgttgcggttgatccagggccacagaacactggctgtgcgctgctcggagcgctcgcacagccgcagctctgtctggtcgcgcacgatcaaggccgctgcgggatggggaacatcaggcttcagctccagaagcctgagtccaccaccccacgccggcctgccgtcacccaccgaactggcaccagtcggcgggctccagggcgtccatcactttgtagaagcggcacataacccagggtggcacctcgtacaagaagtgctgggcgcctggaaccacaggctccccggggcccggccccccggccatggccgccgccgccgcccccgggccgaggcctctcggggcctcggcgggcgcgggccttagcgggccgggtccgcggacactgactcacttccccttcaggccggcctcgtgcgacacccggccgggcggaagaggcggcgctcgacccgccgccatcttgccctccgcggccttccgccacacgggggcgtcccgcgccgcccttgacgcggggaaggagctctgctacgtaggagggagtccctaatgggagaaccgaggtctgtggtcctacacaaacatctgaatagggctgaacaggatgaagaatgacttccagttctagagacaaagggcacgatgtttttacacgatgttctacaaaggcagtttatgccaagcctggtgaaagtcacggagaggctaccctcgctttagttggggagcagtttgagagccagccaaattgttggtcagtcagggttaaatatgggtaacaaaatggccctctggcagactgtagtcatttggtgataaggatggatgccctgagaatggtctggaagagtgtataccatgctactgcttgtgtgctagatctccatgcccccaccacgcccccaggaaccttccagcagctgggccagcaagtgttagatcacagaatctgcctgtgcaggattctaattagctttccaactaacacatttatgtctcttaacatacacatggtgttcggctctaaatgtccctttcctttttctgtcacacttttatcttagtttgcacttctctccataaggatagtagggtctagcagcttctcctacccctttctagagtagttgttggtgataccacctgttgtgacctttagccacatgaatgagtgtctcttgcctattcctctactgttctccattcagggttttctttggcctttttggtcactatgacacacatctcagcgcacactactttctcattatgctctctgaagtcctcttcatatgagtgcactactcttagcattagccattgccactcacctgcacagactgtatggcttggatagtgctccctgctcaggtggtcttcctcaagtacaaatcactaaagcccagctctttaaaagagctgttaggaagatggcatagccagcctctgtccacccacctgaacttatatacaccaacagccttaagccagatagaactctttagatgttgggcttggtggtacacccctttaattcctgcacccagaaaacaaaggcaagtgaatctctgtgaatttgaggttagcatggtttaagttccaggtcagccagggatacaaagtgcaaccctacctcagatcaagaccaaacctgaaaaaaacaaacaaacaaaaaacaaaacaaacaaaaaacccaaaccctgtttagtaggtgtcctgaaaagaacttattctgttctgaaattgagtttgcatatacacccctgctgtagccattcctgataagattgaacataaacagctgtggggaaaacttcctaaacccagctcctctcttgaacacaccttgagcttgctggagttctgtacctctaaacttttctcacttctcactgcccagggatgatccacaggcagcaacttggtattccttgtttggccagctgaaagcatgcttgtaaagcggcagctttcttctcctgaccagtttccccaacaaacactttttgtcatatcaatcctaactacaaagggttctctctcactagcctgacctctaaggaacttatagtatgtcttcagaaaggtctacacaagatccatggctggctcccactggggcctcttctttgaagccacagtaattgtggccactctcaagatgaggtcaaactagatgtggtggtgcatacctgtaatcccagaactctagaatcagaggtaggaagataactaaaatttcaagggcagcttggtttacaatgcatagttccaggtcagccagagctacacagtgagaccttattataaaacaaagcttggcatggtggctcatatctgtaattccagcacttgggaggctgaggcagatcaccctacatactcagttccaggccagcctagagtagaagttggaccctgactaaaaccaaaacaacccaagaggttaaccatatgctgagcttccagtggtttctcatgggtcagtctatattaagatgtgccaactccattatccaaaattatcatgtgtatatatgttaaactctatgggcagggatttggtcctttttatggacgggggactctcagtgtctggtacacacctggtactcagtgtattctccatgtctataggttgaatcatcaatcctttcatgtaacatttgaggccagaacttcaagatagcttctaggtatgctcacaattatttgtgacatgccattatcctctcctccaggccatatcaacctatggagtaggtggctgcagaaggctcatattcttacaggaaaccagtgacacaaggactccctttgggcagttcctcatagttgggaggaaagtgttaacactatggcacaccaggacctagcagctgcccctgccacactggtcaggagagggaagctatgctctaggcacacttgtgtcaggccttcctgtcgaatgctggtgtagtatgcttgaaaaatattgacacagagcaaactaaggaggatgccagtatatgaaataggcttccctaccctcccacacctatcctgagagaggctactggggttcagggatagctgaatcaaacatatcatgctgtcaggtgagctggaggggactggtgacttataatgaaagcccagaccttgagtcactttcacagagagatttatcgagaatgctaacagcacaggatacagtacttcccaacaaaaggtgcaaacgcatcacttagaaaggcatgctgagtattctttgctttcacatgtattaaaaaacttacaaaaataaaatgaaaccgcgtgctgcccatcttttcaaatagtaaaagaaccttatgaaaaaccacttgattttacaacaaaagacacaaacggacatttttatgtaaatttataaggcaaactctttatataataaataggttacaggggttcagtggggtgtgtttttgaaacgtatacaggtacattcagacaggtttactgaaatggtacaaatttccttaataaattgccttttgtttttaaatatatcagtgctttcagtcatttggctatacacaaagaaccttttgttttgaacactacaaaaaagcaatcaatattttgtttttaaaacgacctacttattttctaaagtaattgtcccaaagcacaaaaactgaaggtgaatacgacagagggcttttcaagacccctccagcccagctaggtctgtcctggatctttctctctgccttgtctgcctgctcccaaccttagatgagtttttgagctggtgacaaacacaaggtggcttgtcactggctgcactattctacagatctcaccccccctggctggcagaggggagtacaacatggattttggagggggcatgtaccctgtctggttgttccagctaataactactatagccaactggtcactacaggtagaactgtccacatgaggctccaagggaacactgctctgttcctcttacattaggctggaacaatctgcaatgagaataacactttactgaggatgtttgccatagaaacaggtggtatctcaggcccagattttgttgggaattagatcacattgaaggaaaggagtctctgctatcattttatcccccaggcatggcgggaacagagatatcagattagtactgtgtactagggggcaacatggagtatgacagaagtgtcctgactggtcatgtctttgaaacatgccttgtagacaataatgtccatggccttgacttatctattaagaggtatcttaggcagggagcggctaatttatcttctgtcttctccccatgtccacagtgggtcatcctcctgaaaactcagaccaagcctttccatactcagtgagcacagctctgtgttaatactcctttccctcctggcactcctagattattacagcagtagtaataatctgggaaggagaagcaaagaatccattgggtggaaaagctggttttgctttgactttgaaaatggcaaaacatcagcttcagtctcttgacttggaatggaaaaccagtgcttaacttttggtagcttctggctgatctgggcagggatcaattcagattgcccctcttgtcttattcaccacttccctcccttcaaatgctttgtttgtaatgaaaatgtacctagaagcatttgtctctggaacaattactttaaacatagttacaatacagacttcatttcaaacacagaagagatttacttagcaaagttcctttcacccaccaaaaattacacaaatagaagcctcaacaccacagttaaagaggaccagtagagaaaacctcatgtttggaacacaaaaggaaaaataaaaccaaaccaaacccaacagaaaaaccccagaaagacaaggaaagggcaaggaaggaagaggaaggagagcaaacacagcacacattacagtgtccaggtacacagggagcccagcacaaggaaagggctcggcacacgttgagtaacagtcctggtgatatttggtcatatattcatcaactactgactctggagcggctgttattgactgaagcagtgacaaatcaaatggaaaaggaggccgtgctagcaaagtaaggaaaaggcttcaagttctgtaagccttttgcactccattgtccagctgcccagaaacattgaaccaggtggcctgctccatccaggcagggttagaggtcaccaggtgaagctaacttgggtgctgatctcacatcagccataaaacatgcatatggacatacatggtcacctacctgtcagtggccaagtaagtagcagtggagacaaccctttggcttcttctgcccccatctcatgccggctggggaataatgttgtgacactctactaatactgattactccctagagcaaggccctaggatagggtctcagaggcttccccagcccatcttccaagagctccaagggtagcccagtcacccaaagggcctacaaatatctttgctgtattctggccttagaagcagcaatcatgaggagatggggtagaggtgtgggacagattttggccctgattataatgctctctgctttggaagaacaaggttctggacttttttttgggggggggtgtttttaattatttaagaatgatccttttgcaaaaagaactgttacagctaattttttttttttagcagataatgctcattaaggattacaaaagcaaatgcagttactcatgggagcagggagaagagaaagggatgtttctggagtcttcactactttctggaggagacccattgggctgttggatgtggttctggggtccctggcattctacctggtacagcttacacaccttggagatagaccaaatcttctatcttctctctagtccctagactcagcaaagtttggagggtttttaaatgctctgagccctgctaactggggaaagcttgtcagacttactgtacacaggctcttcctggccagggaaaggtggagggagttgggtcacccccatgcatgctagctccccatccctagaggtggggactaggctattcccactaagttctgtacgtcagcatgtaaagggagtgctcttgtctcctgaccccatgctgaaatgaactgtcctgtacccagaatcttggggcccctttcacaacagaggagaaacaaagcacaaaacctgggtgcagcctggagcttccttcacttagcacagggaagtctttgaaagacgcgaggaaagatcacagatctgcttggattgaagaagtgaccagcagacagatgtgttttttctttttttttttttctttttaaattttttcccttgtcctactctatggttatcagaaatattgtaattaagcaacaggtataattttaaaaggtttttctttttgtgtgtgtgtggcgtcacaagcaaaatgagtttataattgtgaaatatacagatatatatatatatatatatatataaattcaactgctttgtgtgtctagttggtgcataaaataaaaataggaaaactaaaagcaaaactgaaaaacaaatcaaaagcccagaatagaagagtcaaagcagacctatgcatacaaatctcttaagttactggatctaatcagagtcaccaggaagaacagctttgccacttgacacacaaacactgcagggaaaggactatcagtgggcaggagccaaacctctttgccttttcagcgcatttgctttcagtgctaagcagggccccataaaaggtgagaggagcaaggagcaaaggtcatttgcaacttgtccaaatgttcttaaactccaagatggcacttagttcccacaaggggctgagtcctgcttgtgcaaagcctaggaggctgtctttcctcccagagcctttttactacctgcctgcctcttcctcttttctttctcctctccattctatgggctctaacacctccccagaagacaggcagactggcttaaggaggcagggagaggctctggggtaagtttaggagggcatgccaaagtgcttgctacacagccatttcgtatgtgccaagatcctgaaggtcaggtaggtagagtacaaaggatgggagggggcccagggagggatgctctgtaggaagtagaccctccctaatttgtgcagtagtgctggggcaggctcagttaagaagagagcagacactttgtgctgggccttctaggttactgagtgttcaaattgataaaccaagagctggtctcatgcagctttggcatctggcagaccactaacctccattccaaatgacaaggtcagaagtagtttctggggccagctacccaaagagtggctttccaatgctaaaacacctcaaatctcaagaggctcctggttctacctcctctgatgcaggaggcttcagccttgagttcccattgctcagttcactcattagacacctcaggcctaaagtaagtatttatagatcaacattttttcaaaagcctcctcttattcataaacattaaaatataattttttgttaaatgttttcaaggttttccttctaaattgttcagaactggtttcagtgttcaagttttcccctttagcatatatttttagaccctgggggaggcagtattctagcaatttataacaattagactaagccttttctatatagtacctaaaagagaaagacataaaaatggagagaatcaacaaatctcttcagagtggggctggttcactgaagcagagagcaggaagaaggagccagaaaaggatgtggatggagcagagggcttggctctggcatgaggcatgcggcatctgccctagcccccttcagtttttgtacttcgctataccacagtccacaggggctttttttctgagtctcagtcatctgccctagaatctgtagtgttaacctgaatctacaatcttgggcaaagatataggctatgaactgatgcacaaaagtcttcttgaagaactggcacctgtgatgtctcctcagcctgaagagcctggctggaatgctctaggagactgtagtagagaagtgctgcagagttcagacagctggactccatttgggctgcatgaaatcaggctggtctcatctggtcagttctaacccttttgctttttcctggatgggtttgagccacttattacaacctatttaaaatccagaggtgctgtcagctaaggaatttcctttctctgccaaacctggcagtctgttttaagttactgccttgttttatcattgtcagagcaacggaaagctgaataaagcagcagcaattcgggttgctctggttcccacgtccaatgttcatggcctctagtctgttgtgatagcactgaacagagttgtctgtacccatgctgggatcatgggcttgtttggcactgatggactgggggagatggcatttctagatctcccctgtgccttttgatatggaaatacagcaccagcagaaaggagctgtactactagagcctggctgtgaccaagagtcctcaactcactgcacaccaagggcagcagttccactggttaagacagactcaagaacaggcaagcttgggccaggatgatcatagttggaggatatacagcaatctatctgggagaggtagtagctaacaactagaacagggtagggaagactggatgtgaccttagtgacctagccccaggtatctgaaagctgttggtcagtttctggattcttcacatattcagtttaaggtaccacccacactttacaatgttcaaatacaacaaaataaaggtcacattccaggtctgagccagacacagctggtgagaatcccatgacttaaggcttttccctccaacctcctgtcaacctgaccacaaggcagaggcagcctgacagggtccctggcttccaggggaaaaaccccaccaaagctgcctgcttaaaggagactgacttgtgatgcccttatttgtggatgagggaatggggaaagaagcaagaagtgaagaaaaccctaagaagctgcagttaccaccacctgcagttttgaaatcagttctacatacaggtaagtggggggtggtggtggtggtgagggagctgcagataaaacccaagtaaaagaaaaacggcacccaaagtgctgcaatcccaaaagtaaatatctaatcagcctaggttgtcttccaaagatgagggatacccaacttggagtccatttgattggactaagtaagcctaacaggtaaaattccaagcagaccacaataaacaacttggtgtcaacctggctaggtgttgtgaaaagtatggaaaggtgtcctagaggagtgcatggggcaggttggggtggggcagtaggggccttttgtcactggaagaagcaggagttcagaaggacatatcctggatcctccagaattcctcttctgacccctcctccctctccagggaggaaccagaagcaagactaagaggatcaaaagcagagcaggcaaaaggactgcctgacagaaagctggttgcagggtttgcttttatagcacaaggaaatggatacaaatacactaaaagtccaactatgattcggcaaacagaatggggcaagatctctcacttagttctaaccattccataagagacaaacatggttttatcttaagctatcaattggaactgtcaactacggttcctgatcactaaggactggccaggaagtgctagacgatttctatgatgtttcactcttccatgattacaccgcaggaaggaagctggggaacgttaacgaaaatacacaagacaatacacactcgacagttcatggcagcagctcacatgggacgtgcctgtgggtgtttctggaagcataagactgctgtctcatttgctactttgataaggtacttctcagacagatttcgatagatatgagacatctctgtaaacacagaaaaggatataccaatatgatgaagatatgcagctagataaggacttcctgaatggaggttaaaactttgggatcccaaattaaaactgaccaattaaaaccccacagcaaagtcaagtctataaaattcaccactgtacttatggagcagagtttgaaatatgggatgtgctgatgcttcccagtccccagtgagcaagaggttaagaattccactagaaaaagacttgggatgtgtatgtttgtcagaagaagggccaagggccctggtgtcactccctgcttaggtctgcatctgtcctgacaggtcccctgcccacactaagtatgacattagatttctgagtagggtcaagggtagtgggcatggagcccctgttgggccatgcaacgactctggcaggccataggggcctctgtatctccttcagctacccaatgtgacccagattttctagtccacttttctagagtaaaaggtgaaaaggctcattgtttaaggtctgaaagccttttgacatttttcttagcaagagcaagagcttcctaccttcttgttcttcttcacagaggttagggagggctcaaaagagcccagctcttgctcaaggttaaatatgatacctggcactggcaatgggaagttaaagggcaggaagaatcctagggctgcagctgactgctgttaggtaaccatgtggttcagcactgcagctgcctggaacagaagaaacaactagaagctaggggaagaaatgaaagcatgaaatggaaggaaggaagaaatggaaggacgagagagaaagcaatcaggaagtccttataaaattgcagcaaacacttagagtttcggagcttcttgggaatcctatgtgctgagcccactttaaaacaagcgcaggtatatacagatacaggtagttctgaacactgccatgtctggtggcttgtgggacagtgtcaccatttcaagccagtttgctttcagagcatctgtttgttttgaagtgggaacatgaagactcaatagtgcaaataattctaagctgtccctaaaggagaactggaaagtaattggaagaatattttcctttcttccctcttaattactagtcagactgctctcttgttctgtggcactaggcctggcttgactccacctagcctgcctgtactttgtcctgctgcctccatggcacctctttagcattatcttctaggggagcatgccttgtgaacagatgatgacacttcactctgggccatactcttctgtggctcaggctagtttataagccatcagtttaggactcacctctagccatgtcagagctggatcagacaggtgccactttctttttttgcaaaatatccttgtcagttttggattgggttgatgtggagccagatctgtgctaccacagttggaattactgggccttaatcactggccaactccatagtcttctcccaagagtcccatagtttctcctgcatcacacctcccagtccttcagattgggagttggggtggtgtaaaagtcagggaagctattatggacagggcatcaatggcaccaaaaatgggagtgtcctctcaattgccctaacgagcacacggggcgggggtggggggggggaagagggaggatattgttggggggagtgcctggtcaacagcttgtctggtcagtagtatctgcagcaagccttgttgaaggagcctagtttagaaaagtgcaaagctacttctggccctggttaggtcttcaacctgactgtgcttgtcggtaagaaaaacatcccaatgctccaactactcccaccccgaagccacgaaactctaagtttactgaaagaaaaaaaaatattttttatttcagttaatcgggaagctttgtcagagccctacccataaggagaagagacaacagctgcctttattcttgttggtttgctttgcaatccgctctatgtaaagtcagctaactctctcggtcacgggcgtccggctgtccacaggctcctctctgtttggccttggcatggaagatgaaacaatgtctttgcgctctccctcccctcggtgtttgtacttttctgcaactgtggtagtggtggcgaccataggctgagtcttagctggctccttggggcagccatcgctttccagtgagcctcctcggggcatcttctcttctttgcagatgctgctgctcaagtcctgaggctcaggggggctgatggggtcctcagagctctcaggctcaggtgggggtggggatgggagcagtggcatgggggcctttgtggactctgagtgatggtggtgatgatggtgctccttcttaggtggggaggaggcactgctgctgcgccccttggggctgctctccttgcttttacgcccagggctcttgcaggtcttcagtcccttcccgcttttctcaccaagggtggacaccagcaggggcttcaccacttccttgacctcgatgctgaccgtctcccgggtcttgcgcttcttgatggggagcacagtctcatgcacagaccgtatggaagactccttcacggctttctttttggcctcagctgcagcagctgccaccacactcccaggctttctaccccgtttcttaggaatggcctgggggtcagcttcagcttttcgctttctgccagggcgtttgatcaccatgacctgggcagatgtggtagccccacctccctcacccttacccccaggcgatgcttggaaaggcatcttgacaacaagtttcccagggctcttctccaggacccttttcacctgaacaccttctgatgctgctgcctttggtctcccagtgccgctccctttggggcgtccccgacccctgccagttcctggagctttgggagatttgggcttcttaggtggtttctgctctctcctggaggggctccctctcccagttaccgtgaagtcaaaatcattagggtccaaggaggtgtctcccaccttttcaaagtatgcaatcaattctactttagagcgaaaagcttttccctggggactgtagaaacaaacagagagacacaaacaatagtcagaagctttttgacaacatagagactgagatagaaaatatgctgacaagctttcttctaagacattgtaagtgaacaaggaacaaactggaacacaaccgggccagatgcatgggtagaaaccatgttacagcttgctcagaagccaaaacagctggatctgaaaacagaggacctgccggccttcaagcccactcctctgtactccctggcttttccacaatccttaaactgaaggagtgaggtctagtacttgggggtcattgggctagactgaatatctttggttggtacccagacctaatccaccaccaaaacattcctccattttaaccaaggcatggtgtccagcctttttgggaagccatttcagtgcaataaagcttttccatcctagccttcctacccacctggccttcttgttctatagacacaagacttgctcttacttacttgatcaaatatacatcatactttccagcagatcggccagacttcctttgtttaagctttcgtgtccaaccttcaggcaaggtggggtcatcatacataggtccccggtcacggataatggagcgccgctgtttgggggaagccgaggcttctggcactgctggggcagagcctgagctttctgatgtttctgctttgcctgcctctgctggctctgcagaatggtgggctgaaggttgtagtggctcatgcttgccttctttgtcctccttcttgtctttcttcgccttcttaaacttcagtggcttgtctctgaggccctggagatcctggtcttctgacttttcctccctgaagtattaaacaaatatgtaagtattacagagaacacagctgtctgcacagtagtgagtataggtgagcttgagtgccacacatgagacccctggctgctgcatactatctctgattttggtaacttccctaggatactgtatccttgggtcaagctggggcccaaagatttcttaacagctttaggttgctggtgatattggtcaaacatatttgacctttatcatacttctctaaaccctagttctagtgctgttaaagtggcacattttttttctggaatgtaagcactgtatggttggcttcttaacatacagaagtcagtttataagttgcacccaatggccccctgggcttgccacatgacaagacaaaaacacataagataaataaaataatagggcaaagccagaagagggcatcggaccccttgggactgaagttacagatggttgtgacccgccatggattggtgggactgaatccagggcttctggaagagcagctggcactgttaacttgtgagccttcgttccagcctcctgactttccaattcaaaacaagggccccagcaagagatttcagcggtgtaacccaatttcctcatcccaacagcagctaatctcatccctgaggcattccgtgagaattatggacaaaaggcctcaaaatactgtaaaactattgctaactcagggaaatagcaactgctgcctagggttccagtatgagaaaaaaggtatcttgggtcacatgggtctttaccacaagatattactcccccccaaaaaaccctaaatgccaaaaccaaaactaaaccaaactggagggtggggaacaaaaccaaaaccaaaaccaaaaaccctatccttagcagaaaggtgtaatagaacagtgtataggccattagcaactaccatatccaaggacacctgcctattctttcttgtagacagaaatagcctccttctatgggttttggttcttttttggggttccttcatgtactttagggttcaaagcctgtcttggatgcttttaattaccactgtagtgcgacacagtgagcctttctctgactagaatctggtcacactgcactgcccctctgagctacaggccagactaaggaaggtttggaaagaagtagcagctgcctattggtctaaaactaagagaagaattaggttagggctatgatgtgcatctggaagcctgtggtctgttcacagttcaatcttcagactggcttattcagaagctctcagtgacagaagaaaagaaggggatactcaccagcaaagctggcaaaacaaaggccaacaggtacccatcatgtgcatataacttcacaggccccttttgaacaccagggctgctcccctgattctgaacttgagtttgagaaaactactagagtaacaaggcaggctggctttggaattctcacttgtattcttaaatattttaaccaccatcaaatataaactatatgagcaaaggaacaccttctagaaaatctaacaaccaaggcataaaataattttcattacagttttattttcagtagttaagaatgcaggcctctcaggtcctcatgaccaaggagacttggagaatcaactacgggatgcctacatattggaaggttgtgcagctagatgagtatcatgatcttttttgatgtaacaaacaaaacaaaacaaaacaaaacaaatcaaatcaaagcaaaacaaactgcagacacatttcccatatggatcaggtgtacaggattgtaggctagcctagaaaattaacaaagtctagagtaggtgaaaactaggtaagagctcttgttgaacacttctcggaatatatttttgactaatgaatcacataaatacttacacaactaaaaagtaacaaaactataatataatgcatgcaaacaggaacaaaggagcttaactgttactatacaaaaaagactaacttttgatcatagtacttctgtggtgggatatattccaaagtcaacagtaatattctaggggcagtatatacactaaaccagctcaaagataaaattggtgactctgattctggggcatcctctagtgccagtaaagctagggatgggagtacaaaaacagtgggtgggggagggggagtcaagaaaaacttttagcaatagcctaggcatggccaagtatgtaggcagtaatgaatttgagatctgtatagcagagtaatcaacaaggcagaactaagttaattgtgggcagaccgcagtgcccacctaaaaatgctgaaccaaataaatatcgtagagaagacaaggaaggaaggactatacagactaaagaataagaagactgaggagaaagaacattcgaacctaacacacaatcctggactggattctagttttaaagacacacagagcattaatgagacatttggggaaatgtgaataatgctttacattagcttattactaaacttccggactgttgtagttatgctgtgtgctattaggaaagtcagcttcaaatatttatacctgaacatcaagatgacttccaactctcaaggggattcaggggtggaagggatatgtatagtgtcaatgttataacatgttttaaaagaggaaatgacatcaatatcatcagaaaccctactagtttatggcaattaaaatcttttgaaacagagtctctttattatgcagtcctggtggttctggaactcactatgtagatcaggctggctactaacacacagaaatccccttgcctatgtcttccaagtgctgggattaaagtgtacaccacccgatggaagttttttttatggttatgctaggcagtgctctaccactgagtcatatccttagctctaagagtagtattttcaagaagtaataagcaagcttttaagaaagagtaactttgtgttacaagaaaacaatactagatcaggctgcatattacatacatgatgaattctaggctagctagcactacatatccatacccagttagtcatttttcttgttagttttgttttcccaaacagggtctcattatgtagctcttgctgtcctggaatgaaatacgtagaccaggctggctttgaactcacacagattcacctttgtcttccaagtgctgggattaaaggtctgcacagattgatttttttttttttaagcataacaaaaagaaacacctggaaaccttgatgaagcactttcttttagtagctcaaactgccataatgcctaaccacaacactacactgtatttggtgaagctccaacatggggataaaacaaatataaagctacagttttcatgtttaagaaaaaaagcactgccaaaggtagcctagtctgggctccaagaacttgcctgcccaggagcaaatgacatccaggatcttttgaagctacatgagaaagcgagcaggctggttatggtgagaagggatagttgcaatgtgcaagatagggtctcacaaagtccaggttagcctggaactcttgagtcccactcgccccccaagtgctgggattacaggtatataccatgtccagctttgcagccattttttaaaatgcttgtatgtgttggggtgtatgtgtgtgtgcattagcacatgaatgtgaaagccagaagacaattttgagtgtcatcttcaaggatgccacctacctcctctggggtctcttactggcctggaactcatcagttaggctactctggctggtcactgagtcccagggatcatcctttcttcacctccccagtgctgggggtttcaagggtgtggcatcacatccagcttgtcacatccaccatgtcagttaagaaacaacaacaataaaatcccactcctatgagtgatgacatgcacctgtatgtaatcctagcacttgggaggcagagacagaatgactagaagttcaaggcaatccttgactacacagtgggtttgagactgggctgcctcaaatcaacaaaactgtaacaaaacaacacaaaaagttctgtagtgaaaaagtcttgacaactctgaggccaaaatgttacatataaagttcctatggcctagcaattccattttgaagtacagattccaaaaaactgacaataggcctgcaatcagatacttatatgctaatgtttgcagctccctgacccctaagaatcaaaaggtgggagcaatccaagtgtctactgatggatgaatggagaaaaacctctcacgacaacgaaatgttgtttaacgttaaaacagaaaggaattctgatacagtataacatggacgagtctcaagaaaacattctggccgggcagtagtggagcacacctttaatcccagcacttgggacatctacagagtgagttccaggacagccagggctacacagagaaaccctgtcttggaacaagcaaatccatagtaacagaaagtcatttgccagggctgtgggtaataaggaatgattacaaatggatatgagagtctgcccccccccccagagtggtgggagatgaaaatgtttgggaattgctatatatgatggttccacaacactgcaaacatacttgatgccattgaattgtatactatattcatttattttttgcagtgttggggattgaactcaggctttatttgtgatgggcaagtgctccaccagtagctaaattcttagctcttttaaaaaatttttatgttgagatagggtcttacaaaaagttttcaacgcaggtttctgtagcccagacaggccttgatgtgtaattcttttgtctcagccttcagagtagctgggattaccatcctgtgccactagactcagactaaactatattttttatgtatgtttgcacgtgtgaatatatatccataacatgatgatcttgaatttttgatcttcttgacttcatctcctgagtgctgggatacaggtgtatgccaccgtgtcctatttatatggtgctgaagattaaaatcaggactttatacatgccaggaaaaatactctactaattgagccatattcccagtcacatttttttttaaaaaaaaaaaacagattcttgctatgctttaaagacaggttaaccgcaatttatgatcctcctgcttctgcctcccaagtgctgatacaataggtatctactaccattgcagggcccccagaaaggaatttagttcaagaagcttcacaactaggggttttggtcaggttatagattattagctaaatatcctgagggtagttcattatgacaaaaactgtggtaaaataaacacaagcataaagcttaccattagttgcatctagcaatcattactactatctagctcctgcatattttggtaactctcaaaggaaaccctgtattcataggtagttgctaactttctaattcccttcagtccttgacaactacttatctttttctgttactgaattggcctattatgtatttcattattcacagtggcatcataaattttgtggccctttgtgactcatggctcttttctttcataaagcataatgtctttagagtatcatggattagaattttattcctgtttgtttgatttttttaaaagacagggttcctttatatagtcttggctgtcttggaattctgtagcccaggctgtccttgaactcatagacatctgcttgcctttgcatgttggtgatgggagtggaggtatacagattcaggaagctcattgataaaccatgtttcaactgagaaaggcagaagaaagtgacagagcaggacacctgatattctcttctagcttctacacatgtactcagggctacacagacctgcacacctacacaaacataaacaaaccatctatatacaatttaaaaaattccctgattatccattacactggctattaggaatagtgtttctatgaaatattcacatacaagttttatgtgaacatacattttagttctcttctacctataaacctaggagtgattactacagtacatggttactcttatgtttaaccttctgagaagctgccagactgcttttcctttagaggtacttcaaatgttctggaactagatagaagtaaagtggggtggcagaaatgcttcttgaatgctcagtagctagtggtgggtttaaatagaagtgatcctagaaccagggtatggtagtacatgccagtagtgtaagacttttaggaacattatgtgttgcttcatctcactcactcatgcattatccaatgtcccttaaacatcaatgtatcttgttcatgcttacacttgggccatcaataagactctacctgcataaagcatctgttgctgctttttctgatatggttggtattccaaaataaaagctttggtaaacataaaagatagatgccaggagctagggaagactcatcaagtagccagaaaggctccagaacaggggtaaaatggctactctaggactcactgggaaatcaggccaagattacaaacttggtaaaggcaaaagattcaggtagggtgtctttcccacagactgacctcataaatgagataagagggaaaatgtcagaatcactgtttatacaaacattttccattcattcattcattcattcattcactcactcattcattccttcttttgagattcagattcaggaagctcattgataaaccatgtttcaagggagaaaggcagaagaaagtgacagagcagggcacctgatattctcttctagcttttgagaagcctatattataagcaacttctgtttcctcactttcctttgggcctttgattctgtgttctaacaggtttctcctcctcttcttgtagttcagagactgaggaaaaggaggtccagtgacccgcccaaatttggatccatctctaggggaagctccaaggcctgacactattactgatactatggtgtgcttacagacaggagcctagcatggctgccctctaagaggcccaaaaagcatcagactgagacagatgcagatatttttttttcgagatagggtctctctgtgtagccctggctgtcctggaactcactctgtagaccaggctggcctcgaactcagaaatccgcctgcctctgcctcctgagtgctgggattaaaggcatgagccaccacacccagctcagatgcagattcttacacccaaccaatgaactgaagtcagggtctcctgtaagggagaggctggaagaagttcaggaggagggtagccccataggaagaccagcagtctcaactaacctggactccagagatctctcaagacactgagccactgaccaggcagcatacagcagctgatatgaggaccccaacacatatacagcagaggactcctggtctggcctcagtgagagaagatgcacctaaccctcaagacttgaggccccagggagtggggaggcctgatggggtagggacatcctcttggagacgggggaggaggaatgggatgaggaactgtaggaaggaggatcgggagggggataaaaactggactgtaaaaaaaaagattaaagataataaataataacaaatgtatttatacatatgcccatgtttgggtttgtgcatgtgtggctggaactggattctctggagctggggttacaggagacaaaatctgcctaatgtgagtgctataaattgaagtcttgtcctctgcaagagcagcaagctctcttaactgctaagccatctccccaaccctcttcttggtattttaaagacaagagtctctttaaccctaaccctaaaatcactcagtaagtagacacactctaagtccttttgccaatctgatctggggcagctgtccttgcctctgcaactctgcttgcaggaaacactgggcagaactttggctttggagctcatctttctggcagcctgcccactcctcttatcaggtgagggaacgatggcagagcctgatccacatccttgcacaggagttcttttttttttttccattttgatagctacacagtctttattataatcattcaacttatgagctgtagcagagacatagacaaaaacaatgcataaagaaatggatgagctgagttctagtagaattttatatgcaaaaaacaagcagtggcaggccaggtatggtgacacataactataattccagcactctggagattgaggcagcaagatcagaggttagaggccaatctgggctatgtagcaagactgtcacaaataaaccaaatcaaatcaggcagtgagccagagctaactctagggatgtggttcaccagctgctatgttaattgaagagaagctacgtaaacaagcaactggtattttcagtgattatagaagttatttggcctccactcaaactcctaaggtagagcgagaagttctccaaacacaaaatgttacctggagactgtggagtcacagaagaggtacaagataacagttttctaaagaactgaacataatgtcaaaaaaagacgacttgttactggccataacaatgtgaaggtccactggagactgataaggccaattcatggaacacaggagtgtttatatgtctttataaagttgattacaggaggtgagggacccaattataggaggtgagggaagggtccatgaacagagaatgctgggagagtttgattaaaaggggacagagtagagattagacagaggctaaagaaggtttgcatagctaagcaggaaattctaaaacacatttttatggtgataagtgtgattcatgagaggagagaatacaaatgaagtcccagggacatggaagagcagtagacaccacaagccggacagacaggaaatccttgtcatcatgaggtctgcattaggctctatgggtggaacaggttttagttatgacaaagtccagtccttgagtatgaggatgtgtgcctgaggtcactggaatggaggtggtcaaggagatggaaagtctgacactaggaaggttgtcaacatgttcaatatagtcaccttcaggatgagaggggctgagacaaagagatagaagctatgggtgtaaaaatgttctgtttctaaagtacacaggataggaaacaatcaaccagctgctgttggaagaggggcaaatttggcatgaggtgtgggtgtacagagaaaagggactctaacctgaatagggaagagtctagaaagaaaagcaagattcacactagaggggccttgggtttaaagcaggggagagatcaatctgactacagagattgtgtgaaagccaggtatctataggaaagcttacaaggtcacaggaaccctcaagagggtgtttggttcaggacagtggtagaagggctcaagggaaagatgggaaaaagagaaggacagtatggcacagcttggcagctccctaaatattggtactgtagggataggcagaagagtgtccagcctggcggactgaaagcagagcacatgtcatctggttgtgtggtcttatttacccagtttgttctgaagaagcctggtgggtcgtagggcaggcagtgagttgagaagaggcagaagagtacaaaacaaaaacaaccccaaaccaaagctttatcaggtactatttttgggccaaggaagggcacaaggaggaggggaaaaaaaaaccagaaggtagtgggggagagagataacaggcatacaacatacacctatgtgaaaatatcataaagaaaactcattattttgtaaaattaatatatgctaataaaaatattggtaaaatctgacaaaatgcatacttcatgttagcctctttctaccatagagtcaaacaagtccttggtaatttctttcagtgttctctatgactacctaatgggatgtctgctgaaacccaagcctgtttagggactgacaagaggctgaggatgacagcaaggcccatgactgttttatgtaaggtcacaagtagttatcaaccaattgcaaggactggtatcactatattaggttctttcaccatgatgctattgagctactacatgttggtaatgatataggcagaaaggagcccttataaacttgtcataattggggtttctactgctatgaaatttattgcactgtgctacgcaatgtttagactaagattttttgattacaatttctaaaaatatgatagttaatgagttaattcattagaatggtaatttcttctaaaatgtcttaggttcttaaatgtttaaagatatccttgcatatacatgcaacaccacaccaaaaaaaaaaaaacaacaaaaaacccaaccctttctctagtctagaaagatgggtgtaatagctagaacactatcctggtgaggtaatacacctactgaggggctttactttgtaaactactagtggcctaggaaacctatctctagatatcatggtacatgaaagataagtgcaatatcaactccaaattctgtttttaggctaagtagacaatggagaaatatcttaaaaatttaattacatgtacctctttctttcttttcttttttttggagacagggtctctacatagctctgctatgtagaccaggctgcctctaattcacaaagatccatttgcctctgcctcccacttgctgggattaaaggcatgccaaccaccaggcctggcaattatgtgtgtatctgtgtggggaatgtgtaattgagtagaagtacccatggaggccagaggtatcatttgcccctttctctagcttgagttataggaagttgtaagctacccagcagggtgtttagaatcaaactcaggtcctctgaagaacagcaagtgctttaatgactgaaccatctgtcttagttgcttttataatgctgtgacaaaacaccatgaacaatgcaattaataaaatagtgtttagttggcttatagtttcagaagattagagttcatgatggtggagcagggcacagtggcaaggacatctgaaagctaacatcttgttctacatattagaggcagaaaggactctaccttcctaaaaccataagttccaaattaaatgctttctttataagttgccttgttcctggtgttttaccacaggaacaaaaaataagacataatttctattagccaattcccctcattttttgagacaaggtctcactacacagcttatctcacctagaactatgtggaccagtctggctttgaattcacaaagatccacttgccacagcttttagagagctggagttacagacatgtactactatgtctagcaagggaattctttaaaaatttacgtgtatggctgttttgcctacatgtatgtctgctcattcctacaatacaaatgagatatcaagatgaacagaaacaaaacaaaagatgggaatgatagaccgtatgtgagatttatttgaaatattgcttttccactaagatatcacaattactataattcaacccactggaaaaaaaatgacaagtgggattggctcagtagttaaaagtattttctgctcttatagaactgaactacctgagtttggttcccagcacccatgttggatggctcataaccatctgtaactccagctccaagggatctgatgctctcttatgatatctgtgagcacccacaatcatgtgggatatattcacatagacacatatacatagattaaagcaaaacaaataaaaaactgataaagttaaagatttttcttcctatatattatcaaaaaaaaaaaacccaaatcagcttttgaattggttcttagtgaatccaagaaacaaaacaaagataattcagattgtactgtataaacattatgtctcctaggaagtaaccttacagcatcattattcgaagaaaatgtgctttactaaaaaactataaaaagtttaaacctattaataccaaactcttccttttcaattttatcagaacaaaactaaacgtgtttaaattgctgagactcagcaagttcatttagccacagaaaacacacttccaagctacagcagtcacctacaaatgaaggaaagcagctgaagccttgtgattgagcctggaaaccaagcacaggtaacatacttacttacttagatgcaatggccagattttaaggaatgagacagaatttctgcctttcctttttcccttagacatcctgggagtctctatcaaatactttcttttcattgactagttgttgggtacctcaacacacgggccctcctatataggggaagcgaagggaagacacctgtgcacttttgtgctcaaggaacacattaaacatgaaggaaggcagaacaatgtgccaggaaggggcagtaagaaatgcctacaggggttagccagaacccaggcagagtggcaaattccctagtattggagctgggggtagtgccagtctctgtgcattcatcatttcctaaagttccctctagtgaaacagaaaaccacagaggctattctcatgggtactttaaatggtacatctgttggcaaaacacaaatgttgttaaacaaatatgaagttacagattgcacaggcacctgatagcctttaaaattcatgtctcttgttttgcaaagctgaactgagaaactgtgctgttaaatcatacacttatatttaaaaggaggaagaatgtgtggatgctacttagattctcattgatttattttgctttgggtgactacaactccccccaaaataaccccaaactcacatattttcccttttctgtgcacctctgacaggtttgattagctcatgaatagttggccacccaaaagttgatgaactaatagcagtgcaggctgttttattctgtccagcttattttaagacaaaaaccttagggcaaagtcccaatgcagaactattcatctgctaagtagttatgtctgagtctaggtactagagatatgtagcagtatctgtatactccaatcctctgtcttcatggggcttagactgtagtatggggaggagagtacaaacaaaaatattcagcttgtagcagatgtcgacaaatatcaggattggcagtgaaggggtggagaaagaagactttgacctagaagaacgtggccagagagggtcatagtagaagtgatccttgaatagacttgaaaaaaaccccggggctggtgagatggctcagtagttaagagccccgacctgctcttccaacggtcctgagttcaaatcccagcaaccacatggtggctcacaaccacccataacgaaatctgatgccatcttctggagtgtctgaagacagccacagtgtacttacatataataaataaataaacaaataattaaaaaaaaaaagccgggtgtggcggcgcacacctttaatcccagcactcgggaggcagaggcaggaggatttctgagttcgaggccagcctggtctacaaagtgagttccaggacagccagagctagacagagaaaccctgtctcgaaaaaccaaaaaaaaaaaaagaaaaaaaccccacaagctatatgtgtgataccaggaacagaagacagcgcggggtgtgtgtgtgtgtgtgtgtgtgtgtgtgtgtgtgtgtgtgtgtgtgtgtgtgtgtgtcaaggacctaaaacagattcttttctttatcaaacagggatgtgtcagggtggatccaggaagcccttgttactttcctgaccctgatgcagcagatgaatgactacattagacaccagccattgttctagctaaatgcttgggacatatcatgaatcaagtggacagctctgccttaaagtagcatatgctacaatgggctgatagtccaagtaagcactgtcagctacatagtgttaaaaaatgacaaaagctatggttggaggaaaagaagcccagtcatggtaggctccatgagaaggtagagattcatgcagatactcagaaaggcactgacttctatagacattagatcaaatggtgctgaaatgtcctagaaaaggatcagcaaaactggaactgtattgaacaatatgaaggtcattattgatgaacccttactgtgtagcatgccctagctttggcagcaaagagcttaggaaagtatggagagagacatagtgtcactggaaaggaaaagggaagtggtgaagctagaagggagcaggagccagaaacagtgccactgaggtggaagaagtaggaacagatttctagggaactgggaggagggcctgatatcagagagctctagagacacatcttgaaacagaagcaagagtgcagagctgggtctctcacatcataagggagaatgtttgagagcatgagggtgcaatgctagtctgtgggcattctctttggactgtttccctgctctctggaaactaacacagcagttaccagacaagagtgggtatgacagcctgttataaatgataggaagtatcccttttccccaactttacttcttcactctttggccaaagccttgaccctgagctgatggatccaattcctgagaggtgactgaactatgagagctctgatggattcataacttgacaacattactgggaggcagaagaaatgttattaggtatgatctagctagaagaattaggtcactgagggcatgtcttggagagatgtattttgtcctctactcggagctttcccctgcctcctggccactgtgaagaagagcttctctaacaatcttctatcaccacaggtccagaaacaatggagccaactgactatgaagggagactttggaaagtgagccaaaatacaatcctcctttaagttttcctcatatatttgtcatagtgctgtatagacagacatggccaaaggagatggaacaaatagagacacggggaactggagtatacctgtcaaagaaaggtgaacatgaggttcatctggagtgtattaaagagtaatcatattcattgtgtgtagagcagacaagggagataactgaacttcgccaaagctggtgctttattgaccaagtacaaacaaatgaccatggcattgaaactggggagatgagtgggaggtatggtcagattaaagatgcaagcaaatatgaattataagtatccccaaggtaatgagcatattggaattggacattacaggcagtaaacttgaaacacaaaagaggatctctgcttttgcagatacaagatttgaaagcgagtgcaatggctcagcaggtaaaacacttagtgtgatacacatgcatgtatgcatatacaaaataaaatgaagtgaaaagaaaaaaataacatgaactgggctaaattttctgatacttgaactagcactagtcactatgaatgcttgagaaagaatataaagatgtggttaatacagagcaaatgcagattttaaaagcctttgacagggacagaaggaaagcttagggtaacagtacttgttgctcttgcagaagacccagactcgggtgggtaggggattgggggtgggtgggtatgggggacttttggtatagcattggaaatgtaaatgagctaaatacctaatacaaaatggaaaaaaaagacccagactcaatttccagcacccatatggtagattataagtatctattaactccagcttcaggggatcctatgccttcttttttggatctccacaggcactattctcagacatggtacacatacatatgttaggtcttaggtagtctatgcctagaaatgagctcagaatggattatagacagatttctggtgattagctaaaacccagcattcctaaggaacttgtgaaataggttctcatcctccccccacaaaggagtaactctcttgtgtgttgctttatataagaatagctttcatgggctcatatatttgaatgcttagtcaccaggaagtgatactacttgagagggattatgaggtgtaattgttggaagatatggccttattggagggagtttgtagctgggggtaggtaggcttttaggtttaaaaagcccaggcaaggcctcctagtctcacttggcccatagatcaggatgtagcttttaactactttttcagcactacacatgcctgcagccatgcttcctgccaccataataatggactaagattctgaaactgcaagcaagctcccaattagatgcttttctgtgtaagagtcatggtatctcttcacagcaagaaaataatgactaatatgatttgtctcagtggagagccatgccctttctgctagaggctaactgtttaagtgtatttgcaacctggcccgtcaccctaagaaatttaagtgcagacatcccaaaaggaagaaatctccaacaaagaccgtaagagacctacaaactatcaagaaaggtatacttagcaaacttcctctatgtgaagctcatcttttctggcctctgagggttaactagactgcttcctcctaaactggagtctgtcaacctgccctgccctccacagaactcctgcctccagactccctttgtagagagaccatgtagactccatactccaaccccagaggctcttcagggcaggattggaggctcagagaatcagtatcatatagactccaattctgtccctagagaaagcagaaaatattttagagaaatcccacaagagaatcatatacaacgaggaaacatgataaaagtgttcagaaattaaaaataggttaggtacaacacatgtgctgtacagtgttttccagtatgccatcatttcccagaagagaagtctataatgacccaaaagtccattcacaggaactgccaggctgaaaaagtgctgcctcacctatacaagggagttggcaatgggaagaatgaaaatatagcttcttaaagcccgaagaaaagatcactatgctgatggggtgtgggaagaataagtgaaaataaactggaaaaaaaactgagcacagtgttcacccatcaatcaatcaatcaatcaatcagattatcttcctttaattttggaggttgaacttagagtcttatacattttttaaaaaaaagattttattttattattatatctaagtacattgtagctgtcttcagacacaccaaaagagggcgtcagatctcattacgggtggttgtgagccaccatgtggttgctggaatttgaactcaggacctttggaagagcagccagtgctcttaactgctgagccatctcttcagccttcttatacatttttaatgcatcacaaaaatcacttcattcctgtcctggctagttttaatgtcagcttgattcaagctagagtcatctgagaggagggaactcattaagaaaatacctcccagctgggcgtggtggcccacgcctttaatcccagcacttgggaggcagaggaaggcggatttctgagtttgaggccagcctggtctacagagtgagttccaggacagccagggctacacagagaaaccctgtctcaaaaaataaaaaacaaacaaacaaaaaacaaaaccaaaaaccaaaaaaacctccctaagatccagagaagggcattttcttaattagtgattgatggggaaggaccagcccattgtaggttgtgtcattcattcctgggctggtggttctgggttctataaggaagcagcaggctgagcaagccaggaggagcaagccaataaacagcacccactcaaggcctctgaatcagctcctgcctccaggttcttgccctgtctcagtttctgtcctagcttcctttgatgatagatgtgtggatatgaactaaataaacaccttcttccccaagtttctttttggtcgtggggtttcattttagcaacagaaaccctaagacaatccacaaacactttagcattcatgtcattatttaatgctgaaatttttattttcattttaagttaaaacttaaactcactgaggtgtataaaaatcaagtgtaccatctaatgacttttgctaagtgtatgcagctgtgtaacagacactcctaccaagacataagacaaacacaacaatgggaagttccctggcatctttcttgccacccctactcaatattatcagcaacatttggtgttgtcagggattttttttttttttttttggtttttcgagacagggtttctctgtgtagtcctggctgtcctggaactcactctgtagaccaggctggcctcgaaatcagaaatccacctgcctctgcctcccaagtgctgggagtaaaggcgtgcgccatcactgcccagctgttgtcagggatttttgtttgggaatcaaacctatagtatcacacatgtcaggccagcactctaccactaagcaaaaaagcccagcccttattatcagtttttaattttgatcattccagtggaggtacagaggcatttcagtgtgcttataatctacatttcactaattcctatgttatgattcaaatatattcctttcatgaagtatccattacgttttccttaactgtttgccacatttgccatgcaggtaagcaatgaggataagagttcagattccccgaagctcacataaaatgccaggtgggtgtggtagaagaaggtgtgtgatactgccacctggccatgttttattgttttaaaattttacttaaagctgttaattttccttctaagtgatattttgtgcatatcccacaaatcttacattatcttttctaatttttgtgttttttcctgactcatgagtaacttaggaatgtgttaattttcaaatatctgaggctttttctatgtcttatagttacaattcgcaatttaatttcactctgattagagaatacaatcaaaattcaaattaataagacttgttttacagtccagtaaagaataaggtctttacctttattaccctttggtaataatgggtactctgtagtcaatgaatttattactctgtaaactgtaattagattaagggtgactggtaatgttaagaccttttatatgctcactgaatttttctcgcagttctaccaattaccaagatgggaattaaaattcccaagcagaattattgtgggtttatatactttctttaatcttcataattttcttccatttttgtagctctgtacttgaacatatatacattcataaatgttaatgtcttcataataaattgacccttatcattttaaaacacatccttttttttcagtactggtattgaaccagggcttagcacatgctaaggaagtgtcctaccatattcccagctcttaaaatatgtcttgttatctatgttaactaagtctacttttttcatattattattgtcaccccaacattcctttacttgtggatagcattacactttaaatctcattttgtcatattaaaattatcttgaggctggagagatgactcagcagttaagagtttgtccagctcttccgaaggattcagttcagttcccaatatccatattgggtggcttgtaactacctataccttatttttttcttcctttaagataaggtctcactatgtatacctgactgccctggaacccaatacgtagactaggttggccttgaattcagagagccacttgactctgcctcctgagtgctggtattaaaactacatgcatcaccttgtctggccttgggtcttgctttttaatgtactctataatctgcttcttgccagaaatgttcagtctatttatgcttaatgtgactggtaatatgaatggatctagaactactgatttgttccatcattgcagacatggtttactttttcttttatgtcttgataatagctactctgaaatctttctctgctgattccagtatctcggctgtcttggggtgggtctcaatgactatattttcttttgaacaaaggtgagcagaatatggcctacaggcttaattggacccagtgactttttttgtaaaattattttttttgctacagctatatccatgcttttgcatctacaatagtgagttgtgtaagctgcaacaaatcaaatgagctaaaaataactgtttatgggaaaaatgttgactcctgcttgagtaacagttacatttcccctttttttcttgcctaaacatagatgcactttcctattctacagaaatgtgttatattctaataaagaagtctgatttctattttcttgtcacatctgtgtatgatgtacatgtgtgtattggtgtctgcatgggtttgagtgtgtgtatgcaattgtgtaacggtctaaggttgatgctgggaaccgtcctccattgctctcctaccttattcattgaggcaaggtctcttgataaaaatccagaacccatggatatagctaatctggctattctgtcttcccagtctgagataaccagcagccatacccacctggcctttacatgggtataggagaactcaaagcactttaaatactaaactatctctccagcccaagcattctagtttttaaattttagtagttatcgtggttcaactcatacttcaaactgtcttaccttggtaggcaacaaagagctgagactcttcagtttttctgccttacctaaagtttggtggagtctatgtgaaggaagaattggagcctcttgcttctggctgattcctaccctcagatcctaagaatggtagctactctgaattctgatttctcaatccaagactctgtgcttctatccaagaaagcttgtctgatgagtgaatactgactggacagttatcatgtaagtagtcaatataaagagaaaattcattccaatgaagtttccttcttcaaatgatccacttggcatcagcttctgtgtgtttctgattattctccagtgccctaagtagttattttaaatttctgtgacttttttttttgagatagaacctcatgtatctcaggctgcccttgaatttattagggtagctaaggacaagcctaaacttcagatccttttgcctctatctcctgtgtaccatgatgatacctatgtatcactgtacctagtgtgatggccattcttggttgtcaacttgactatatctagaaataatcaaaacccaagaccctctgtacatatgtgaaggattttttaaataagttatttgaagtaggaagacctacttgttatgttttataaaaaaaataaagaggaaggaatatgtttggtagaggcgaggtatggtgtggggtaagaccttgcctctgtgggcccacgctgaggcattccttctcttgaaggacctggaataagatagaatagtttattcaggcactggggaggggaattgagagaaaggcagggggtagtagaggctggccatgagcacgtggagagggaggagaggaatgggaagatagggggagcagaagcaagaggagagagcaagagagagaggagggggcaagcagcctcttttatagtgagtcaggcacacctggctgttgccaggtaactggaacagagcctagactaaatgtcaacactacttgtaatctgtattttttgaggtttagggaagatccacctttagtctggccccactttctgttagctgcctatataaagaacaggaaagaaggaaacttaactctctttactgtttgctttctctctgtggctggcaagtccattccttcactggcattaaacttacttctatggaattctgcataaactaataaccagtggagaaacatcaagtgtcatggatttaacaactactggattcttggaacttctgttggtaaacagccattgttggaccagcaagaccagtctgtaagacattctaataaattttatacacacatacatatacatgtgtgtgtgtgtgtgtgtgtgtatgtatatgcatatatatatatgaatatgagttttgagtatttgtttaaaaaaaagtagagcaaaatgggctactttgccactaactctcaagagtttacctcaaaaaaaaaaaaaaaaaaaaaaaagagttaatctcatccgagtaagtagtttaagtagtttctccaccctcagcagaagatgtactcccaaccccaaaacctgaattattgcattttctgcctttgactgtgaaaattgatccttcactgactgctaaaccagcagtgatttttctctgaagaaaatactgataatactatgtccttcagggcccaccaatagttgcctctagacctataagtaaactaaggggtaagtaggctcctaaaggggagacagaaagtgtactccatgaggaggtgtactacactactaaagaacttaatgtgtttgctaattcatccaagcagaattctgggaaatatgtgtaggaatggattctaggggtgtgggttaataggtcaggcagcatttactgatttggggaccatcaagtgaagattctaggttagatatggaagactgcacagttagatttgtcaaaagatggcctactgaaaaaggagttgggagatgcctgatatcccttggcttagcattgatgacgggattttaaggttcagggaatttgcaatgctagagtgggtatgctatgtaaaacctaatccttcataatgggaaggcccagaagatatacacttcactgatcctataagacaaaaaatggagagaggggtacaacacatctgaagagctttgttgttgcccatttccttatgccagatcttcaggttagagacattgttgctcatttggattaattaaatgtggtgggtttaattgggccccaaagttgtagggaccagatgggagcactgaattgccaaaggtaaagtgatcatagttatcataactggcagcatagacaccaaggtcagccttggtgaatggaagtccatgttgttgagcctaagcataacccccatctctcccaccatagccactttgctcatgtgtccattgagtaaggacagggatggctgtggaaagagactgactgcccacagaacagggcatactatctacttgcttgattattgagctcctcttctgctgaagtcaccttttgatgagcatttacatgggatacaatatcttcacatgcttccatttggagagatctatccacatctttctcacatggctttctcaccaattttccaatcatgttctttccaagttcctgactattgagtcagtccatcagctcaatccatgaatccactaacaatcacatatctggacatttctccttccaaacaaaatggatggccatgtgtactgccccgagttctgcccaccgtgaagatttctcttcactggggtctttcagggttgtcccagaaagggactgtaaagctgcagctgtccacttctgggtgctgcctgcataatgtgcagaaccatcagtaaaccaagtcctggtgtactcaggtgctaataatagattgatgttgtgcatgtcctactttatgacttggtgggtccatgatgggcaatttaggtcgaatggaaacttggtagtccattgtcaaatgttcagtttccactacagtccaatagcatgcccagagctgtctttcaaagggagagtgtttgtctgcagatgatggtagagccttgcatcgaattcccaaaggtctcttctgccaaagactggatccagacttcatctctatgtgccagtgatacacaagtaccatcaggtctgctagatcatatagtccaagtggtagagtagcctgctcaagcaatttggacctgttgaagagccttctattccagggcccactcaaagctagcagctttctgagttagttggtatatgggctggagcaacccacccaagtgaggagtatgctgtctctagaatccacataagcctaccaaaaatcggcttttacatggtgatggcagggacagatgcaataacttactcttttctttagaatgactatttctgcattcccacattatttgactcctaataatcttattgatgaaaaaggcccttggatttggttggatttatttcccattctcagatgcacatgtgtgttaccaacaagtccaaggtggttgctacctcctgctcactttgtccaaccaacatggtaaagtaatgtgtattttgtggaagagagagaagatcaaggtcccttcaaaataagttatgacacagggctggagagttaatatacctttgaggtaaaactaaaagtatattggcaaggtcagccaactgaaagcaaattgcttctggtagtctttatggacaggtaacaaaaaagggcatttgctctactaatatctgtataccatgttcaagcacttttcaagtccttggtggcactaatttctgcaattcccccagggatgtgttataatttttaactcattgttcccctggcagagacaactctaaaggctcccatttagcttttccaaccataatagccctcaatgcacagatcagggaaccaacgtgagaattttaccaacttttaagtatatctatcccaattgaggctggggaaataaccacaggatgaattcagggacctgctagacctattgtatgtcagacttcaccaaaactccataaattatttgacatccccaagcccttactttaactggaaggacatgatgcttcttggggtctccccaaatcagagtcagtatcaaggttcttccttgggataacttggccatcccttccttcagggagttctgggtctgcataccgtctcaagtctggaaattgggttgtggtacaagactcccttttgctaccatcaaatatataggctatgtttgaagttttttttcccacttatatagatcaaacaaaaattcaataggcttatctatttcatgtctagaaacaccatgactaagtaaattagacagtaccaaaagttcatacaagtcatgccactataaaactcactacagctgaatgtcagatctgccaacagcaagaccaacactgagccccaggtatggcaccattccttggggtgaccagccagcaacctggtggcaggctaactacattggaccacttcctccgtggaaagggcaatattttattcttactggagtagatactcttattctggtcatggatttgcctttcttacacgtaatgacaaaaccaccatccgtggacttacagaatgccttatctatcctcatggtatcccatacagtattgcttctgatcaaggaactcatttcacagccagagaagtgcaacagtgggcccatgatcatggaatctactggtcttaccatgtttctcaccatcctaaagcagctggtctgatagaaagatggcatggcttttgaagatgcagtcacagcgccaactaagtggcagcagcacggaagtcagcaaccaatatatggtatggtatctcccatacccaggatccacaggtacagaaatgaaggggtgggtaaaaggaatagttccactcactattccccctagtggcctactagaaaaattttttgcttcttgttcccatgacattaagttctgctgacctagaagttttggttcctgagtcaggagcgctcctgcctaaagacgtaagaaatagttcattaaactagaagttcaaacttccctctggccattttgggtttctgatgcccttaaactaatagctaagaaaggactaacagtgttaggaagagtgactggttaccaagagggattggactgtttctccacaatggagttaataaagattgtctcaagtgctaaagatccttgagagcatctcttggagctacagtgccccgtgtttaaagccaatggcaaagtataacacctaatgcaggcaggatgataaagggtacagacccttcaagaatgaaggtatgggtcacacctccaagaagagagacctgatgagttcttaacaagggttcaggaactacagaatgggtagtagaggaaggaagctataaatataaggccacatgacagttccagaaattagaattataactgaccttagtgtttctgtcaaattttgttaaaatgtctttgtatatttgcattttctttcctttatttctttatcatgtaatgcaacatcaattaagagaatattagtggttatacttaagtttgagatactaaaagagtatctctcaagggacattgccacctattcaaaaatttataatgcatttggggttgcagaagggatagttatgttagaattatgacctggttattgttttcatttggaaattaagcatgacttaaggagacatgactgaatgtcacattgataagaggtggacaggtggacttgtggtcgatcttcttggttgtcaacttgactacatctatgattaagcagctgggcgtaactgtgttttttttttcataattttatcatttaaagtggaaagagacaccattaatccatatctttgaggtggaaagatacacctttattctgggccacaccttctgctggctgcttatataaagaacatggaagaaggaagcttactctctttgactgctcgtcccccctctggctggcaagtccattctttcactggtattagaacttacttctatgagattctggcatatactaatgaccagtggagacatcaagtctcatggactgaacaactactggattcttggaccttctgttggtagacagccattgctgaactagcaggaccacagtctgttaagacatactaatatatatatatatatatatatatatgtgtgtgtgtgtgtgtgtgtgtgtgtgtgtgtgtgtgtgtgtatgtgtgtgtgtgtgtatgtatgtatgtatgtatgtatgtatgttgtatcagagtttttgtaagaaaagtagagcaaacgagttactctgccattaacaaaagcaaacactccacatgatttgttttaaaacagggtcttactatgtagtcctggagcatactatatagaccagggtaatcacatattcacagagatccttcagcctctgtgtctcgagttttgggattaaaggcctgtatcaccacaggccaggcaggtatagcaggtaatttttatgcatatatcctgactttacatcggtagtaagatttctaacagaaaaaaaaaaaaacctgatgcatcaacttttgttaatactgctattagttttataattttatatttttattttatatatgaatgttttacatgtctgtctatgcatctatcacatgagtacttgaagctggcaggggtggatttggatccactgaaactggagttacagatagttgtgagccaccttgtggatgctaggaacagaattaggtcttctgcaagagcagtaagtactcttcatcactgagccatctcttctgtcccttgtaattattttatacatattacaaaacaaagccagtaagtgtgaatattagcattgttagaaatcaacattttcagtgaagaaaaaaaatatgggcataagttaaagactactgaaagctaaaaactgtctttgaaaaaaatctctcacagttatgcccagctgcttaatcacagatgtagtcaagttgacaaccacaagtccacctcttatcaacgtgacattcagtcatatcttctttgatttcgttatacaatcatgatttttttaaaaaaattaaataattttcccagctttgctcacccaaagggtctagatgtgctgttaacccagtaaaaataaatcacatctggcatacacacttggggatctaaataccatttaccactataatgaaccagcgattcttgcagtcaattctgggaccaaaaaagcacatgttgggatgcaatatttggtgttagaaaacaagagaactgctcaaagactagttaataagagtgtgacaagagagcacaggcatcaatataaagagcttcttcaatgtccaaattcagaatgatttgatgacaaaacaatgactgtagctgaattctaaaatttctatttttttttttttggttttttgagacagggtttctctgtatagccctggctgttctggaactcactctgtagaccaggctggcctcgaactcagaaatccgcctgcctctgcctcccgagtgctgggattaaaggcatgcaccaccacgtccggcctaatttttttttttgagacaagttctctgtatagttttggcctggactcaaactcagagatccacctgcctttgcctcttgtgtgctgggattaaagatgtgtcaccatagactggctgaattctaaaatttctaataaataaaacttcaggagtccatcaacatgaaaaacgtatcaacaaatatgttgtcactaataatcactaattctactttgaaatttagtaatcaatccagtaaaaatctgtaccttttgggggagaaatagttcctccttacggataattctttacagagggatggcaactgggagatgacagaattagataaaccataattttgcagcacatagtaaaataatggattcaggtaagaattatgaatgaatgctaaagtcatcaagtgaatacctgttagaaacaaagatatttgtatggtgcttaaaccatgtagattatttgttggttacaacagaaaaattgtacatactccaataaatggaaattaaaaaaatattgagaagtcaggtggtggtggcacacacctttaaatcccagcacccagggaggaagaggtaggcagatctctgaattccaggctagccaagcctacaaagagagttccagaaaagttgatacaggagcaacccaaggttccaaaattaaaaagaaaagaacagaatatatatctctttttttttattttatgtgcaggactgtcctgcctccaagtaattgtgccccatgtattcagtgctcatggaggacagcagaggacattagatcttcctggaactggagttacagacagctgcgggtgctgggaatagaacctgggccctctacaagagcaacaagtgctctcaactactaagccatccatctgtctggcccaagaagttaagattttaaaaagacaacaatagacaaaactattctgactgagcaatctctagaacaatgaaatgaaagacacagtccctttaaatttcagaacacagaggataaagagaatattctaaaaatctagggaaggaaaaacaaaaggaggtcacttatatgagacctaaaataagccagactcagaaagacaaaaacctagcatggtgatcctatccataaaataaaatagtactataaaatagtactataaaaatcttattgcctaaaatcagtgcttgggccactatagacatttcactccattgtcagatgaatgaatgatagtaacttaatgtactgcatatgcttcagcatggaatatgcaaaaagttcattatgtaaaaaataagtgtcagtataaccaagagacctaggtttataaggatgtcaatgaggatgctgtttgacatgtcatccaaagaactgctgtatccatctgagaggcgattcgtggcttggactgagatcttggcagtggaaatgatgagaagcagcttgactcatatgaagtgctattaaaagatggtgaaagaaagagcagaatcaagactgactctttgaatctggattaactggttagatattggtattatttcctaaaatggagtaaagagcagatggaacaaggttaaagaggaagttaagaattatgtttaggactttaagtttaatgggcaactcaagtatatctaaagaactcattacatttgagacttcggaaggtttgggtacaggtagaggtggttccactggcttgctgatacatcatcatttcagagtaatgaaaaggcagaaacaatagaaatgtcacttactgatggcacagtcttgacaagttataaaatgacattgaaatgatatgtggggaccaaaaatagtactataaaaatcttattcagctgttagctaccaatctatggcaaatttatggacaatatctacttttcctctttctatattttatgaaaccttttctatcaagtgcatattatttttatttttggaggcaggaggaccacaagttcaaatacactattatttttagagtaagaaatgcagttgagcttctctttattttagtggaaagagttcacgccatctattttactgctgtgcagaggtatgttaaggaaaaaaggcagattacatgttagatgagctcactccctaaaatgttatgtatgcaggaaggaaaaggaaaactagaagaaagtttaaaatgccaatagcacttgtgatcagaactcaagagacggaggcagaaagattgcaagtttgaggtcagcctgtgcaacacattgagatgtttcaaagaaagaaaggaaaaacaacaaaaatccacctaaaatgtcaatggcataggctattaatataaacttttaggctattaaatattaagtcattgatgtggcattaagtactcaaaacagatttttggattgctgaggtggctcagcaggtaaatgtacttgtacacaacgcaggatagcaaaaacgattcacctagcagagaaagcccggcctcagccttggcataagtcagcaggagggacctggagggacgccaggagaagttctcagctgtgcctctcagcgaagatgtgagaccaacaagtgtggcacaagtagctctgtctgtaagcaagccaagctcgggctccatcactgtccgtagagtcctatttataccctccacacatcacgtatccttcacatgtcttgcctcagcacatgcatctgtctcggctgacaccactctgccaatcattctgagtctgtggaagtagcaagacactgtagcacatcatcagaaggttttggtgcggttctctctatggagttccaacaaatgcagctcaactgtgtaacgtaaggtggaccaatacatgtgtgtcgtttgcaaagaatccttcatcacatgtcctttcatgtgcttgctttagcaaaacatcctttcttctgcgtccatttcaacaaaatgttccttcatgtgattgccccagtaaaacatcatccaaaacaactgactttccaaagaaaccttaagtttctacttcaacacagtgaggcactatctcaaaataaaaagatgaagctttaaatttcattttgtaaaaataaaaaccaaaaaatatttatttttaaattataattatgaagtaggggatagaagtaattaatacacacatgtgagtatgagtatccatagaagaaagaagaaagcatttggagccctctggagattgatttaaaggtagttggtgacccacctaacatggatgctgggaaccatacccaggcactctgcaagagtagtatgtgctatttaactgctgagccatctctccagttcctttgtctttttcgtatacctgtgcttttccctatataactgcttagttgggtactaataccaattgtagaaatatctaatatcaatctagggcttctatcctgcctttgatcatttagttcccagataaaagacacataacttttatgatttacaataagttttaatctgcactagagttgggcagctgtctaccctctatgttgttagaatttattttcctatagataactctgagttattatgtttactatgtttcatctgtgctgttcttaactccaattggccaactctcatgggtatgctttcttgactcctaactcatggtgtctttctcctctctccaccttcttctctctctccttgtggtctgctctgacccacaaggccaggaacaccaagccctgtctatctcaattctgcccagctataggctataggcatctctattcacaaatcagaaataacttgggggcaaggtcacatagcatcacttgggtctcttatctctgggacaaccaggtcttgggagcccacatttagcattacaatatacaataacagaccaaaccacaacagataccttaagttttaaaaaaagatttatttttaagtggtatagagtgaaaacactcatggacgctagagatgttggatctctctggagctagagttacaagttgttgtgagctacctaacatgggttctggggttcaaacttgggtcctctaataagagatatgggtgctcttgtaactgctaaaccatctttctggcccattgataacttattttacaagttttacttatttatgtgtatacccatgccatacagaagtgagaggttagcaggtagtgtcttcctctattgcgtcccagcttatttttttattattttaagggactattttatgtgcatgtctgtatgtacatgtatcatgaatatgcaggtggccaaggaggccagaagaaggtgacagatatcttggttctagagccacagttggttgtgagctgctatagatgctgggaactgaaccaagccctctgcaagagtagaaagcactcttaaccactgagtgttctattcagtatcctccaccttattttgagaaagtgtctctcaccaaacttgaacctcacagactgactagactagctagtcagagggcccctgggatcctattgctttcatctctgccatatctgtttgttggcgatcagaactcagattctcatgtgtgtatatgtatgtatgtatgtatgtatgtatgtgtgtgtgtgtgtgtgtgtatgtatgtatgtgtgtatatatatatatatatatatatatatatatatatatatatatatatatatatatatatgaatgaagcactttacccagtgattctaaagttttcttgaggtatttttcaaagtgactggtcatttaattatttatttatgatggggtcccaagtactgaccaaacccgacataattttttaaaagtttattgctgcatgggataataaacacaccatctaaatctccccaccctacctccaagatttcagtattgaactcaggatctcacaaatgccaggcaagcatcctaccaataagctatactttcagatgggtatttgtaaaccccccttttttggccaagaaccctttttgttttctgaattccttctcaggaaatgatttgaaatacataaaatatatagacactgatttatgacaaatttgtgctagaataaaatgcacttctttggtaaatcattaatcagatccaaaggtagaccaaagttacaaacaattatgaacacatatgacatttcaaatatctacaataaatatagtgtaagctgcaaagatttctattctctactggtgataatcacatactttcctggtagtagagatcaaatccagggccttacccatgctgaatatgtgctctaccactgagctacatgacaaagctagagctattcccaacagtactataaataatctattatctacaactgtcagtgaataacaatgaaatgtttcccccatcaaaggtcacaaacccctgagctaagactcaaagcccttaatctagaaatctaaaaagatattccttgtggtactgaggactaaattcaggtctatgaccatgttagcattccactactgagctacaaccttatctctgagcacatgaataacagtttcctttggtgaattatcagaatattttttacttttgttgttttgatttttaaaaataaggtagaatggctatctttgaagtcctggctgtcttggaattcactatgcagaccatgctggccttgaacttagagacccatcttgcctctacctccccagtcctggattcatgtcccaccaggctcagcaggatgtttttttttaacttttgatctttgtacctatatgcattttccaagtttcttactataatattccatttttataatgaaaaataaagagctctgctttgtggggtgatgtctataatctcagcagttgtggaggaaagagggtcagaagttcaaggtcatcctcagctatatagggagtttgagagaagtctgggatacatgacatgctacttaaaaaaaaaccaaagctcaaaaagcttaaaagtatcatatttttgtttgttttatattaatctggaagaacatctaagaaatattatacaagtacttataagcgacattaacattttaaaacacaccttcagggctagagttggctctggctaacaacactggcttctcttttagaggacccaggttcaattcccagcacccacacggtgactcaaaattgtctgaaacttacttctggcttcctcaaggaaccaagcatgtattctgtgtacagatacacaggcaggcaaaacacccatatacataaaaaatattaaaaaaatacaactttcaactgtcctaactacttggattttatcattcccatagttttactagcctaaaaaaaaaaatcactatatctatttatcttggaatttaaaagaacaaacaaaagccaaactgtcacaacttgcagacgtttgtctaatttttttgccaagaataattccaaaaacagctaaaaatattagagcaaattagttcttaatatgctctaataccttctgctgtttacaaaaacacaaaacctagaaacacatggaaccatatattttaaaaataaattaccaaatgtgtgtaggaaaaattagaatacaacacatcaaagcaatgctaatacatacctcaagcaatgtatttttcccttagtagtttggtatacttaatctgttcatttataaggtacaaactaatgaagatataggattatcaggaactggacaaagatgaacaactgtcaattattaggcaagtaagcataaatatatattagtataaactgttcaaatcatttataaaaatgcatcagctatggccccaggttagaggagaataccaaggtattattagaagcctcaagcaagccaaaaagtatttcaagattttcaaaattgacttacatggagaaaattaagattgcgctgccaaagtattaaattcatggtttagtagaaatacagaggttacaaaggagacaaggaggaaagtctagacatagatgcaatttttgtgtgtgtgtggaaagattttataaacatagaaatgtaacaacttctggttaacaagaccaaaggatacaaacataaagcaaataccaatccttgcttctatctaatctattctcagtgaaaactctggttagatttctgttacaaaaatgtttccatagcaaaaggaaacacaaatgaagaaggtctgcaaagatcaatataaccatactttaaaaaagaaaggagttgcatacaatagcatcctgcactgtagaatatgctatatgtacaacacaaccttgcagggaatgtaatgtgtcctgatcaactttagtagactagctactttagggaggcagggaaattaccatgagttggagtttagctgggactgtttctgggttctacagaaggaggctggcatgaatacgcatgcagattgctaacacttatgtttgggtcaaaaagtatgtaagtagctaccacatgtgggtagggtacaagggctaaaaagactgggaaaacaaccacagaatgacctagggagaacagaagagcaaaaagttcagaggatctggagaaggttctagtttcagtccctgaggtcaggttgggagaattagaggactgctgttaacattggctcatcaggatagacctagtccatgacaggaaagaaacaagtttgttcatacacttcctttactatcaaagtcttgttcaaaaaaataataaagcctactatggtaacacacactttttttttgtttttgttttttgtttttcgagacagggtttctccgtgtagccctggctgtcttcaaactcagaaatccgcctgcctctgcctcccgagtgctgggattaaaggcatgcgccaccacgcctggattgtgacacacacttctaatctaagcacttgtgaagtagaggtaggatgactatgactagtaatttaagactagcctcagctacatagtgatcttaaggctagcctgtgctatatgatactgtctcaaaaaaaaaaaaaaaaaccaaataactgggcatagtggttcccaccagtaagtaatcccagcacttggaaaccagaaggagaaagactgctgcaaattctaggccagccagtgctatacagcataactctgtctcaaaaacaaaaatatacacacattaaaaaaaaaactgatggaaatcagtaagggtttaaggctgcaggtatgacttagtggtaaagtattttcatagaataaaaaaatatcaagagaagtatcatttaataccaaagatagcttttgctcctgtacaagctctggactacctcataggctggcactattgagtgttactatggtaatagagaataatgttaatagagaatatgttggaaggagaagccctgtcctacttaagtgtctaccaatctcctgggacaaaagtatggaggggaaggaggttctgtaaggagatctataatgggaaccctggagctccaataggtagaatgggaaggttacagaaattgtccttagagtaagtacagaataaattcattgtggaaatagtacaggataaatggacagagcactgcttggtaactctgaggataagagtagtatcttaagagtatgctgtatcttggcttgtgtgactagtatacagctgcctgaacatcatactacatgccccaaaacgtaagagctcccatcttcaggccccagctgactatgcacacctgcctatgtctgtgtactgagccagacacatattctttcctgcctcagctaccaggcattcttgtctatttttaagactcatcatctttttctactgatgctttctcctggactcagctaaagtttccttactgtgcagatgctgactgccatttaagaaaaagacaactaaactgttctctgcctccatcccataaatctaacttttttttgcttttttttgcgacagggtttctctgtgtagccctgcctgtcttggaactcactctgtagaccaggctggcctcgaactcagaaatccacctgtctctacctctcaagtgctgggattaaaggcatgcaccaccaccgcccagctaaatctaacattttatgtgctctctcagtggcagacactcttcacaatcataattgtctaccccttggaaaatcagagcccatttgcccatccgtacctacattaggccagggtaaggacagtcccagtagttagcacacataacagatgctcgatcagtagagatcacatgaataaagtactgctatatacactacaacattcataaataaataaagcaacagcaacttggtcccaaatacttacaggatattctttgtgcaaattaaaacaggatgtaggcagaaggtccagcatctgagggatactctccagccaagaatccaaaggagctaccacaacttagaatggtccaaaataaaaaaccatttgattttcttcaagattcataaataggaactagctgaaattcccctcatcaagtaaaatgtcttgcctgaaatgccctgcttacacaagatcatattttatgaaatggaagcctccaaagtttggtttctagtgctaactgctaaaaacaacttcctcctagcccaactacactctaatctctaaaaatagtactgtagtcataaattcgtgtatttatctatttatagttttccccctaaaagtctacaactaaatggctacccctttgttcagaaatactttgaaaatttaaaatgtatatatcctttgatctagcaagttccacttctagaactctatcttacagataaacttgcctctgagctaaatacaggaaaaaatgtatagtatagtggtttgaataggtttgagcactatagatttatttgtttcaatgcttggccttatggagtggctctattagaaggcagggttttattgaagtaggtgtggccttgctggaagaagtaacatcactgtgtaagcaggctttgagatctcttatactcaagctctgcccaatgtggaatgagtctcttcctggttgccttctaatcaatatgtagaactcttcttgactccttctccagcaccatgtctacctgtaggctgccatgcttcctgccatgattataacaaactaaacctctgaaactgtaagccagctccaattaaatgttttcctgtataagagctgtcatggtcatggtgaccatgcaataagccctatttaacagcaataaaaccctaactaacacatagagcatcaacattttgaggtagataaggtttttctatgtagctctgaatggtcggaacaggttggcctcaaatctgcaataatcctattgcttatgcctcccaagtattggaattaaaggtatgtgccaccataccatggtaggataaatgacattttgacaattagaaacacaaacatccattaatagaaaatcaaatgtattatagcataccccataaatagactattttatttcatcagttaaaaagaatgatatggttctgtataaactaattccagataatcgccaagatacattaactagaaggcaagctttgcaactatgtgccatattttatggttcaagtaaaagatatactcccacatactttttgtatatgtgtaaacatacaaaatacataaaatgcacatgcataaacattcagagtaaggcactagacggtattgacagccagtaggagagtgttttagcaaaggatagggatgaagcaagaagcgaaaattagtcttcagtgagcatagaactgcagcattataaaagaaaagagatctggatgtggaaggcaataataataatttgaaaactgaatgacaagtttaccaaagtcaaactcaagcatactccggaaatcatcccatctcaaagttaaatataaaaaccagtatttgggaaaacacagggcaatcttaaggggaaacaggtaacatatgacatgaaactagagaaggggtggtggtggttctgtagtgaggaccagaaggataaggcaggagaacaggaaaaggaatggggaagaatgagcaacagaacagagtatatatgaaaataccataataagaccatcatttttataagctaactttaaaaactacctaagggctgcatgccactaagcctaatgatccattagcctaacacacacacacacacacacacacacacacacacaattttaaaaaccaatttaagggctggtgagatagctcagcagttaagagcactgactgctcttctggaggtcctgagttcaaatcccagcaaccacatggtggctcacaaccatctgtaatgagatctgaagacagctatagtgtacttacatataataaataaataaaatcttaaaaaaaaacaacttaaaaaggaatgtggacaaacaggaacttatgatacattaaatatgtatacattgaaaatacatcaatcttttcagaaaaaaaatggaagtatcaactaactcctagaagaaaaagattttcctgtataaaaaattaattttatgtgttttgtatggtgtaagtttatgtaccacatgcatgtgtgatgcctgtggaggccagaagagggcactggatctcatggaacaagagttacgtacccttgtgagttctggaaactaaatccaggccctttgcaagagcagcaagtgttcctatgttcttaaccactaaacagtatctccagcctccagaaaacactttctaggagcaaatgaaatcttaatttttttttaagtgtccatgttacatgtgtgctacagtctaaagatagcttgttggagtcaacaacttcgaggagttggttctctctttccactatatggcttctggagatcaaatttaggtcactagacttgatggaagcatctttaacccactaagctaatcactgggctgcctgagattttatataatagaaggacaaacaggttaggtattcagttcagtagatctagaaagtatagctcctggcttcttacagacccacttaaaaagaagtatcttgggggctgaagagatggcttagaagtcaagatcacttgtgactctggtagaggacctgtgtttggtttcttaacagtcatgtgaggtagcttacaactgtccataactataactccaagaggatctaccactggcctctgtaggtgcctgaactcatatgcacccctcatcttccgcgtgagccccacagacacagaaaaagaattaaacacacacacatacacacacacacacacaaagaattaaaaattaataaaaaatatcctgatggaataataaatacagaacatgaacatatagttcacataggccagatacaaatggccaataattactgagatacagctcagtaataacaaaaagaacactgatttaaaaaataggtatctaattatgaagtcccaagaatttcagaaaggtgatacctaccagtacctccaagtctaggtagccattcttcaaaatgactagctgatgaagaagttctaatttaaagtttatagggtttttttttttttgatacaaggtcttgctatgtagccttggctagcctgaaacttgctatgtaaactaagctggcctcatgctcacaaaaatccatctacctatctctgtgtcccaagtgctgggattaaagttgtacaccaccatgcttggctttttcttttcctttttttttttaattaagaagaaaagatatacatttttctagaaaaaagttgtattgtttgacctgaaatggttgtttttctagagaaagcagccaaggagctgaaggggtctgcaactctataggtggaacaacaatacgagctaaccagtacccccagagctcatatctgtagctgcatatgtagtagatggcctagtcggccatcactgggaagagaggcccattggtcttgcaaattttacatgccccagtacaggggaacaccagggccaagaaatgggagtgggtgggtagggaatcagggcggagggagggtatagggaactttcgggatagcatttgaaatgtatataaagaaaatatctaataaaaataaataaataaaagaaaaaaaagactttttctaaaaaaaaaaaatccaccctttctctggagaaacatgtatagtatcattactgtctttttcccagagtcattcataaactgagaaaaagactttaaaaaccgcaaaccacgcccagcctaacatctacccatcagtgcttctattacatttagtagaattcttgagacaaagcactagccatataactcccaccagcataaatgtgtgaagcacaaagatcggtcaggtctggatcatacctcatgacagtgaggagaatgacaactgacgtcacagtatcagaagcagaatcaaatcttcattttcttctattctcctccacccaaaacttaccccccccccccataaatcagctatgtgtgtgtgtacatgtgtgttgcgtctgtacagtgtgtaatacatttagagatacagaaaatgctaactggggatctctgctacaatcaaaacacagcatgtgtgaacagtcaacattttcttttgtagaagataggaaaagtcaattggcattatctgttttatcacacagaaatacaggtgacaaactatcaaatgtagaataattactaatttaaaaaaagcttgagaggtttgagcctgataaaggataagaaattacagaacaagtcattcttgcaaaaactaaagtccacacaatggtaccgcagtagttcacagtacagatttgtcaggtctgaaaaacaactgggctttccagcttttcctgctctagaatcccgagagtcgcacatctgtctggatgcatccatcagaggtcagcaagcaagcaccactaaccacaggctccattgtgccgtgacactttcagaaaggtgctcttctaaggggaccacataccagttcctatatctgaaaatgcagcacaccactgcttgctaacatcgacctgcaagtcatttagcccaaaccaaatcaaagaaagcatcatgctgaagaccactaggtaagagcagcagcacaggtgaagagctcaggccaagcactctcctgcttcaaggtgaactgaagctgcagatcaccagttccagctctaatctgacacccaccccccagatcacactgtggctaccaagtaactctacccaaactgaactgaactttcagggctcagggaagtgacttttttttattatatggcacagtttggcccagttatattttttgtctttggggtactttcatactgtccaagaatagtatatctttttttccttttttttttttttaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaatcgtaagttgaaagtccccattgagctgcaccttttcccaaggctttttggaacattctgaagataaacagacaacatactatgttacttcccagctcagctagttagaagcaaagaataaactgcaaattactgccacaaaacacagaatgctaaaataaagacaagagttatggctgtcagaagcgtcactatcagaggtccttacacctctggggaacactttggaactacagtgcacaccacaagtggtgacttctgcttaagtacttcttccaccacactatacaggaaaagtcaaggatagaatgtgttcaagagtatatgcaacatcaaaacaaaacaaccaactccccccccaccccaaaaaaaacaaaaaccaaccaaccaaaaaccaaaacaaacaaacaaaaaacccaaacacccacacatcacctcaaaaagaacacaaccaaatccagaggcaaaagtctctcttctgcttccagcagtcaaagctgcaaggaactgctctaacatcacaaaggggttttcaccctgagataaaagacaaaacaccaggagatccaaagccatcatccaaactataagtccttctctaaccaatttctgtaaccctctcaattcagtacatctcaatggctgtaacacagagttgatgatccttttgacctttttgttactgtttttctttaaaatttttgagattttatttatttttattttatgtgcatgagcatttgtctgaatgtatgtctgtgcactacccacatgtagtgcctgctgaggctagaagatgggtcctggggactggaattagaccattgtgagcctctatgaaggtagtggaagataaacaagtgctctaaacagctgagcgctctccctccccccattgttgtttttgaggcagtctcgttatgtagttcaggctgtcctcaaactcagttcttccggcttcagtctctcgtttttttttttttttgtttgttttttttttgcacacatgttcaaataaggctgttgccaccaagctaaccatcgtttcctagttaaagccttagctacctaaatacctaattttagatacctggctctcccagcaataacacttttatctttacactaaaagaaaagcttatactatacaacttaagtctattatagtcactcatggggttgaatccagaggaaaggcaacagcaaccaagtcctttgcagctgtatgctatttacctagacgatgcttacagttctcttttaaggctcagcaaaacctcttcatttctataatttccttaaatcatagaattaagtcatggaacagtttgaaatcccaaagttaattgttttttggatatcagcctaataaaaaaactcaaaccagtgccttgtttataagaaggcctgcaaagtcacaacttctcaagactagttttacctacctgcaattttatttatttatttttttgtaaggatggaactgaaatcagtgccttgagcatgtgaagcaaatgctctacactactgactgagccctatatcttcagcccttatttcactagaagctgaactcagctttattctaagctcttaaaaaagtttgagatttgatgaaaaaaaaagttaaaaatgaattcagttaggtgaaaatccaacaaaaatattcatactaaaataccccctgcttttaggaaaagataagcacacttttactaaggcttggccagtaacaagagtccagacatccatagtaccagctaggtgagcagacattcacatgctagcagtgtccaggaaaaggtcatatttccccctttaacatgggagtaggctcgtctgccttctcttgagtcttgccaccattcagacattccacacactatatttcccataaaagtgattgaaatcaaactttcaaaggaaaatgttccttgggagagaaaggcagaagagagctgtagaaagcagaagagcacacacacacaccttctgtataaactagccccagaagtagggagccactggactccctgaaatgatgagcaggtgcagcactctgattggacaacagcggagtgattaaaaatggctgtgatgggcactgaggacaatgtccttcccttggaagaacaatagtgttttctacccaactaaaaagattgtttctgttagccacatggcttgctgcacagatgttaccagagcaggtgattaaaatgagatattctgccacacttcctggaattctctagtctaggctgcgcttaaaaacactggctactagaaatgtcattgtccatcagtctatgcttcccagaagtagttcactggtggtaaactgctcttagccaattaaaacattccccaccgagtgacctgtttttgtggaactcccatcagagggagtggggagctctgtcacttttggcatccccttcctcctagtgggctgccttaatatgagggaaggtgactagtcttattgaaacttaatatgccatgctacattgatatgcctgggaggcctgccttttctaaagggaaaaggatgagtggatggggaaggagaagggaggagtgagggactgagaggagaggaggaagtggaaaatacagttgggatgcaatatatgagaataatgaataaaaaaaaagattctcactgacaattacctttagaaaagataacaggttccaggatatatcatttaccatgcaaacaaactaacacgtttacctctgctgctctttattttaggtttaaaaaaaaaaaaaacttctcaggagttcatgggtggagttggggcactggaacaagggtttagctgatttctccttaaactccatagctttgcctccctatccccaatagattaggcttcatagaagcagatcaggtagagtgaaccactctatctggaaaatacacagattgcaaaaacatatcataaccttccaaaatctttgtggtctatgtgtagtctttgtggtcatatgtacctcaggagtcaaacagcacaaaaaacagagtagaaggctaaggatgtggagtgattgcctagcatgcatgaggtcctgggtttgaccaccagtataacaataacaaaaaaaaaaaaggaaaaaaataatccttagagtacaatggacaacatgatgctttcttcttcagtgaaatagtgacctgttactgtagctttaaagtactcaagacacattctcatggaaagaaaataggcatatgtgatagatcaatactagcaagaaagccatacagtttcttcaaattcttaggacacactagcttcagatgtcaccaggcactttgaaaggaaactgtgttctagaagttgcttacgatgtttaaagagctatgggtacaacaaatagataaccagaggggcacctgaggaagcaaacctgttgtaagaatataaaaacaaagtaaaggttccaactctgagctcaggctcagatgtacaaaccttggaattttttgacaagcaagacttgggtgtgtttgtgaaagtgaatgcactctgtcggccatgtgtattaactcattttagatcatttgtacttttacagtgtttggactctttaaggttctgacatatccaggtaagaaaataaaagcaagtgtttcctaggctttctgagtatgacttgaatttgaagttaaaaacaaacgaaaaaccaaaagtctgtaaatatatttttccaaatccttggtggaaactccccaaggacctaacaatccaaattttatctttttatagagattcgacatatttcaaagaacctaagatatcagtttaatcatgttattaattgaaattgctgagattcacataattccaaccacaaacccaaaattctcctctacagtaataattacctattagtgaaattttactacccaggcccaaattggtttcatttatgtagtataacaaaatatctagaacttgtcctacaacatctcagtcacttagcactataaattagtccattctgtttcatgatcgtcatcaaccaccctgtatttgagcctactgcctcactgtaatgattccaaacagtggagtcaacatgcaaatgactcaacagagcccatttgtgttcctggaaaattaaccaagagtacatatctgcctgactatgagtcaggaatatcaaatttgtggtggagcccatttttgttttgatcaacctatacccgaacatacaaggaaccagcatagaggtatcccctaacaagctttgcccttcaggggtccatactgaacaatgtcataccagggtctctcttgtgagagggaatcttttttagactccatgatgactttaaacctttagtgcaaaacctcagaaacattgccactgccacataaaagtcacctgtgttttattttcagtgattcagccataaccaaactaaaaagagaatgaactttcaaagataagtgacaggagtcacagcgatgcgatgatctcgccccatttggtactggcgatcctgagcgctccaggacgaagagagcccgttacatacaacgtcccattccacttatgtaactggatgatcgctggcgaagggaggggagggagggtgggaagacgctcatattccgaagccacagcacagcatccccaaagaaccagagcaccctgcgggcatggtctcacggaagagcttcgagtgctgaggaacgcacagtcccttgcccacggttcctgatgagaactacaaccatctctttatgatgagttgtgggacctaggaacataatgtctagtcctttttgtgggtggacaataaccctcaacttgttcctgccaagtggggaatggagctgatggaccgactcgcttgcagtgggggcaaaaagtcacggaatgggagaggaggaggagggagcaaaacccagagatgggggtaagagctcaggagcccttgtggcgcactctcccaacgggagatggactgcgcacgcgcgccagtctgtgtgtgtgaggggggagcaagtaacgggagtgggggcgcgcgagggagaaggggacagcgcgatccagggagaggccgggaccgcgggcgcgcgacagtgccgaggcccaaagccccaagaagggcaggagcgcgcgcagccccaactggcgaagcccagacgacaagggcgcttgcacagctggggcctaggatgcgcacagatggggcgggcagcgggagggcgtcattcgaaggtggctccagggagatcgcgctgagaaccgtcgctcgcgattgcgggagacgagtggagaaagccaccaccggcggcagagggagggggagggtagagaggagggacgccatccgccagccgtgtcgcccgaccccgcgggcccctcccgcgccacgtcccgcccctacccgccccccagcaagggtccccgcccgcggccttggcggtcccactcacagtctctcctcctcgcctcctcctcctcctccgctcggcgcggcggcggcggcggcggtggcggcagcggcggccattttccggacgggttttaccacagccctctctccgagaggagggagcgcgcgcgcaaccgatgccgggaccccgcacggcagacgtcgcgccccgccctcccgaccagcctgtgtgctgctgcacctgcgcgcccgcgccccaccccttgctctttgtcgagattacccttcattggttgtggagcccaggctggggcggagccttagcggtgacgccctcaattggcaggagttcctgtctgtttaggcagggaaaagaggcggaccccattcagctgcggattggtggagttctactgtcacttggaaaaaagaggcggctagggcacagaggggctggttttgtgggcagcatttgaatgttgaggattaactgggcccttgtggactctggcgcttaaggaagtctaggctcttggcgcctattagagcctccctgctgagtagttcaccattgtgataagcatttgacttcaccagcatttctttattatcattttctgtagaagtagcaaagttgcctgttgaggagcctggcgttgttccaagccaagggacttgttttaaagggtctactgattgtattattacactaaattagcagatgtcgcactcttaaggctgacagtaaaatcaacatatcaaaccttggtctttgcagacgtttataatgggcagatggtgtgtgccaagcccataagagatcggtctgtcattgttgaatcagatggtttgatggaagtacgtataaaagggagtgaggccagagggagcattgtcaaagcagccttaccctgataccagtcagcatccaatgctctttgtgctaaacaaatgctcaacaagagactttctttctttgtttgttttttaaacactatgcaacaagagactttctgattcaaatttggctcccctctctattcatttatttgctaggcactgttttagtactgaacaaggagacaaactagactcctggtaaggaagagtcatactaaacatacaagaaagtagaacttaaaattttgcacagagataaagactttgaaatagatagggcaaggacaaaagaagtgctattatgataccctctagcttttgccctcatgtcgtctcccaatatgggtaattggggaaaacattctaggcaagtttaaacactctaaggaaggactatgcctgccttactaaggaggccagtgtgactggagagagacctaggccaccaaaagaactaggagattattttgagatgagaagcccttgataaatatttgagtcactagctgtcaccataaaacctatgttgccagtgaagaatgaagaactggctggtccagaggtcctggcagcagttgaagaaagatagatgatgaaggctttaaccaggacagtagcagttgaaatctgataagttgtgatagttaagatttatgttaaaaattgagccaaaagtattggatatcagatggaaagaaagaaaaaaaataaggatgatggctgactttgggacaggatcacctaagtgaatatcttactacagtgggggaaatctagaggatttcccatatggccattctaaaccatttgtaattctagtctcagggaatcctgtgccctcttctgaccacagtgagcaccaggcaaaacacttatacacataaaatactaagatagaaatgtaaaaaacaagtgggtaagagtggtagtgtgtgtgtgtgtgtgtgtgtgtgtgtgtgtgtatgttggggtgtgagaatacaggtatttgcatatacagagaataggatctgaacttgggtcctctgcaagagcaacaagccatctctccagccacaccttcaggctgagttttattccacgaatgcaaggatggtttaaaattagaaatcaattataattttaagaacagatcatgtgagtatcccaatacatgcaggaaaaagcatttaataaaattcaatacctacatatgattttaaaaacaccttaaagaactataattagaatgtccttaatctgatcaaaatgtctataaagctgtagaggaaacatgatatttaattgagaacaaagcaagaaacagcaagatctacagtgcaatatcattcacaaaaataaagtacatcattttcctaccttgtgaaattttgggaagaaaatcttaagttccttaaattagataaaagagatttaaatgacatattttatacttgcactaaaaaaaaaaaatagaaaaaaaggcatattgtaccaaaagtattttagcagtagaattaaaaggagccatttaaaaaatgagagtgtagcatttaaaaataatattcctttaaaatggggagatagagtctgaggataaaacgtaatggtagagcacttgcctaccactcataaagccctggattcaatccccaacataaaaagtggggcaattacaaccaggaaagtatactacatgtatatatctcaacaaactgaagaattttagcaatatggaaaatagaacacacacatccactctatccaaaaatctgtgggagtggtgggacatttttttttaattccaaaatgacaaagaaaaatgagaaagatgacacagttcaaaatactgaaggcacatcccatatgatgctacacaagtataaacacaatttgacttgaggatacttatgtaatatctcccaaaaccattcatccatcatacacaccaatcaagtgtcccagaagctgtaagtgttgctcaatggtaaagtgtttgcctagcatgtacaaagccctgggataacccgtagcattacatacacctgtcatggtggtgcacaattataaggccagtacacaggaagtaaaaggcaagaacatcagaaattcaaagtcatccttggctacattatgaattcaaagccagcctaggctacatgagatgctgtctcataaacaaaacaaaacccaatctctttcatacaggaaaacatttatattcataaaataaaaataaatacacatttaaaggtaaaatagaaaaagacaataaattatgcttgcatgtacatgctctcaaagctttccttttttactcttaaaactactcaaaaaaagtaccatggctggcacgatggacagtgtaaaggctcctgctgctaagcctgatgacctaagtccaagtcccagtacctaaaactgactcccataaattgtcctgtgacctttattcacatacttgctatggctcattctttccttctccccaatccaaatggatggacaggcagacagacagacaaaattttgcaatgaaagaaaagtgcctaagattaaaaggaaataaagaaactttggtgaaagttctgttggcaaaatgcttgatggtgcaagcatgagaacctgatttcaagccgggcggtggtggcgcacaactttaatcccagcacttaggaggcagaggcaggtgggtttctgagtttgaggccagcctggtctacagagtgagttccaggatagccagggctacacagagaaaccctgtctcaaaaaacaaaacaaacaaataaacaaacaaaaagagagaatctgatttcaatcttcaaaacttttttttttttttaaatctgaacatggagccatgtgtttggaattttgtaattccagtactggggagtcagaaacaagcagaatcctgaggctagctgactagcctaacccagcctacttggtgagtttcatgcaagtgataggcccaatctctttaaatcacctttaaatatgatggatgtggagggcatgaagtctctgtgctcatagacaaggaatatagaaaccagggatgtgaagcatgcaggcaggcttgtctcttcaacagaagggatgtatatgcctcttttccacccagaaggctgggagtggattttgttaatagcctggtggtctgcgccacctgtgtggtcaggtcacacccaaatcccccctcccccagtttatatcagactctccctccctagaccttcatccgcagttttgttctcagtcagtagactgagatgtcaacaagtattttatagcctggtgacctcaacactatctgcatgacagaaaccacaccagatcctagggccctaagctgtagaatgcatcctcacggtagaggtcacctaaactttgcaaaagactttccatgtagttaggcccaaatattcattttctacacagaattgagaaaactgtaaccagggaacttttctttcccaaaattgcaccatacttaaataagtttaaaataaaccgcacagggtcagactagaattttgaaccaacactggctaagacagatttcctttctgccccttgcagttcatttccctgcagtagagcttacagagacccccatgatggttcctgaggtccaacactagtggttgtctcctgtctccacatgtacatgtagacatgcatcaatatccacatatatacctgcatacacacacacaccccacaagagagagagagagagagagagagagagagagagagagagagagagaatgagaatgtagagaagaattatttgaaaaatacggtagctggaaaaatatagctgaaaatatttgaccaggcagctgcagaagagatagggggcagtttgcaggttaaacaacaaagagtctgaatctggaggcacgttatatacaaaaaatgaaataaaacaatagtagacacacagggattcagtgcaggatgatggtttcagttggaacacccctctccccaagcagacagctgagctggagccaacaagggcttaaagagaaaacatctggctgttctataaagaagctgaacatctgtagagagccaaggcttccagcatggatgctgacaattcctgagtaatttcttcctcattttagccagtagactctatgatctccactcttccagcccctgccctcacagaggtcgtttggatcaggaaagcagatctccaacagaacattaaatccacaatagctattgaactcttctttattaattataaataattactaagtaccataaaaaattgagagaaagagctcggtgtggtgtcttatacctgtaatcctagcactgaggaggccatgaggcagaagaatcaccacaagtttcaggtcagccagaggtatattgttagaacctgtcttcttaaacatgaaaaagaaatagacgggagccttccatacacacaaaaattcaaggtcttgtctaaaatgtacaaaacactggctttaatgcccaacactgaaaaaaaaaacacatattgcatctataaataagaacagaacattatataatagagcattcagagacaaaaagtaattcttaaaaagaggagaaaaatgagaactttgaggagtattctggaattcgagagcttaacaagaatttgaaaattaaaaactgagcaaaacctacaaagtctcagattctacgggagtgagaggctcccaggatccaatggagatgactttagccgaaatatccaacaaaggggggatacaacctgtagagaccacctccagtagataagcatggcccccagttgggagatggggccacccctgcatctcaaaacttttaactcagaaatgatcctgtccaaagaaatgacagggacaaaaaaaaaaaaaagcaacagagactgaaggaaaggacatccagagaccaccccacctagagatccatcctatctgcagacaccaaacgtccacactactgctgatgccaagaagtgcttgctgacaggagcttagcatggctgtcctctgagaggctctagcagcacctgaccaatacatattgagatagagccaatcattgggttgagtctggggaccccaatggaagagctagaggaaggactgaaggacctgaaagggattgcaactccatacaaagaacaatatcaactaactggaccacccagagctcccagggactaaattaccaaccaaagtgtatacacatggagggatccatggctccagctgctatgtagccttatctgatatcagtgggaggggaaggaggcttgatgccccagggtagggggatactaaaggggtgaggcaggaatgggtgagtgggtagaggagcaccctcatagaggcaaaaggtgtggagagggggtatgggataggggattgtggaggagtaacctggaagggggatatcatctgaaatgtaaacaaataaaatgattaataaaaaacaagtgaaaaaaataaaagctgaggaaaagaaacagttatgagactagcaccagacaaaagttaacagggcaactagaacatagacaatagggcaaagcttttaaaattgtaggagaggcaatcaagtgttagggatccctttctgatccaggaggttatttatttctcaataaaaccttgcttgttaccccccaaaaattctaaaggaaaatgcttgtccataagcaatagaatcatgtacaagtcaaaatatttatcatgtataacaatgaaataaggagttatagagatatatgaactaataaatttctctcaaatacattttcttaagaagttacttgaggatgttttgaagcaaaacaaagatataagccaaaaaagaagtggtgggatccacaaggtgggggttcacagggatgccaactgggcagaaaaatgacaaactcagtgtgtgtgtgtgtgtgtgtgtgtgtgtgtgtatgagagagagagagagatccaagaattaaaaacaaattagctatatgtttgtgaattcaatgttttagaaggtgtgattaagagtttgaagaagctggatatgggtttaggatgtggtttggttaggagactgcttgcctaacatacaagaaaccttgggattgatccccagtgccacataaactgggggtgatagtatatgcctgtacagtacagtacagcactaagggtgtggagttaggaggattagaagttcaaggtcattctcagtcttagaacacaccaagatcaatatcattagcaaagcaaaatttatcataattttctaatttatggcacataagaaaaaatagcataatgggacagtgctatcttcttaagttgtccaggagtcatcaaactagactcgtgaaaatgcagcacaactctaacatgtctcctcgtccttttcctttctttcctcatccttcttttagttgagatgaggtctcttcagtctatacccagagtggtctcaaactgacagcaatgcttttatcctcagcttcccaagtgttgagactacaggtgtcagccaccattcccagccttatgtggttatcttagttgtggtaaatttaaacaacacactttaatttctcatgccactaactttcaatatcaatattacatttgacagttttgtatcagctagacttcaattttacattgttggggttcatatgtaaaatatgaaaagataatcaccaaaaaaaaaaaaagaaaagaacagaagaaagtagaacaaaaggatattagagtttgagagaccctgataaatgatacccatttttcccactgagttgtagtggaacttaataagcaaacacacacaaagttcagctaaaaatcccttatttaaaggttcttcagtaaacacaagttcaatcaagaagtgaaaccttcctttaactagataatttaaaatgctatggaaatacagagatgaaacaaatccaggtttgctgtcaaaacagacagccaacagaaacacatggattcttaaagggagccaagtacagtgttgagcagctccagcagcttgttggccagccctgcttctattccctcacccactcattttcttaattcacagaaatgtggcccaggacctagttctagccaatgaaaggtgagggtgagtagactgggggatttggggaagctgcagctgttctgctccccttgatcagggtgagcctggagaaggcagaggatgtctggccataagtcagttagctaccaaacacgtttttgaggtcttgtgagattagatatttcatcaatatctgctattttccagctttggtttaaatatttttttctctggttattgtttgttttcttgcttgcttaggttgactgctactttctctttatgttttctttttatgtactcaaagaaccaagtttggtattaattttcttgcctctctctgtttattgacttggtacttcctctgctctcacagttccagtgttctacatattttcaaactttgattgttttcaactgaaatttaaatctaattctagtagatcccctttttgttcattgtttcttttctaattttgaaacttcttgagggtcatttttgggccttaatattagtctctggctcttctatgaacccccttgccactatgctaagcaagatctactatctagtgtgggccaccctgcaggatatgagagaggtgaaggatgagttttagagtctttatttgcctaccatgcacaaagccctggatttggtccctagcaccacacaaacagggagttgtggttccagctctccagtggtgaaagcatgaagattagaaactcaaggtcatccttagctttgtttttattttgtttttagatttgtttttagagtagctgaatgttgataaaattgagaagaggttaatgaaaattcccatgtaccttctgccccaacaagatgcacagttccttcattatcaacacccattagagtgagacttttatatattcaatgaatctacactgacacgtcattatcattcagaatctgttacagagcactgttttaatgtgtgtgtgtgtgtgtgtgtgtgtgtgtgtgtgtgtgtgtgtgtgtgctggttagtcttatgtcaacatgacaagctagaatcatcaaagaggaaggagcttcaattatgaaaataccttcataagatccagctgtggacaactgtgtactctctcagtgagtggtgagagaatggagggcccagcccattgtgggtggtgccatctctgcactagtgatcttgggttctacaagaaagcaagttgagtccatgctttcagacaagatcagacacatttgccttgatacacctctctctgtggaaatgaagctcatgagcaagcatctgcatagtagaacttggcctgagaactgtcccctgagcaccactgtttagatctagtcttgctccttggtctggagaagtcacacaggaccccaagagcatcctgccttcctgtggaaacctttgggggccccaaaactaaccagcttggaaccctgcctgaacacccatcctagttggagctgcctgacaccctagctgggtctgactggggcacaccctgtagagtagtaaccactcaagaaaaagcctgcagagtggtgtctgcctgagacacagccaacagagtagggtatcctgacctacattttctagcctatggcttcccccacctcctcatgaagtcctgctgctatcaggatcatcctgccagtaccagggaaaaccagatgcctaaaggacagtgtaagaacacaatcaacaagactcaaggcaatatggcatcaccagagctcagctatcctctacagcaaaccctagatatcctaatgaaactggagcacaacaagaggatctcaaatccaactttataaagatgatgcaggcctttaaagaggacataaatacattctttaaagaaacacaggataatacattcaaacagatagaggcattaaaagaggaagcaaggagctagagagatgactcagcagttaagagcactgactgctcttccagaggtcctgagtccagttcccagcgaccacatgataatgggatccaatgccctcttctggtgtgcctgaagacagccacagtgtattcatataaataaaataaataaatctttttttttttttaaagagaaagccgggctggaaagatggctcagtggctaagagcactgattggtgagactaggccggggcctagcaaacacataagtggatgctcaaagtcagctattggatggatcacagggcccccaccaatggaggagctagagaaagtaaccaaggagctaaagagatctgcaaccctgtaggtgcaacaacattatgaacgaaccagtaccccggagctcttgactctagctgcatatgtatcaaaagatgggggctggtgagatggttcagttggtaagagcacctgactgctcttccgaaggtccggagttcaaatcccagcaaccacatggtggctcacaaccatctgtaacaagatctgactccctcttctggagtgtctgaagacagctacagtgtacttacatataataaataaataaatcttttaaaaaaaaaagatggcctagtaagccatcactggaaagagaggcccattggacacacaaactttatatgccccagtacaggggaacgccagggccaaaaagtgggaatgggtgggtaggggagtgggggggggagggtatgggggacttttgggatagcattggaaatgtaattgaggaaaatacgtaataaaaaatataataataaaaaaaagagcactgactgctcttctagaggtcctgacttcaattcccatcaaccacatggtggctcacaaccatctgtaatgggatctgatgccctcttctggtgtgtctgaagagagcaacggtgtactcacatacataaaataaataaatctttaaaaaatgaggaagcaaataaatataaagaaatatgagaaaatacaatcaaacaggtgaaggacatgaataaaactgtccaaatcctgaatataaaatagaagcaataaagaaaacacaaactgaggcaatcctgaagatggaaaacctaggaaagagaacaggaactacagatgtaagcatcaccaacagaatacaggaaatggaagagagaatctcatcaatatatcactcaaagaaaatgcaaagtctaaaaggttcatgacacatccaggaaagataagacaacactgatcactctccccatatctcttcaatacagtacttaaagttatagctggagcaatgagacaacaaaaggagatcaaggggatacaaactagaaaggaagaagtcaaagtattgctatttgcagatgatatgatagtatatatatatatgtgaccccaaaaattgtaccagaggacttttcatcaaattggctggatacaaaattaactcaaaggaattaatagccctcctctacacaagcgataaatgggctgagaaagaagttagggaaacagtactcttcacaatagccacaagtaacataaaataccttggtataactccaagcaagtgaaatatttgtatgacaaggacttcaagtctctgaagaaagaaattgaagaaaatatcagaagatggaaagatctccctggctcatgtatcagtaagattaatatagtgaaaatggccatcttactaaaagcaatctacagatccaatgcaattcccatcaaaattccaacgtaattctttacagaacttgaaagagcaattctcaactttatatggaaaaacaaaaacccagggtagctaaaatgatctcgtacaataaaagaatttctggaggtatccccaccccctgacttcaagctgtattacagagaaatagtaataaaaactgcatggtattggtatagaaacacacatgatgataaatggaatcacatcaaagatccagaaataagcccatgcatctatgggtggttgatttttgacaaagaagccaaaaccttataatagaaagaagagagcatcttcaacaaatggtgcttgtctatctggaggtctgcctgtagaagaatgaaaatagatccaatatttgttaccctgcacaaaactcaagtccaaatgaattaaaggcatcaatgtaaaaccagacacaatctaatagaacagaaagtggggaatatccttaaacttgtcggta

SEQ ID NO: 5 - DNA, 47 bp, Homo sapiens
ctgcatcatcgtcgtcagagccaccgcagattatcatcaaccctgcc

SEQ ID NO: 6 - DNA, 45 bp, Homo sapiens
gctaagggagtgccatctccaccccaggactggcccttggcagct

SEQ ID NO: 7 - DNA, 41 bp, Homo sapiens
tccatggcagcccctggcagcgccatcaggagccagtgccc

SEQ ID NO: 8 - DNA, 44 bp, Homo sapiens
cctgggccagctggcctgctgctgcctgcaccgccgggccaaaa

SEQ ID NO: 9 - DNA, 45 bp, Homo sapiens
aggtctggctgcagatgcctgggctgctcccatcgccatgcagat

SEQ ID NO: 10 - DNA, 45 bp, Homo sapiens
ggctggtcagagggctgtgaagacgcacggtgccaggaccaagta

SEQ ID NO: 11 - DNA, 30 bp, Homo sapiens
ggccagagggggagccacaccaggtcccgt

SEQ ID NO: 12 - DNA, 46 bp, Homo sapiens
gcgtgtaccgggcggtgatgaggaacacggtgtatgctgtgaagag

SEQ ID NO: 13 - DNA, 48 bp, Homo sapiens
ttgcactctcttggctgtcacccgatcgccagcaaaacttagatgtga

SEQ ID NO: 14 - DNA, 41 bp, Homo sapiens
ggtgttgaggcttatatttgtgtaatttttggtgggtgaaa

SEQ ID NO: 15 - DNA, 47 bp, Homo sapiens
tcgtggtcttttcctcgcttctttcaagggctttcctgtgccaggtg

SEQ ID NO: 16 - DNA, 47 bp, Homo sapiens
aattatacctgttgcttaattacaatatttctgataaccatagcata

SEQ ID NO: 17 - DNA, 50 bp, Homo sapiens
tttagttttgcttttagtttttctgtcccttttatttaacgcaccgacta

SEQ ID NO: 18 - DNA, 48 bp, Homo sapiens
atctttgggcatatacatttttagcctgtgtcattgccccaaatggat

SEQ ID NO: 19 - DNA, 50 bp, Homo sapiens
ctgacaatactgtatgtcgtcgagctccccccaggtctacccctcccggc

SEQ ID NO: 20 - DNA, 43 bp, Homo sapiens
tccttagggttttctctctatttccccctttcttcctcattcc

SEQ ID NO: 21 - DNA, 47 bp, Homo sapiens
ggctcctgcccccatagtggcctcgaactcctggcactaccaaagga

SEQ ID NO: 22 - DNA, 46 bp, Homo sapiens
atgtgtccatttccttatgctgtaaaagcaagtcctgcaaccaaac

SEQ ID NO: 23 - DNA, 42 bp, Homo sapiens
aaaaccgtgtttgtctcttctggaatggttagaagtgaggga

SEQ ID NO: 24 - DNA, 46 bp, Homo sapiens
ttgtgtatttcagttattgtccctggcttccttactatggtgtaat

SEQ ID NO: 25 - DNA, 49 bp, Homo sapiens
gtttacagagatgtctcttatatctaaatctgtccaactgagaagtacc

SEQ ID NO: 26 - DNA, 86 bp, Homo sapiens
tgctgtgggtttttaattgatcagttttcatgtgggatcccatctttttaacctctgttcaggaagtccttatctagctgcatatc

SEQ ID NO: 27 - DNA, 47 bp, Homo sapiens
gccagaacaccacacatttcactgtctgtctggtccatagctgtggt

SEQ ID NO: 28 - DNA, 47 bp, Homo sapiens
ccagaactctgcctgccctttgtcctcctgctgccagtaccagcccc

SEQ ID NO: 29 - DNA, 45 bp, Homo sapiens
caaggacaaacccctcaagtttaaaaaggtgaagaaagataagaa

SEQ ID NO: 30 - DNA, 105 bp, Homo sapiens
cagacgaacttgttttagaatttaccatcgtaactgagctcccttcagcgcatacctccttggctcctgctcagtctctgtttctccttttagccaaactctcta

SEQ ID NO: 31 - DNA, 46 bp, Homo sapiens
aagtcctgttaggccaaccacttctcagcatctgcactgccagtat

SEQ ID NO: 32 - DNA, 41 bp, Homo sapiens
atgttcatgactctgaatgatgatatgtctgcctgctgatg

SEQ ID NO: 33 - DNA, 48 bp, Homo sapiens
ttcctgtcagccctcttactatggaactcaaataggacagattcagct

SEQ ID NO: 34 - DNA, 24 bp, Homo sapiens
tttttacataagactttgatggta

SEQ ID NO: 35 - DNA, 43 bp, Homo sapiens
tcttcatggacccttctttcccttcacttctgtcccaggagac

SEQ ID NO: 36 - DNA, 40 bp, Homo sapiens
gtgaagacgaggcatgaacaaccagccaggacatgtggag

SEQ ID NO: 37 - DNA, 25 bp, Homo sapiens
gcaatactgtttgtagagatcacag

SEQ ID NO: 38 - DNA, 46 bp, Homo sapiens
aaatgtgagttttcacttatgcggccattgtgattccgactgagac

SEQ ID NO: 39 - DNA, 53 bp, Homo sapiens
tttgacatgtggatttcagaacttctgtgtggtaaagcagaatgttccaattg

SEQ ID NO: 40 - DNA, 59 bp, Homo sapiens
gtgcttgctacactcctcccatggtaactaaagagagtacccagatatacatctggttc

SEQ ID NO: 41 - DNA, 43 bp, Homo sapiens
tgcattttcagatatgggaactggtatgtggttggttccctag

SEQ ID NO: 42 - DNA, 78 bp, Homo sapiens
tagaagtactacagttgattaaagtaagtcaccacaggtcacccattcgtggcaggtcagctaggtggctgatcactg

SEQ ID NO: 43 - DNA, 44 bp, Homo sapiens
taggtaattattactctagagaattttgggttccatggctggaa

SEQ ID NO: 44 - DNA, 63 bp, Homo sapiens
gcctccccctccttctcgcccattccatgaatttctgccccccgctacccccccgcgagcgag

SEQ ID NO: 45 - DNA, 4047 bp, Homo sapiens
ctgtaatcccagctgctcgggaggccgaggtgggaggatcacgagcctgggaggttgaggctgcactgagccatgattgcaccactgcactccagcctgggtgacagaatgagtccctgtctcagaaaaaaagtaagttgtagaaagaccaagagctgtggcacagtgtctcacacctgtaacaccagcactttgggaggctgaggcgggaggatcacttgagcctacttggagaccagccaggccaacaaagcgagaccccatctcttttttttttttttttttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtagccagctgcgcactgggacggggtggccagatagaaagcccgcattccaggccttgctctgtagtgaccccatctcagcacctgctaggtctctctggagtctccacacatttcttgcttgccctttggttctgtttggggcagcgcccctctgaactgaggggccccgggcagtcctgctttgcggagcccagctccgacccccttcacatagagagaaggaaagagctgctgccgcgccccctgctgggcgcactgcactactgcatctgcctttttctgtcccctccctagtaccccacctcttctcctctggtgacagttgaaaatggagaggccccgtttgagggcagcggggcagtgagattcattttgtagaaaagaacgaggccattctcagtccttgcttttggcagccgcgcttctcagcactccctgtgatgggaacagaggggcgaggggcagagcgttcccagctgcagggtatgtcattttagagccctggggcaggtcacggacggcctggagcagccctgtggtttgcccacggggtgaccggccagggctgccatctcaccctgagagtccctcttttccacttgcaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggtagctggggagacgggttcccaggagagggaccaaggcctctttgggccaaagcccctgtaagtccccaccccagccttctagaagagaaccagggccaaatgttcagctcactgtgaccttagcaaccctggtttcccctccccaggccacatccttcccaggtggagcttgctctccagccctccccccaccccattcctgaaggctgggaacaaggagggctctgtctggtagcctgagagctgggccctgcccttggacttctctgaggaattcaggcctgaggccagggaggcagggtgctaggctgcgggctggggagccacagcatgaggctaagggagtgccatctccaccccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggtgctgccgcccaggctggcctctggggtgctcaggcgcatccgtgtcagccccaaagagcagagtgtctgtcccgactgcgctgagggcgtggggcagccgggcaggccactggctctggcgacctctagaagcccagccggccccacatgcctcccttagcaagaccctggcccactccttccctcgcctcctgacagtagcacctcctttagcccgagggtgcctgccccactctgtgctttcaggaaataggaagccccagcaggaattttccatcccaggtactatttgaagaaccactgcttaggaaccctcagctgggcgaggtggctcatgcctataataccagcacttttggaggccaagatgggaggatcacttgagcccaggaggtggaggctacagtgagctgtgatcaagccactgcactccagcctgggagacagttagaccctgtctcaaaaacaaatgaacaaacaaacaaaaaccctcaattcccacgaacgccccaggagataagggagcatggcccaggccttgagccagggcttctggcagtaggggagcctcccccatttgctaagcggactttcctcttccttctgtaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacagg

SEQ ID NO: 46 - DNA, 4045 bp, Homo sapiens
agaccagcctgggcaacatagcaagataggcatggtggtacacacctgtaatcccagctgctcgggaggccgaggtgggaggatcacgagcctgggaggttgaggctgcactgagccatgattgcaccactgcactccagcctgggtgacagaatgagtccctgtctcagaaaaaaagtaagttgtagaaagaccaagagctgtggcacagtgtctcacacctgtaacaccagcactttgggaggctgaggcgggaggatcacttgagcctacttggagaccagccaggccaacaaagcgagaccccatctcttttttttttttttttttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtagccagctgcgcactgggacggggtggccagatagaaagcccgcattccaggccttgctctgtagtgaccccatctcagcacctgctaggtctctctggagtctccacacatttcttgcttgccctttggttctgtttggggcagcgcccctctgaactgaggggccccgggcagtcctgctttgcggagcccagctccgacccccttcacatagagagaaggaaagagctgctgccgcgccccctgctgggcgcactgcactactgcatctgcctttttctgtcccctccctagtaccccacctcttctcctctggtgacagttgaaaatggagaggccccgtttgagggcagcggggcagtgagattcattttgtagaaaagaacgaggccattctcagtccttgcttttggcagccgcgcttctcagcactccctgtgatgggaacagaggggcgaggggcagagcgttcccagctgcagggtatgtcattttagagccctggggcaggtcacggacggcctggagcagccctgtggtttgcccacggggtgaccggccagggctgccatctcaccctgagagtccctcttttccacttgcaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggtagctggggagacgggttcccaggagagggaccaaggcctctttgggccaaagcccctgtaagtccccaccccagccttctagaagagaaccagggccaaatgttcagctcactgtgaccttagcaaccctggtttcccctccccaggccacatccttcccaggtggagcttgctctccagccctccccccaccccattcctgaaggctgggaacaaggagggctctgtctggtagcctgagagctgggccctgcccttggacttctctgaggaattcaggcctgaggccagggaggcagggtgctaggctgcgggctggggagccacagcatgaggctaagggagtgccatctccaccccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggtgctgccgcccaggctggcctctggggtgctcaggcgcatccgtgtcagccccaaagagcagagtgtctgtcccgactgcgctgagggcgtggggcagccgggcaggccactggctctggcgacctctagaagcccagccggccccacatgcctcccttagcaagaccctggcccactccttccctcgcctcctgacagtagcacctcctttagcccgagggtgcctgccccactctgtgctttcaggaaataggaagccccagcaggaattttccatcccaggtactatttgaagaaccactgcttaggaaccctcagctgggcgaggtggctcatgcctataataccagcacttttggaggccaagatgggaggatcacttgagcccaggaggtggaggctacagtgagctgtgatcaagccactgcactccagcctgggagacagttagaccctgtctcaaaaacaaatgaacaaacaaacaaaaaccctcaattcccacgaacgccccaggagataagggagcatggcccaggccttgagccagggcttctggcagtaggggagcctcccccatttgctaagcggactttcctcttccttctgtaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaacc

SEQ ID NO: 47 - DNA, 4041 bp, Homo sapiens
ctccttgggggtccttggacttccccacttgctccccaccctgcagccaaagtgctcttttcaaaggcccctttgccttttctctgctcttggggtgaaggcccagtcccttatgtggttgaccccccaacgccccaggtccctgggactcggggcgctccctgctgcctgcttcacagccttagtatgtgccgttcgctctgcgagaaaagccaccgcccacccaggtggttcctcctggtctgtctgatttcagaactggagatggcctccggtcctgtttccaccctgggggcgcctctctgcggggcgcctctctctctggggtacctctttgtctgtggggcacctctctgtggggcgctttccttctcggctctgccctctcaggctacttcctgccttcagaccccagctccatggggctctcccccaccaggaagtcagctctgtcaaaccgggtcccagggttctgtttgttcctgtatccctagggcccagagcaccactggcccacagtaggtgtttaataaatctctagaagctactcgggaatctgaggcaggaggatcgcttgagcctgggagttggagaccagcctgggcaacatagcaagataggcatggtggtacacacctgtaatcccagctgctcgggaggccgaggtgggaggatcacgagcctgggaggttgaggctgcactgagccatgattgcaccactgcactccagcctgggtgacagaatgagtccctgtctcagaaaaaaagtaagttgtagaaagaccaagagctgtggcacagtgtctcacacctgtaacaccagcactttgggaggctgaggcgggaggatcacttgagcctacttggagaccagccaggccaacaaagcgagaccccatctcttttttttttttttttttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtagccagctgcgcactgggacggggtggccagatagaaagcccgcattccaggccttgctctgtagtgaccccatctcagcacctgctaggtctctctggagtctccacacatttcttgcttgccctttggttctgtttggggcagcgcccctctgaactgaggggccccgggcagtcctgctttgcggagcccagctccgacccccttcacatagagagaaggaaagagctgctgccgcgccccctgctgggcgcactgcactactgcatctgcctttttctgtcccctccctagtaccccacctcttctcctctggtgacagttgaaaatggagaggccccgtttgagggcagcggggcagtgagattcattttgtagaaaagaacgaggccattctcagtccttgcttttggcagccgcgcttctcagcactccctgtgatgggaacagaggggcgaggggcagagcgttcccagctgcagggtatgtcattttagagccctggggcaggtcacggacggcctggagcagccctgtggtttgcccacggggtgaccggccagggctgccatctcaccctgagagtccctcttttccacttgcaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggtagctggggagacgggttcccaggagagggaccaaggcctctttgggccaaagcccctgtaagtccccaccccagccttctagaagagaaccagggccaaatgttcagctcactgtgaccttagcaaccctggtttcccctccccaggccacatccttcccaggtggagcttgctctccagccctccccccaccccattcctgaaggctgggaacaaggagggctctgtctggtagcctgagagctgggccctgcccttggacttctctgaggaattcaggcctgaggccagggaggcagggtgctaggctgcgggctggggagccacagcatgaggctaagggagtgccatctccaccccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggtgctgccgcccaggctggcctctggggtgctcaggcgcatccgtgtcagccccaaagagcagagtgtctgtcccgactgcgctgagggcgtggggcagccgggcaggccactggctctggcgacctctagaagcccagccggccccacatgcctcccttagcaagaccctggcccactccttccctcgcctcctgacagtagcacctcctttagcccgagggtgcctgccccactctgtgctttcaggaaataggaagccccagcaggaattttccatcccaggtactatttgaagaaccactgcttaggaaccctcagctgggcgaggtggctcatgcctataataccagcacttttggaggccaagatgggaggatcacttgagcccaggaggtggaggctacagtgagctgtgatcaagccactgcactccagcctgggagacagttagaccctgtctcaaaaacaaatgaacaaacaaacaaaaaccctcaattcccacgaacgccccaggagataagggagcatggcccaggccttgagccagggcttctggcagtaggggagcctcccccatttgctaagcggactttcctcttccttctgtaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaa

SEQ ID NO: 48 - DNA, 4044 bp, Homo sapiens
ctctccaggtagtgctagagaccttggctggtcagagggctgtgaagacgcacggtgccaggaccaagtatctggtgagccccttgaggcagggccaggagggacacacagctgctggcagccagcaggcacagccccagtggcggggataactggggcgcagtgcccatggatgcctctgctgccacagtggcctcatttttgaaagtaggcagggctccaaacaacttcgtttaccttgccgaggacaaacctgtctgtcctgcagacactatgggccttgtacagaccccacctgggctgggggcagggggaagggcggtcccagggcactgagacccaagctgcagtggaactcagaggactctggccggagaaaggcggtggtagagaagaagcaggccccgaggaacctcctgggccccagcaggctgcagctgagctctccgcaccgtgcagggcagcctgagctgcctcacggtcttactccactcagtctgcctcaccgtggactgtggtggggccaggagactagagacctgggttttagccccagcctgacagtggccttccagcaaattcctgctcccctgtgggcctgttttcccatatgcaaaacagacttcacagaatgtgctcagccagtaattgcttcactgcttctcctcttgtttggggcggttcctgtgtgctgtggggtctccgtcaggattcagccccgctgagaacccaggagccgggcttgagccctccttcctttcccttccccgtccgtccatccatgcatcctgctgaagaagcgcaccaggctccttgggggtccttggacttccccacttgctccccaccctgcagccaaagtgctcttttcaaaggcccctttgccttttctctgctcttggggtgaaggcccagtcccttatgtggttgaccccccaacgccccaggtccctgggactcggggcgctccctgctgcctgcttcacagccttagtatgtgccgttcgctctgcgagaaaagccaccgcccacccaggtggttcctcctggtctgtctgatttcagaactggagatggcctccggtcctgtttccaccctgggggcgcctctctgcggggcgcctctctctctggggtacctctttgtctgtggggcacctctctgtggggcgctttccttctcggctctgccctctcaggctacttcctgccttcagaccccagctccatggggctctcccccaccaggaagtcagctctgtcaaaccgggtcccagggttctgtttgttcctgtatccctagggcccagagcaccactggcccacagtaggtgtttaataaatctctagaagctactcgggaatctgaggcaggaggatcgcttgagcctgggagttggagaccagcctgggcaacatagcaagataggcatggtggtacacacctgtaatcccagctgctcgggaggccgaggtgggaggatcacgagcctgggaggttgaggctgcactgagccatgattgcaccactgcactccagcctgggtgacagaatgagtccctgtctcagaaaaaaagtaagttgtagaaagaccaagagctgtggcacagtgtctcacacctgtaacaccagcactttgggaggctgaggcgggaggatcacttgagcctacttggagaccagccaggccaacaaagcgagaccccatctcttttttttttttttttttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtagccagctgcgcactgggacggggtggccagatagaaagcccgcattccaggccttgctctgtagtgaccccatctcagcacctgctaggtctctctggagtctccacacatttcttgcttgccctttggttctgtttggggcagcgcccctctgaactgaggggccccgggcagtcctgctttgcggagcccagctccgacccccttcacatagagagaaggaaagagctgctgccgcgccccctgctgggcgcactgcactactgcatctgcctttttctgtcccctccctagtaccccacctcttctcctctggtgacagttgaaaatggagaggccccgtttgagggcagcggggcagtgagattcattttgtagaaaagaacgaggccattctcagtccttgcttttggcagccgcgcttctcagcactccctgtgatgggaacagaggggcgaggggcagagcgttcccagctgcagggtatgtcattttagagccctggggcaggtcacggacggcctggagcagccctgtggtttgcccacggggtgaccggccagggctgccatctcaccctgagagtccctcttttccacttgcaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggtagctggggagacgggttcccaggagagggaccaaggcctctttgggccaaagcccctgtaagtccccaccccagccttctagaagagaaccagggccaaatgttcagctcactgtgaccttagcaaccctggtttcccctccccaggccacatccttcccaggtggagcttgctctccagccctccccccaccccattcctgaaggctgggaacaaggagggctctgtctggtagcctgagagctgggccctgcccttggacttctctgaggaattcaggcctgaggccagggaggcagggtgctaggctgcgggctggggagccacagcatgaggctaagggagtgccatctccaccccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggtgctgccgcccaggctggcctctggggtgctcaggcgcatccgtgtcagccccaaagagcagagtgtctgtcccgactgcgctgagggcgtggggcagccgggcaggccactggctctggcgacctctagaagcccagccggccccacatgcctcccttagcaagaccctggcccactccttccctcgcctcctgacagtagcacctcctttagcccgagggtgcctgccccactctgtgctttcaggaaataggaagccccagcaggaattttccatcccaggtactatttgaagaaccactgcttaggaaccctcagctgggcgaggtggctcatgcctataataccagcacttttggaggccaagatgggaggatcacttgagcccaggaggtggaggctacagtgagctgtgatcaagccactgcactccagcctgggagacagttagaccctgtctcaaaa

SEQ ID NO: 49 - DNA, 4045 bp, Homo sapiens
catctggctctgcctttgtccacacccttgtcaggcccaatccatgtccacaccagaggcctcttccctgccaaggccactgccatgctctccctcttccctctctccaggtagtgctagagaccttggctggtcagagggctgtgaagacgcacggtgccaggaccaagtatctggtgagccccttgaggcagggccaggagggacacacagctgctggcagccagcaggcacagccccagtggcggggataactggggcgcagtgcccatggatgcctctgctgccacagtggcctcatttttgaaagtaggcagggctccaaacaacttcgtttaccttgccgaggacaaacctgtctgtcctgcagacactatgggccttgtacagaccccacctgggctgggggcagggggaagggcggtcccagggcactgagacccaagctgcagtggaactcagaggactctggccggagaaaggcggtggtagagaagaagcaggccccgaggaacctcctgggccccagcaggctgcagctgagctctccgcaccgtgcagggcagcctgagctgcctcacggtcttactccactcagtctgcctcaccgtggactgtggtggggccaggagactagagacctgggttttagccccagcctgacagtggccttccagcaaattcctgctcccctgtgggcctgttttcccatatgcaaaacagacttcacagaatgtgctcagccagtaattgcttcactgcttctcctcttgtttggggcggttcctgtgtgctgtggggtctccgtcaggattcagccccgctgagaacccaggagccgggcttgagccctccttcctttcccttccccgtccgtccatccatgcatcctgctgaagaagcgcaccaggctccttgggggtccttggacttccccacttgctccccaccctgcagccaaagtgctcttttcaaaggcccctttgccttttctctgctcttggggtgaaggcccagtcccttatgtggttgaccccccaacgccccaggtccctgggactcggggcgctccctgctgcctgcttcacagccttagtatgtgccgttcgctctgcgagaaaagccaccgcccacccaggtggttcctcctggtctgtctgatttcagaactggagatggcctccggtcctgtttccaccctgggggcgcctctctgcggggcgcctctctctctggggtacctctttgtctgtggggcacctctctgtggggcgctttccttctcggctctgccctctcaggctacttcctgccttcagaccccagctccatggggctctcccccaccaggaagtcagctctgtcaaaccgggtcccagggttctgtttgttcctgtatccctagggcccagagcaccactggcccacagtaggtgtttaataaatctctagaagctactcgggaatctgaggcaggaggatcgcttgagcctgggagttggagaccagcctgggcaacatagcaagataggcatggtggtacacacctgtaatcccagctgctcgggaggccgaggtgggaggatcacgagcctgggaggttgaggctgcactgagccatgattgcaccactgcactccagcctgggtgacagaatgagtccctgtctcagaaaaaaagtaagttgtagaaagaccaagagctgtggcacagtgtctcacacctgtaacaccagcactttgggaggctgaggcgggaggatcacttgagcctacttggagaccagccaggccaacaaagcgagaccccatctcttttttttttttttttttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtagccagctgcgcactgggacggggtggccagatagaaagcccgcattccaggccttgctctgtagtgaccccatctcagcacctgctaggtctctctggagtctccacacatttcttgcttgccctttggttctgtttggggcagcgcccctctgaactgaggggccccgggcagtcctgctttgcggagcccagctccgacccccttcacatagagagaaggaaagagctgctgccgcgccccctgctgggcgcactgcactactgcatctgcctttttctgtcccctccctagtaccccacctcttctcctctggtgacagttgaaaatggagaggccccgtttgagggcagcggggcagtgagattcattttgtagaaaagaacgaggccattctcagtccttgcttttggcagccgcgcttctcagcactccctgtgatgggaacagaggggcgaggggcagagcgttcccagctgcagggtatgtcattttagagccctggggcaggtcacggacggcctggagcagccctgtggtttgcccacggggtgaccggccagggctgccatctcaccctgagagtccctcttttccacttgcaggtgtacgagaggctagagaagctgcaggcagtggtggcgggggtgcccgggcattcggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggtagctggggagacgggttcccaggagagggaccaaggcctctttgggccaaagcccctgtaagtccccaccccagccttctagaagagaaccagggccaaatgttcagctcactgtgaccttagcaaccctggtttcccctccccaggccacatccttcccaggtggagcttgctctccagccctccccccaccccattcctgaaggctgggaacaaggagggctctgtctggtagcctgagagctgggccctgcccttggacttctctgaggaattcaggcctgaggccagggaggcagggtgctaggctgcgggctggggagccacagcatgaggctaagggagtgccatctccaccccaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggtgctgccgcccaggctggcctctggggtgctcaggcgcatccgtgtcagccccaaagagcagagtgtctgtcccgactgcgctgagggcgtggggcagccgggcaggccactggctctggcgacctctagaagcccagccggccccacatgcctcccttagcaagaccctggcccactccttccctcgcctcctgacagtagcacctcctttagcccgagggtgcctgccccactctgtgctttcaggaaataggaagccccagcaggaattttccatcccaggtactatttgaagaaccactgcttaggaaccctcagctgggcgaggtggctcatgcctataataccagcacttttggaggcc

SEQ ID NO: 50 - DNA, 4045 bp, Homo sapiens
gctcagaacggcttctactgcctggtgtacggcttcctgcccaacggctccctggaggaccgtctccactgccaggtaggctcacctggcccggcacgcttcccaggacccaaagcactcctgacacctggctggagccgggcgcggggcctagggctttcagcctgtgtgagtgggtcctgccagcaggccaggcctgcacttccagctccccagcagcacccggctcaggatttggcccacggtggggtcaatttttttttttttttttttttttttttttttgaggtggagtcttgctctgtcatccaggctggagtgcagtggtgtgatctcagctcaccacaacctccacctcccgggttcaggcgatcctcctgccgcagcctcccgagtagctgggactacaggcatgcaccaccacacctgcctaatttttgtatttttagtagagatgaggttttgccacattggccaggctagtctcgaactcctgaccccaggtggtctgcgcgcctcagcctcccaaagtgctgggattacaggcgtgagccaccacgcctggcccgacccaatgttttctatagagctctttcccaggcctctcccctttgcaagcagcgtagctggagggtctcatcagcaagccccggaggcgagggggtctggggctaccagctggaccacctacagctgagggagggcccccttgcctcctcctgcatgctgcgtttggggagagcgggaagaatgccttcaaggacttcccgaccaccagggacaaagggatgagccctgggagccgaagcccagcagattctattgaacgtgtccccagccattgcttaagaagtgcaggtcacggagactttgctcctcgttttccagaagggggaaactgaggcctagagagtgaagtggctgttccaggctgcacggtgacaggtagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagaggtgaggaggggcccttgagaactgccggggcagggcctgcagcaaggggggccccgcgtcctatcaatgtggggatcaggcatggcctgggacctcaacaccccggcatcgcacaggtgtgggaacgggccaaggatgggccctactgatgagcagaggcccccaggcagctggagcgctcagggcagtgccagcgctttctgtgggcaaggcaccgggctggcagcctcgagtccagccttatctaagccgggcaggtgtaggagctaggaccgggctgacgccactgtcttctctccccaagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtgagccactgacccctctgctggctcagaggaggagaagccacaggcaggcagaggtgggggctgcagagtgcactgcgggccaggggccatctgccaagaccccaggaggctgcagctccagggtccccctccctccgaggccctcctcctcaccctgcacctaactgtgtgtttgtaatttgtcttcaagtgggctctccgagttgcccgagcttcagtcccataacatctggctctgcctttgtccacacccttgtcaggcccaatccatgtccacaccagaggcctcttccctgccaaggccactgccatgctctccctcttccctctctccaggtagtgctagagaccttggctggtcagagggctgtgaagacgcacggtgccaggaccaagtatctggtgagccccttgaggcagggccaggagggacacacagctgctggcagccagcaggcacagccccagtggcggggataactggggcgcagtgcccatggatgcctctgctgccacagtggcctcatttttgaaagtaggcagggctccaaacaacttcgtttaccttgccgaggacaaacctgtctgtcctgcagacactatgggccttgtacagaccccacctgggctgggggcagggggaagggcggtcccagggcactgagacccaagctgcagtggaactcagaggactctggccggagaaaggcggtggtagagaagaagcaggccccgaggaacctcctgggccccagcaggctgcagctgagctctccgcaccgtgcagggcagcctgagctgcctcacggtcttactccactcagtctgcctcaccgtggactgtggtggggccaggagactagagacctgggttttagccccagcctgacagtggccttccagcaaattcctgctcccctgtgggcctgttttcccatatgcaaaacagacttcacagaatgtgctcagccagtaattgcttcactgcttctcctcttgtttggggcggttcctgtgtgctgtggggtctccgtcaggattcagccccgctgagaacccaggagccgggcttgagccctccttcctttcccttccccgtccgtccatccatgcatcctgctgaagaagcgcaccaggctccttgggggtccttggacttccccacttgctccccaccctgcagccaaagtgctcttttcaaaggcccctttgccttttctctgctcttggggtgaaggcccagtcccttatgtggttgaccccccaacgccccaggtccctgggactcggggcgctccctgctgcctgcttcacagccttagtatgtgccgttcgctctgcgagaaaagccaccgcccacccaggtggttcctcctggtctgtctgatttcagaactggagatggcctccggtcctgtttccaccctgggggcgcctctctgcggggcgcctctctctctggggtacctctttgtctgtggggcacctctctgtggggcgctttccttctcggctctgccctctcaggctacttcctgccttcagaccccagctccatggggctctcccccaccaggaagtcagctctgtcaaaccgggtcccagggttctgtttgttcctgtatccctagggcccagagcaccactggcccacagtaggtgtttaataaatctctagaagctactcgggaatctgaggcaggaggatcgcttgagcctgggagttggagaccagcctgggcaacatagcaagataggcatggtggtacacacctgtaatcccagctgctcgggaggccgaggtgggaggatcacgagcctgggaggttgaggctgcactgagccatgattgcaccactgcactccagcctgggtgacagaatgagtccctgtctcagaaaaaaagtaagttgtagaaagaccaagagctgtggcacagtgtctcacacctgtaacaccagcactttgggaggctgaggcgggaggatcacttgagcctacttggagaccagccaggccaacaaagcgagaccccatctcttttttttttttttttttttttatcaaaacccatacgattgagtgacaaggacctgaggactgcagctgcaggtgtggccacctggtagccatactgacagtatttatcccacagaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtagcc

SEQ ID NO: 51 - DNA, 4030 bp, Homo sapiens
ccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagcccgggaggccgatcgccgctcgcggaacccgccgggacccgggccctccccggcgcggggcgcccccgtgtgacccagcgcgcggccgcggcgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctgtgagcgcgggactccgggcaccccacggctgggaggccggcgggccccacggggctcccccacccgggcctcaaccttcctttccttccttggcgtcccagggcaccctcccgccccgcttccgtccccaggcaccactgccccgaggcccagcagcatccctgcacccgccgaggccgaggcctggagcccccggaagttgccatcctcagcctccaccttcctctccccaggtaagagggcccggttgttaggctcggtggacccaaagaagagcccaccttgaccacggccacggctgtagaccctgctgctggtctctgcctgcctctcactggtgtctttatgaagcttttccaggctcccagacccattcagggcctgagctcggcctggtcccaagccctgcttccctgtggcctccaccgccatctccagccccttcttctaccaaggtaggtgtcccctgccccccagggaagattcgagacaaggaggaaggaattcagcctttgatgtagcgcagagccccagtcagccaagctgggtcagctgggaggcagctgtggtggggagagcctggagccttgggcagaagggaagagacagggaccccacctgatccaggctctcttcccacagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggtgagtgtcgcaccctggcagggaccctggaaggccatcagataaccctcaccacttctccagcctttccccctcgcttccccacacaactccttcagccctcattctggcgtagggtccctggccccttggtggttctgggcctcgggtaggtggcactggtggcccgaaggccttcgcttcgagagcctcacgctgcccgtcttccctgccccttcccccaccgcaccctgggggctgcagaacgctgacctggagtggactgcagtgaagcagagcttcctgaccgaggtggagcagctgtccaggtgaggccagagggggagccacaccaggtcccgtggggcttcagaccgcacaccacaggacctggctcccttgggcacctgaggcctggcaggcccgggcgagctgaggccccagccagggctgcccacccagtctggcctgatggaaagtgctcccctttttcaaacaggtttcgtcacccaaacattgtggactttgctggctactgtgctcagaacggcttctactgcctggtgtacggcttcctgcccaacggctccctggaggaccgtctccactgccaggtaggctcacctggcccggcacgcttcccaggacccaaagcactcctgacacctggctggagccgggcgcggggcctagggctttcagcctgtgtgagtgggtcctgccagcaggccaggcctgcacttccagctccccagcagcacccggctcaggatttggcccacggtggggtcaatttttttttttttttttttttttttttttttgaggtggagtcttgctctgtcatccaggctggagtgcagtggtgtgatctcagctcaccacaacctccacctcccgggttcaggcgatcctcctgccgcagcctcccgagtagctgggactacaggcatgcaccaccacacctgcctaatttttgtatttttagtagagatgaggttttgccacattggccaggctagtctcgaactcctgaccccaggtggtctgcgcgcctcagcctcccaaagtgctgggattacaggcgtgagccaccacgcctggcccgacccaatgttttctatagagctctttcccaggcctctcccctttgcaagcagcgtagctggagggtctcatcagcaagccccggaggcgagggggtctggggctaccagctggaccacctacagctgagggagggcccccttgcctcctcctgcatgctgcgtttggggagagcgggaagaatgccttcaaggacttcccgaccaccagggacaaagggatgagccctgggagccgaagcccagcagattctattgaacgtgtccccagccattgcttaagaagtgcaggtcacggagactttgctcctcgttttccagaagggggaaactgaggcctagagagtgaagtggctgttccaggctgcacggtgacaggtagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagaggtgaggaggggcccttgagaactgccggggcagggcctgcagcaaggggggccccgcgtcctatcaatgtggggatcaggcatggcctgggacctcaacaccccggcatcgcacaggtgtgggaacgggccaaggatgggccctactgatgagcagaggcccccaggcagctggagcgctcagggcagtgccagcgctttctgtgggcaaggcaccgggctggcagcctcgagtccagccttatctaagccgggcaggtgtaggagctaggaccgggctgacgccactgtcttctctccccaagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtgagccactgacccctctgctggctcagaggaggagaagccacaggcaggcagaggtgggggctgcagagtgcactgcgggccaggggccatctgccaagaccccaggaggctgcagctccagggtccccctccctccgaggccctcctcctcaccctgcacctaactgtgtgtttgta

SEQ ID NO: 52 - DNA, 4046 bp, Homo sapiens
ctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagcccgggaggccgatcgccgctcgcggaacccgccgggacccgggccctccccggcgcggggcgcccccgtgtgacccagcgcgcggccgcggcgcgcaagatggcggcgggcccgggcaccgccccttccgccccgccgggcgtcgcacgaggccggctcgaaggggaagtgagtcagtgtccgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcggtgggtggcggcgggctgccggggggcgggaggcgcgcgggctcctggcgccgacgcctgacgccccccgccccgcagccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctgtgagcgcgggactccgggcaccccacggctgggaggccggcgggccccacggggctcccccacccgggcctcaaccttcctttccttccttggcgtcccagggcaccctcccgccccgcttccgtccccaggcaccactgccccgaggcccagcagcatccctgcacccgccgaggccgaggcctggagcccccggaagttgccatcctcagcctccaccttcctctccccaggtaagagggcccggttgttaggctcggtggacccaaagaagagcccaccttgaccacggccacggctgtagaccctgctgctggtctctgcctgcctctcactggtgtctttatgaagcttttccaggctcccagacccattcagggcctgagctcggcctggtcccaagccctgcttccctgtggcctccaccgccatctccagccccttcttctaccaaggtaggtgtcccctgccccccagggaagattcgagacaaggaggaaggaattcagcctttgatgtagcgcagagccccagtcagccaagctgggtcagctgggaggcagctgtggtggggagagcctggagccttgggcagaagggaagagacagggaccccacctgatccaggctctcttcccacagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggaggtgagtgtcgcaccctggcagggaccctggaaggccatcagataaccctcaccacttctccagcctttccccctcgcttccccacacaactccttcagccctcattctggcgtagggtccctggccccttggtggttctgggcctcgggtaggtggcactggtggcccgaaggccttcgcttcgagagcctcacgctgcccgtcttccctgccccttcccccaccgcaccctgggggctgcagaacgctgacctggagtggactgcagtgaagcagagcttcctgaccgaggtggagcagctgtccaggtgaggccagagggggagccacaccaggtcccgtggggcttcagaccgcacaccacaggacctggctcccttgggcacctgaggcctggcaggcccgggcgagctgaggccccagccagggctgcccacccagtctggcctgatggaaagtgctcccctttttcaaacaggtttcgtcacccaaacattgtggactttgctggctactgtgctcagaacggcttctactgcctggtgtacggcttcctgcccaacggctccctggaggaccgtctccactgccaggtaggctcacctggcccggcacgcttcccaggacccaaagcactcctgacacctggctggagccgggcgcggggcctagggctttcagcctgtgtgagtgggtcctgccagcaggccaggcctgcacttccagctccccagcagcacccggctcaggatttggcccacggtggggtcaatttttttttttttttttttttttttttttttgaggtggagtcttgctctgtcatccaggctggagtgcagtggtgtgatctcagctcaccacaacctccacctcccgggttcaggcgatcctcctgccgcagcctcccgagtagctgggactacaggcatgcaccaccacacctgcctaatttttgtatttttagtagagatgaggttttgccacattggccaggctagtctcgaactcctgaccccaggtggtctgcgcgcctcagcctcccaaagtgctgggattacaggcgtgagccaccacgcctggcccgacccaatgttttctatagagctctttcccaggcctctcccctttgcaagcagcgtagctggagggtctcatcagcaagccccggaggcgagggggtctggggctaccagctggaccacctacagctgagggagggcccccttgcctcctcctgcatgctgcgtttggggagagcgggaagaatgccttcaaggacttcccgaccaccagggacaaagggatgagccctgggagccgaagcccagcagattctattgaacgtgtccccagccattgcttaagaagtgcaggtcacggagactttgctcctcgttttccagaagggggaaactgaggcctagagagtgaagtggctgttccaggctgcacggtgacaggtagaaggatggttgggatcaaggaacggccatccagcaacctcccctgtccccctttgccaccccagacccaggcctgcccacctctctcctggcctcagcgactggacatccttctgggtacagcccgggcaattcagtttctacatcaggacagccccagcctcatccatggagacatcaagaggtgaggaggggcccttgagaactgccggggcagggcctgcagcaaggggggccccgcgtcctatcaatgtggggatcaggcatggcctgggacctcaacaccccggcatcgcacaggtgtgggaacgggccaaggatgggccctactgatgagcagaggcccccaggcagctggagcgctcagggcagtgccagcgctttctgtgggcaaggcaccgggctggcagcctcgagtccagccttatctaagccgggcaggtgtaggagctaggaccgggctgacgccactgtcttctctccccaagttccaacgtccttctggatgagaggctgacacccaa

SEQ ID NO: 53 - DNA, 4048 bp, Homo sapiens
acctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagt

SEQ ID NO: 54 - DNA, 4041 bp, Homo sapiens
ggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcagg

SEQ ID NO: 55 - DNA, 4047 bp, Homo sapiens
caaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttcc

SEQ ID NO: 56 - DNA, 4047 bp, Homo sapiens
agctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggag

SEQ ID NO: 57 - DNA, 4050 bp, Homo sapiens
catccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgtttt

SEQ ID NO: 58 - DNA, 4048 bp, Homo sapiens
ctgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagag

SEQ ID NO: 59 - DNA, 4050 bp, Homo sapiens
gtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaatta

SEQ ID NO: 60 - DNA, 4043 bp, Homo sapiens
ttggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgac

SEQ ID NO: 61 - DNA, 4047 bp, Homo sapiens
tgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcc

SEQ ID NO: 62 - DNA, 4046 bp, Homo sapiens
acctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaat

SEQ ID NO: 63 - DNA, 4042 bp, Homo sapiens
ggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctg

SEQ ID NO: 64 - DNA, 4046 bp, Homo sapiens
gtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcac

SEQ ID NO: 65 - DNA, 4049 bp, Homo sapiens
tctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccac

SEQ ID NO: 66 - DNA, 4086 bp, Homo sapiens
aaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtccc

SEQ ID NO: 67 - DNA, 4047 bp, Homo sapiens
ccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgcc

SEQ ID NO: 68 - DNA, 4047 bp, Homo sapiens
agccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccatcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcatta

SEQ ID NO: 69 - DNA, 4045 bp, Homo sapiens
cggtggctcacgcctgtaatcccagcactttgggaggctgaggcgggtcgatcacctgaggtcaggagttcgagaccagcctgcccaacatggtgaaaccccgtctccactaaacatacaaaaattagcctggcgtggtagcacacgcctgtgatcccagctactccggaggctgaggcaggagaataacttgaacccggcaggcggaggttgcgatgagccgatattatgccatcggcaacagagcgagactccatctcaaaaaaaaaacaaaaaacaaaacaaggcgagctctgtgctgggacagattagggacccctctttacagcaagaaagactgctctgtgggttgtaggatgcctttgtgtatgcagtggctctaggtgactctggcagccacactctgggccctaaacttctggaggaagatacaggatagggaggaactcaggggtgagtcatggtggggacaagacattccctcactctaagaccttgtcactagattggaacatctcttgcctccctacacctgacctgatggttctggagagatacgtccttgcagcttctgagtcccagcactaagcagcctttggtaacttccctacatcatttgagttctggtttcctaaggatgcttgccagtgagtgccatggtgccctcattgcacagtctgtgcagtgtagacaagaggggaagtctcttggggtagaccagccgcaaggcggtgactagcactgatgtgaaccacatgggacaggggagttgtggggctgagaacacggagggtgggagtagtcatgctcttttccagaatgaactgctaacgaagggactcgcaggtggctgctgcttctttccaagctgcccctgttgttgcagaggctctggagtcctaggaggtttcacggtggcatactcgacagagtactagagcatcatggccagatagtgatgctggggtgtggggcctcacggtggccatttctgacgagaccccaccgggccaaagtgatgtgtagagaaggagctgcttcggtcaccagaaaagaacggggaagcctcccacactagaataggtagggtgctcttctccaccggcaggaaggggatgtatggctctgcctggaccacacctttttccttgctcttccctccgcatctgctgtggccgaggccattcctcatcagggaacatgtgttagaggctcacgccacctgggaccacttgtcttatcacccccaggaccctaggcggtagtttcctgtggcctgagttagctgatatttatatagtgccattgtgccttttctcctgtgatgctcacagtaaggatgcctagatggggttacctgttgtcaagataaggaaactgaagcacagaatgctgaggtcatttgctgggttcatgtttggaaagcggcaaaggatttcagtgcaggttggctggctccaaacctgtgtgtgctttccatgacactgtactgtgtgcctcattgagcctcattctagaaaaccaaaaacacacccaaggcccggccttcacaaaggagacccctcccccatttggctccctttccagcagtcgacggcctcttgtcagccatcgagcccagagtcccttgaagtgcgactcatgctggggtggtatgctcaggagccgcagtgtttccgctcagaggaaagggctctgattctcctgcagtgctaggagacttgtgggtggccacagtgcaggtcaggcacaccggccagcaccacccacagcccaaattcctaaagaaatatttgggtcccagcttggcccgagtctctgttgtcctggggaaggacatcaagatctgagtgtatgatggcctggggccttgcatgtggtgggggtccaagcctgcctctgctcacttgttctgcagactggcatgttctctgtgatacttacatacttgtttaacacttcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaagtaagtaagagcaactcctatctctacagggcagggagggcagggacaaggatccctcatggagcaggaaaatgtatgtgcccagggtggggtcggggggaacataaacaatgaacactgagaccaggtgtgcttgaaatgaccgtgtacagaggtcgctgccctgagtgggaagttctcaaggtagcaggccctctatcctctccacacctcaagtctttatctggggatggaatagctgcggaagcagaggaacttgcagagctaggggttcagaggggtgaagaagcatgtttcagttctgccttttaaatgatcccaaaaaggttagcagttttcaaatgacatttgcagacagcctcatttaattccatgagaagggtgagcaaaggattatcttgttgaaactgattcctggagagactgagcaccgtacctgagttcaaacttgggaatgttctagatggtgactcaggcccaggcaccaaccagcagaatgggcctcagcctgacaacccttctgtaccaggcctgactctttggttgctgaactttggagaggcctgggggggtcagcggcaggcagacgagtgagtggctttggtgacaggtcctcaggggcagccaggcagtgtgactctcgttcaatagtaacgtttgtcagagcgttgtcaccaccatccgctctgccctatctctgacattgctatggagagcctctaattgttccttgtgtctttctgtttgtccccacagtccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtaca

SEQ ID NO: 70 - DNA, 4105 bp, Homo sapiens
gtggtccttgaccctcatcattttgtcccatctcctatgctgggctctgtatccttgtctccaagcagtctcgtgtgacagggaagttacctattattgtatggtcccctcttcttgtcacctctggtgtggcacttgttccatttcttgttcaatgaatgtgatttgtgaatgtgccacatctgtgggaggaaggcagttcgcagcaagagttgtagttcccttgctttgccctgagggccaggactttacactagatttttttgttgcattcctgcactcataaagtacacgtaaacttagaggtggtgtgttaaatgctagaacttaaaactgagttcagctaggctcaagtgccccacaatttttgtcccaccagacaatttcatgaatatctacagattgttccctcaatatgcctcaatattgaggcatattgatttggggagcacagacaagtcaaggttgatgtgcatccgctgaacatgatcttaagttgttgaagtaggtattattaatgaacgaacgtctattttagctccaagagcccctggtcttccagaagagactcccaatgatcttccagaagcagctgggcttcttttggtcctcccccacccaggtgcagtcccgttctccctgcctgggtgagtttgattcctctgccgtggaataggctaggctgctacctcttgagcctcttccaccaggccatccattaggtggcgacagagagcactaaaaggaactactatggaaataaaacttgttttgcttcttggggggaaaaaaaaagaaaaaggcttgtggggcgtgtgtgcattttagtcagattttactgtgcaaaacatttgagagatttctgccctctttctcccttccattcttctcaacccactgggcgccctaccacccctgtctccttcaagataaggtagatcagaagaccaaatagacaaatgccatgtccactgttttctgtcacagttgatagccataccagtcacccaagctggaaacccaacaggcccctgcccttcactgcccacatccaagggagccaccaagtcccacaaattgttcctttaactgtttgtccctcttttgtcttctgtcatcccttctaccgctgtcctggttcaatccctcatcttgctctgggactcccatgataacttatgatctttcctccacctctctatcttccacacaatccctatcatcaatctcattcccctgctttaaacccaagagtggcaccctgtgtttgagtgacatcagggcccctcatgtggctcctgcttctctttgtggccccttctgttgctgctgcttttcttatggacatagccctcagcagtccaggactgcttgtagttcctcccaggtaccatgtttcttgcactcctggcctttgtcattggctcccctgcccaagtccccttctcttctcctttccttcccctgtggccttgccttgtcgtgcttatccttgaagaccctgtcaggtatctcttccccaaagagccctgcctaaccaccgcccccctcccccccgcgacacacacacctgggttaggccctgcctctccacgcctgtgcctcctgccaagtcctcagaggtctctgatcccatgtgcctccaggcatggcatagggggactgtgacacagcctctcggcccacagacccctgattgtgggcttgctcactgccccagtcagtcctcttattgaggattccgtgccagttcctgactccagcacacacacgcatgtaggccgccctcctagtgcctggctccttccctgtctcttctgccactcattcccatggtcgtatcctggagttggtcatctctggaactccacccacggagttctaacttagctctgcctatgatgaggacttactgtcttcccagcttgcagtgtcaaccactgtttgatgcccctgggactccattggtcttccctcctcttgtgaactgtgcccatcaccagacgaacttgttttagaatttaccatcgtaactgagctcccttcagcgcatacctccttggctcctgctcagtctctgtttctccttttagccaaactctctaagagttctctccactcatgggccctcttccttgcctgctgctccttgctcagcttgctccatgaacacttgcttttccacattccatgaaataatcttaacagtcatcagtggctgtcactccttctcagccctttccttgtgtctcttctggtacctcatactctccaggtggccatctcacctcacatcttgaaccctctgggtttgggagaattctcacctcacgagttgatgggaggcctggcgacctctgattgtagtcactgcaaatgccagatgcttatttgcctagcttccctttcggtcagggcagcagttggcaaacggtatctcaagggccaagtccggcccactgcctgttttcgtaaatgaagctttaccaggacccagttccaccccgtcctttgtgcattgtccaagactgctctcctgtacaacagcaggtgggctggttgtgacagatactgtctggcccacaaggtggaaaatactatctggccccttacagaaagaaattacctgagttctacacgagggtgtaggtatgtaccctggcctctgccagtcagactcacatgctaggaggagcagggccaggcaggagagccgtgtctcctggcattggggctgcaggaaagacgagctcctaggccacagtgccagtggccagtgctgctgccttgcagggtcgcacaggcagtgctggctgtttggactggcttggcagaaggatttgaagtattgttcctagccaactggactcaaacctgttcctccaaccctctagggattctcttatcacccagtagccttttccccctagttttaaaaattgcagtaaaatacacaaaagataaaatgtactgccttaaccatttttaagtgtacaattctgtggtattgagcacatttatattgtgcaaccatcaccacatgcatcttcaatagcttttcatcagtccttgtctgcataaatcagctagagttggtttctattgattgccaccaataatcttgacagatatgtctgatcttccttctctgcactgactcctctttctctgtctcctctgctgattctttctcctcatcacaactccaaatagcagggggagggttgtttacacttatattcagcacgccctcacgcactcgcctggctcttcagacctctcccctgaactccagattcatacatccagctgccctttaggcctctagaaagctaaatacctcagtatcaaaaacatgagaaacggaagccagagtcctggatctctcgccctttcgctgtcccggtgcccatgcccttcagggatggcacctagaccagctccctgcatccctgcctagactctgcagtagtctcacgtggcagacccggaggtcactctcctctctggatgccctgcggacactccggttagcctcagctgcaagagcctcctcacccaaggtcacgccatttccaggacagcaccctggtgactgagcgaggtaagggtacaaggcccttatagggccttctctttgacttcttcccacctccctttatggatgtcagttcctgatgaacatcttacacctcaaaccgtgacccaacatctgcttctgcagagcccccctgtggcatcttgtgccctcctgccccactccctctactctatatcttcccatagttagaatgggctttttttttttttttttgagataaggtctccctttgtcacccaggctggaatgcaatggcacagtcacgactcactgcagcctcaacctcctgggctcaagcagtcctcccacctcagcctcccaagtagctgagactacaggtatgcaccaccacacctggctaatttttatattttttgtagagactggggtctccctatgttgcccgggctggtctcgaactcccaggctcaagcaatcctcccgccttggcctcccaaaatgcaggattacaggcgtgtaccagtgtgcccagcctcagatggg

SEQ ID NO: 71 - DNA, 4046 bp, Homo sapiens
ggtcttcatctcttgaccttgtgatctgcccacctcggcctcccaaagtgctaggattacaggcatgagccaccacgctgggcctgctgttggcattttaaacatccttctagagtctttcttatttgcctgtaagcacgtacacatgttgttgttgttttgagacaaggtctgtcgcccaagctggagcacagtggtgcaatcacagctcactacagcttcgacctcttgggtgcaagtgatcctcccaatcagcctcccaagtaggtgggactacaggtgtccgctaccatgcccagctaatttttgtattttttttgtagagacggagtttcaccatgttgcccagactggtctcaaactcctttgctcaaacgatccttccgcctcggcctcccaaagtgccgggattacaagtgtgcacctctgtgcctggcccacatattgttttagatgaatgagatcatatatgtacttttgtaacttgctacctttcctcaacaaaatgttgtaaatatccatgtccataaaaatagacgtatatcttcacttttccctaaaatgaaaataacttaacttgcattttcttttttgtttttgtttttgttttgagacaggctcttgctctgttgctcaggctggagtgcagtgatgtcacagctcactacagcctccacctccagtttcaagtattccacctacctcagcctccaagatagctaagactacaggcacatgtcacgacgcctggctaatttttaaaatattttttgcagaaatgggatttcactatgttgcccaggctggcctcaaactgctggcctcaagtgatcttcctgccttggcctcccaaagtgctgggattacagtcgtgagccactgtgcccagcctgcattttcttattataaaagtaatacatgttcaatggacaaaaaattttcagaaaatatgcaaagatgaaaagtaaaaattgtccataaatctgtcatctacagataaagataacttctggataatgtttttctaccatcatttttagtaatcacataacatttcgttgtatgtctatgccttcatttaattaagaggcatttccattatttctgcatgttcatgactctgaatgatgatatgtctgcctgctgatggctacaaccctgtttctgcatttcaaacctctctcttgagctccagatttgatggcctcgtcagcatttacttgagttgctcataagtgtctcaaatttaacaagtcccagtcttgatttttttcccccttcaaacctattcctcatgttgtctctatttcagtaaacaatatcaacatccacccagttactcagtccaaaattctaggagtcatccttgattctgctctttctttttttttttttttttgagacggagtctcgctctgtcgcccaggccggactgcggactgcagtggcgcgatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcttttttttttttgatacggagtctcattctcgtcatccaggctggagtgcagtggtgcaatcttggctcactgcaacctccgcctcccgggttcaagcaattcttctgccccaacctcctgagtagctgggcctggctaattttttgtatttttagtagagatggggtttcaccatgttggccaggctggtcctgaactcctgaccttgtgatccgcccacctcagcctcccaaagtgctgggattacaggcgtgagccactgcacccgccctgattctgctctttctctcatcatccctgatctgtcagcaagtcctgttaggccaaccacttctcagcatctgcactgccagtatgctagtccaagccacaaaacacctctcagaggtacgcaacaggactttgttgttgttgtgtgtgtgtgtgttttttttttttttacggtagaattattttataacttgaagtgtagggatgaccttccttttaaaattttatttattttcttaattttttattcccatagattttaggggaacaggtggtatttggtgacatgagtaagttctttaatggtgatttctgagattttggtgcacccatcacccgagcagtgtacactgaacccaatttgtagtcttttatccctcaccccctcccaccctttccctcaagtccccaaagtccattgtatcattctgatgcctttgcatcctcatagcttagctcccacttatgagtgagaacatacggtgtttggttttccattcctgagttacttcacttagaataatagtctctagttccatccaggttgctgtgaatgccattaagtcattcctttttatggctgagtagtattcctttgtatatatatgccacaatttctctattcactttctgattgatgggcatttgggctggttctatatttttgtaattgtgaattgtgctgctataagcatgcgtgtgcaagtatcattatgcaacgggacttcggatgacatattgaacaacttcctcactgatatccttgtgaaacgctacatatttcatgggtctgtttgttataccaacactcaattctgaatgatggaattatttcacatttagtctctttttcatctagccattatagtttagtttaaacaccaagttccattcctgctgcatgctgaaggatttgcagtacatcaggctatagtccatcaattcattccacaattgagtaagtaaggtatctatagtacctcaggccctgtgttaggcagggatggggtaacctagacagatttggtacctgtcctcatggagcttgactttagcggcagagacagatcttagataattgtaccagtacttaagtgttcagaaggacaagtatggaggtgggagccactccagtcctctacagtcacgtgctgcacaacaacgtttcaaccgacaacagagcacacatacagtggtgttcccataagattagaatgccatatttttactgtaccttttctatgtttagatatacaaatacttaccattgtgttccagtgatctacagtattcagtatagtaccatgctgtacagttttatagcccaggagcaataggctatataccgtatagcctaggtgtgtagtatgctacaccatctagatttgtgtaagaacactctctgatgttagcacaaataaatcgcccaatgacacatttctcagaacatatccctgttgttgagcgactcatgactgtacaatgggggaacagctcagcctgccttccccaaggaggcaacgccgatgcagggaaccgagggttgaacagaagtgggcaaggtgcagagaggaaaaaggctttccagatggagaagagcatgtgtgaaggccctcagtctggcaagagcttagtcctgtgtggcaggagctgaacgaggggttaggggagagtggcaaagggtccgggccatcagagaggtcaacaggggctggatcatgcaggattttgaatgttaacatcagagcgatagaaaacatgaagggtaaggtggtttgggttttgaatttttatcaaaatattgcaactactcggcaacaagttagatataacaaaagaggtcatcgtaaaaacagcagtctaccccttccccttcccttccctgactcagacatgacagcttttaactgtttctgattttagttcctttgatggttacctccaaaattaaatcatatgcttatacatctttcttgatttgccaactttagggaactgtgttaactccctgaaatgaaagagaatgacttagcttacgttacctccccatgttgaaattcatattcacatttctctgtaatttttt

SEQ ID NO: 72 - DNA, 4041 bp, Homo sapiens
tttcatatcatattatagttgttacagatattttgaaatatatatgtccatcactgcttcaaacttaaggtaattattagacccatctctagatctggttatttaatgatttactgaagaagcacatattatttgagaacgaactcttgaaatatgttgttaatttctgtgcattttacacatttcaaaacattcttctgaggaggggtccagaaggccaaaagggtccatggcagaaaaaggttaagaacacctgttctgtactttgtaccatgtggctacaaatataaaaacagacgttaagccgggtatggtgatgcacacctgtagttccacctacttgggaggctgaggtgggaaaatcacttgagcccaggagtttgaggccagcctgggcaacagagcaagaccccatctcttaaaaaccagtcagcacttgactagtcagttagtgggggaaaacacaggtacagtaaaaggagtcaaaattacacttaaacttaggtcatcttattatatcaaacatttattaacatgtttagtgttttgtgtatattatgcaaagtgtaatgcaactaaaactgtttaacacttctcgatatcacataaatttgttggtgcataatagcctaaaagttacttttgctgttggcattttattttattacttacttatttatttatttatttatttattttgagacagagtcacactgtcgccaggctggagtgcagtggtgcgatctcagctcactgcaacctctgcctccctggttcaagcgattctcccgcctcagcctcctgactagctgggactacaggtgcgcgccaccatgcccagctaatttttgtatttttagtagagatagggtttcgccatgttggccaggatggtcttcatctcttgaccttgtgatctgcccacctcggcctcccaaagtgctaggattacaggcatgagccaccacgctgggcctgctgttggcattttaaacatccttctagagtctttcttatttgcctgtaagcacgtacacatgttgttgttgttttgagacaaggtctgtcgcccaagctggagcacagtggtgcaatcacagctcactacagcttcgacctcttgggtgcaagtgatcctcccaatcagcctcccaagtaggtgggactacaggtgtccgctaccatgcccagctaatttttgtattttttttgtagagacggagtttcaccatgttgcccagactggtctcaaactcctttgctcaaacgatccttccgcctcggcctcccaaagtgccgggattacaagtgtgcacctctgtgcctggcccacatattgttttagatgaatgagatcatatatgtacttttgtaacttgctacctttcctcaacaaaatgttgtaaatatccatgtccataaaaatagacgtatatcttcacttttccctaaaatgaaaataacttaacttgcattttcttttttgtttttgtttttgttttgagacaggctcttgctctgttgctcaggctggagtgcagtgatgtcacagctcactacagcctccacctccagtttcaagtattccacctacctcagcctccaagatagctaagactacaggcacatgtcacgacgcctggctaatttttaaaatattttttgcagaaatgggatttcactatgttgcccaggctggcctcaaactgctggcctcaagtgatcttcctgccttggcctcccaaagtgctgggattacagtcgtgagccactgtgcccagcctgcattttcttattataaaagtaatacatgttcaatggacaaaaaattttcagaaaatatgcaaagatgaaaagtaaaaattgtccataaatctgtcatctacagataaagataacttctggataatgtttttctaccatcatttttagtaatcacataacatttcgttgtatgtctatgccttcatttaattaagaggcatttccattatttctgcatgttcatgactctgaatgatgatatgtctgcctgctgatggctacaaccctgtttctgcatttcaaacctctctcttgagctccagatttgatggcctcgtcagcatttacttgagttgctcataagtgtctcaaatttaacaagtcccagtcttgatttttttcccccttcaaacctattcctcatgttgtctctatttcagtaaacaatatcaacatccacccagttactcagtccaaaattctaggagtcatccttgattctgctctttctttttttttttttttttgagacggagtctcgctctgtcgcccaggccggactgcggactgcagtggcgcgatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcttttttttttttgatacggagtctcattctcgtcatccaggctggagtgcagtggtgcaatcttggctcactgcaacctccgcctcccgggttcaagcaattcttctgccccaacctcctgagtagctgggcctggctaattttttgtatttttagtagagatggggtttcaccatgttggccaggctggtcctgaactcctgaccttgtgatccgcccacctcagcctcccaaagtgctgggattacaggcgtgagccactgcacccgccctgattctgctctttctctcatcatccctgatctgtcagcaagtcctgttaggccaaccacttctcagcatctgcactgccagtatgctagtccaagccacaaaacacctctcagaggtacgcaacaggactttgttgttgttgtgtgtgtgtgtgttttttttttttttacggtagaattattttataacttgaagtgtagggatgaccttccttttaaaattttatttattttcttaattttttattcccatagattttaggggaacaggtggtatttggtgacatgagtaagttctttaatggtgatttctgagattttggtgcacccatcacccgagcagtgtacactgaacccaatttgtagtcttttatccctcaccccctcccaccctttccctcaagtccccaaagtccattgtatcattctgatgcctttgcatcctcatagcttagctcccacttatgagtgagaacatacggtgtttggttttccattcctgagttacttcacttagaataatagtctctagttccatccaggttgctgtgaatgccattaagtcattcctttttatggctgagtagtattcctttgtatatatatgccacaatttctctattcactttctgattgatgggcatttgggctggttctatatttttgtaattgtgaattgtgctgctataagcatgcgtgtgcaagtatcattatgcaacgggacttcggatgacatattgaacaacttcctcactgatatccttgtgaaacgctacatatttcatgggtctgtttgttataccaacactcaattctgaatgatggaattatttcacatttagtctctttttcatctagccattatagtttagtttaaacaccaagttccattcctgctgcatgctgaaggatttgcagtacatcaggctatagtccatcaattcattccacaattgagtaagtaaggtatctatagtacctcaggccctgtgttaggcagggatggggtaacctagacagatttggtacctgtcctcatggagcttgactttagcggcagagacagatcttagataattgtaccagtacttaagtgttcagaaggacaagtatggaggtgggagccactccagtcctctacagtcacgtgctgcacaacaacgtttcaaccgacaacagagcacacat

SEQ ID NO: 73 - DNA, 4048 bp, Homo sapiens
gggtttcactgtgttgcccaggctggtcttgaactccttgggcttgagtaatcctcctgccttggcctcccaaagtgccgagattacaaccatgagccatggagcccgacaagagtagccttttatttgcagaccattagagaaaaagttgcgtgtaagtagataagcatacgaatttatcactgcaatactgtttgtagagatcacagagctgttaggctaggaagaagtttttagcagttagcactagaaagcaaaactttggaaacttccatttcatcaaaagtgacctcatctgagtagggcatgtgagggaaggacctttttactcgacaaggggaacttgccagttcttgtttgtgaaccttgaagaaagtggagcatttttattttgggaccattctaggttgtggtagttccttggtactcggggttggagaatctccctctgctgctggaccttctgcctcctcatgctgtaatatgcataagaggtgtcctagaagtattcaggaacaggctgtggttgctttgttgttctgtgactgttgaactctttatatagcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttcttttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatccacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatggaatgggagtcagctgtggtacaaagtacgctgcttagttctactgattttttattttttatttttacataagactttgatggtaaaggaagcagtgtgtgagcaagctgactcctgtcttgtcaagtaccaggtccactctgatgagcccctgtggacagcactgctgtaactccccaagcctgggctcaggaggtgggccctaagcgctgttcccagctcttcctccatgctgtcagctcttccaccattcttcctggcgtcattctaaggtcctgtcttcccccgccctcttccttcctggcttctacgctcagctcaagtagtagctgtttgggtacttttcacccagacttaggaaatgttatcagttggtcgtattcctgtcagccctcttactatggaactcaaataggacagattcagctgaattcccagccctgtggttgcactctttgtctgccctgcttccccaaggtagcctgctccctaaaggtcaccgagatactccccatgcaaggtttttgttgtattacacatgacaacatggaataaagtgttttgcaaatttactggatgatatcctactatgtggaacatcctacaacttactcttttcactcaacatttgacttttgaacctggtctgtattgctccgtgcagaccaatgttcattcatttgatatgtctccttgtgccatagaaatagttttacaatagaagcctgtccagagccatgagggagaaggggattgtagagaaacaaggattggcatctggtttatgtttacatcctttagtcctgttaaccgagaagaagatatttttatttccatgtttgcgaaagctttccacaaaaaaaagcatccattttctagacttattaatagggcagtccaaaggttttatttttagatttgaaagaaagcaaagtaggcttctgagatatgcacatttccctgtgtccctgtctcttttgcaacattccacattgctgctaaaacttgaacatgagcactttcaagcatgtgcttactttctatgtatgactcattttttaaaacattaaagcattttcggccgggtgtggtggctcacgcctatattcctagcactttagaaggccgaggcgggtagatcacttgaggtcaggagttcaagaccagcctagccaatatagtgaaaccccatctccactaaaaatacaaaaattagccgggcatggtggcgggcgcctgtaatcccagctactcgggaggctgaggcaggagaattgcttgaacccaggaggtggaggttgcagtgagcagagatcgagccactgcactctagcctaggtgacagagcgagactctgtctcaaaaaaataaaaataaagcattaaagcactttgtctggtggtatgtaagttttggcattacttagataagttgtattttaagtctttctacacacaataacttatttttaaaatacaagtttctgtgtacttccgggttttgtgtttttgtaaacagcagaaggtattagtccatattaagtactaatttgttctaatattttcagctgtttttggaattacacttggcaaaaaaatagacaaatgtctgcagttgtgacagtttgtttttttgttctttttaactccagaataaataattctagtgagtttttttcttggcttgtaagaacatgggaatgattagagtcatcataacacttaagtagttatagaaggttgaacatctgtagtcagttgtataaaatttcctagtcatccttccaggttgtttaagacaaacaaatacatagtatttattaagctcttataaattttaattgtaaaacatcattgtacaaaactttgaaaatgcgtataggtacaaagataaaaaattaggccaggcatgccatggctcacgcctgtaatcccagcactttgggaggccaaggtgggaggatcttttgagcccaggagttcaagaccagcctgagcaacatattgagaccctatctctacaaaaatatcataaaacaaaatagaatcactctggcgattccactatccaaaaaaaaaaaaaactgctgttaatatttggtatgtatctttctagaccaaggcctccaactttggttgagaattcagccgggtctgtgaccttggatgggaaaaacattcactctttattttcactaatgtctctgaaaacccagatttttagctgggcatggtggctcgtgcctgtaatcccagtgctttggaagcccgtggagggcagatcacttgagcccaggagtttgagaccagcctgggcaacatagcaagaccctgtcttttaaaaaaaaaaaaaatccagccgggtgtggtggctcatgcctgtaatcccagcactttgagaggctgaggcaggcagatcacctgaggtc

SEQ ID NO: 74 - DNA, 4024 bp, Homo sapiens
ttagaatcggttcatacagagccgtatcattccttttaagggttgggtttaaatagtctgttatggatgtaccacaatttatttaaccagtttttaaattttttacttattttttttaatgtttttttagagacaggatcccactccatcacccagactggagtgcaacagcatgatcatagcttactgcagccttgaactccggggctgatgtgatcctcccacctcaggctctcttgtagctgggactacagggatgtgccgccatgcctggctaaattttttatttttatttttatttttatttttggtagacacggggtttcactgtgttgcccaggctggtcttgaactccttgggcttgagtaatcctcctgccttggcctcccaaagtgccgagattacaaccatgagccatggagcccgacaagagtagccttttatttgcagaccattagagaaaaagttgcgtgtaagtagataagcatacgaatttatcactgcaatactgtttgtagagatcacagagctgttaggctaggaagaagtttttagcagttagcactagaaagcaaaactttggaaacttccatttcatcaaaagtgacctcatctgagtagggcatgtgagggaaggacctttttactcgacaaggggaacttgccagttcttgtttgtgaaccttgaagaaagtggagcatttttattttgggaccattctaggttgtggtagttccttggtactcggggttggagaatctccctctgctgctggaccttctgcctcctcatgctgtaatatgcataagaggtgtcctagaagtattcaggaacaggctgtggttgctttgttgttctgtgactgttgaactctttatatagcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttcttttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatccacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatggaatgggagtcagctgtggtacaaagtacgctgcttagttctactgattttttattttttatttttacataagactttgatggtaaaggaagcagtgtgtgagcaagctgactcctgtcttgtcaagtaccaggtccactctgatgagcccctgtggacagcactgctgtaactccccaagcctgggctcaggaggtgggccctaagcgctgttcccagctcttcctccatgctgtcagctcttccaccattcttcctggcgtcattctaaggtcctgtcttcccccgccctcttccttcctggcttctacgctcagctcaagtagtagctgtttgggtacttttcacccagacttaggaaatgttatcagttggtcgtattcctgtcagccctcttactatggaactcaaataggacagattcagctgaattcccagccctgtggttgcactctttgtctgccctgcttccccaaggtagcctgctccctaaaggtcaccgagatactccccatgcaaggtttttgttgtattacacatgacaacatggaataaagtgttttgcaaatttactggatgatatcctactatgtggaacatcctacaacttactcttttcactcaacatttgacttttgaacctggtctgtattgctccgtgcagaccaatgttcattcatttgatatgtctccttgtgccatagaaatagttttacaatagaagcctgtccagagccatgagggagaaggggattgtagagaaacaaggattggcatctggtttatgtttacatcctttagtcctgttaaccgagaagaagatatttttatttccatgtttgcgaaagctttccacaaaaaaaagcatccattttctagacttattaatagggcagtccaaaggttttatttttagatttgaaagaaagcaaagtaggcttctgagatatgcacatttccctgtgtccctgtctcttttgcaacattccacattgctgctaaaacttgaacatgagcactttcaagcatgtgcttactttctatgtatgactcattttttaaaacattaaagcattttcggccgggtgtggtggctcacgcctatattcctagcactttagaaggccgaggcgggtagatcacttgaggtcaggagttcaagaccagcctagccaatatagtgaaaccccatctccactaaaaatacaaaaattagccgggcatggtggcgggcgcctgtaatcccagctactcgggaggctgaggcaggagaattgcttgaacccaggaggtggaggttgcagtgagcagagatcgagccactgcactctagcctaggtgacagagcgagactctgtctcaaaaaaataaaaataaagcattaaagcactttgtctggtggtatgtaagttttggcattacttagataagttgtattttaagtctttctacacacaataacttatttttaaaatacaagtttctgtgtacttccgggttttgtgtttttgtaaacagcagaaggtattagtccatattaagtactaatttgttctaatattttcagctgtttttggaattacacttggcaaaaaaatagacaaatgtctgcagttgtgacagtttgtttttttgttctttttaactccagaataaataattctagtgagtttttttcttggcttgtaagaacatgggaatgattagagtcatcataacacttaagtagttatagaaggttgaacatctgtagtcagttgtataaaatttcctagtcatccttccaggttgtttaagacaaacaaatacatagtatttattaagctcttataaattttaattgtaaaacatcattgtacaaaactttgaaaatgcgtataggtacaaagataaaaaattaggccaggcatgccatggctcacgcctgtaatcccagcactttgggaggccaaggtgggaggatcttttgagcccaggagttcaagaccagcctgagcaacatattgagaccctatctctacaaaaatatcataaaacaaaatagaatcactctggcgattccactatccaaaaaaaaaaaaaact

SEQ ID NO: 75 - DNA, 4043 bp, Homo sapiens
cttctcccctttcccccaccccaccctctggcaactactattctactctttgtctctattggacatatttttgtgtgtttaggtttgtgtatatattttacatgtgtgtataaatacacaagggtatgtgggcgttgtgtttttacacatactataaaatattgtgcacatttgtttattttaatgtatcctgtagattatttagaatcggttcatacagagccgtatcattccttttaagggttgggtttaaatagtctgttatggatgtaccacaatttatttaaccagtttttaaattttttacttattttttttaatgtttttttagagacaggatcccactccatcacccagactggagtgcaacagcatgatcatagcttactgcagccttgaactccggggctgatgtgatcctcccacctcaggctctcttgtagctgggactacagggatgtgccgccatgcctggctaaattttttatttttatttttatttttatttttggtagacacggggtttcactgtgttgcccaggctggtcttgaactccttgggcttgagtaatcctcctgccttggcctcccaaagtgccgagattacaaccatgagccatggagcccgacaagagtagccttttatttgcagaccattagagaaaaagttgcgtgtaagtagataagcatacgaatttatcactgcaatactgtttgtagagatcacagagctgttaggctaggaagaagtttttagcagttagcactagaaagcaaaactttggaaacttccatttcatcaaaagtgacctcatctgagtagggcatgtgagggaaggacctttttactcgacaaggggaacttgccagttcttgtttgtgaaccttgaagaaagtggagcatttttattttgggaccattctaggttgtggtagttccttggtactcggggttggagaatctccctctgctgctggaccttctgcctcctcatgctgtaatatgcataagaggtgtcctagaagtattcaggaacaggctgtggttgctttgttgttctgtgactgttgaactctttatatagcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttcttttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatccacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatggaatgggagtcagctgtggtacaaagtacgctgcttagttctactgattttttattttttatttttacataagactttgatggtaaaggaagcagtgtgtgagcaagctgactcctgtcttgtcaagtaccaggtccactctgatgagcccctgtggacagcactgctgtaactccccaagcctgggctcaggaggtgggccctaagcgctgttcccagctcttcctccatgctgtcagctcttccaccattcttcctggcgtcattctaaggtcctgtcttcccccgccctcttccttcctggcttctacgctcagctcaagtagtagctgtttgggtacttttcacccagacttaggaaatgttatcagttggtcgtattcctgtcagccctcttactatggaactcaaataggacagattcagctgaattcccagccctgtggttgcactctttgtctgccctgcttccccaaggtagcctgctccctaaaggtcaccgagatactccccatgcaaggtttttgttgtattacacatgacaacatggaataaagtgttttgcaaatttactggatgatatcctactatgtggaacatcctacaacttactcttttcactcaacatttgacttttgaacctggtctgtattgctccgtgcagaccaatgttcattcatttgatatgtctccttgtgccatagaaatagttttacaatagaagcctgtccagagccatgagggagaaggggattgtagagaaacaaggattggcatctggtttatgtttacatcctttagtcctgttaaccgagaagaagatatttttatttccatgtttgcgaaagctttccacaaaaaaaagcatccattttctagacttattaatagggcagtccaaaggttttatttttagatttgaaagaaagcaaagtaggcttctgagatatgcacatttccctgtgtccctgtctcttttgcaacattccacattgctgctaaaacttgaacatgagcactttcaagcatgtgcttactttctatgtatgactcattttttaaaacattaaagcattttcggccgggtgtggtggctcacgcctatattcctagcactttagaaggccgaggcgggtagatcacttgaggtcaggagttcaagaccagcctagccaatatagtgaaaccccatctccactaaaaatacaaaaattagccgggcatggtggcgggcgcctgtaatcccagctactcgggaggctgaggcaggagaattgcttgaacccaggaggtggaggttgcagtgagcagagatcgagccactgcactctagcctaggtgacagagcgagactctgtctcaaaaaaataaaaataaagcattaaagcactttgtctggtggtatgtaagttttggcattacttagataagttgtattttaagtctttctacacacaataacttatttttaaaatacaagtttctgtgtacttccgggttttgtgtttttgtaaacagcagaaggtattagtccatattaagtactaatttgttctaatattttcagctgtttttggaattacacttggcaaaaaaatagacaaatgtctgcagttgtgacagtttgtttttttgttctttttaactccagaataaataattctagtgagtttttttcttggcttgtaagaacatgggaatgattagagtcatcataacacttaagtagttatagaaggttgaacatctgtagtcagttgtataaaatttcctagtcatccttccaggttgtttaagacaaacaaatacatagtatttattaagctcttataaattttaattgtaaaacatcattgtacaaaactttgaaaatgcgtataggtacaaagataaaaaattaggc

SEQ ID NO: 76 - DNA, 4040 bp, Homo sapiens
caaaaaaaaaagcgtgtgtgtacccgtgtgttaaatttttattataaaatatatataacaggctgggcgtggtggctcacgcctgtaatcccagcactttgggaggccgaggcaggctgatcacgaggtcaggagatcgagaccatcctggcgagcacggtgaaacctcgtctttactaaaaatacaaaaaattagccgggcatggtggcgggcgcctgtagtcccagctactctgagagcctgaggcaggagaatggcgtgaacccaggaggcggagcttgcagtgagccgagatcgcgtcactgcactccagcctgggcgacagaccgagactccgtctcaaaaaatatatatcgatatatataacaatttacagttttaatcatcttaactgtacagttcagtggcactgagtacattcacattgttgtacagccattactaccatccatctctacaacctttcgtcttgcaaaactgaaatttcatacctattaaacactaactcccacttctcccctttcccccaccccaccctctggcaactactattctactctttgtctctattggacatatttttgtgtgtttaggtttgtgtatatattttacatgtgtgtataaatacacaagggtatgtgggcgttgtgtttttacacatactataaaatattgtgcacatttgtttattttaatgtatcctgtagattatttagaatcggttcatacagagccgtatcattccttttaagggttgggtttaaatagtctgttatggatgtaccacaatttatttaaccagtttttaaattttttacttattttttttaatgtttttttagagacaggatcccactccatcacccagactggagtgcaacagcatgatcatagcttactgcagccttgaactccggggctgatgtgatcctcccacctcaggctctcttgtagctgggactacagggatgtgccgccatgcctggctaaattttttatttttatttttatttttatttttggtagacacggggtttcactgtgttgcccaggctggtcttgaactccttgggcttgagtaatcctcctgccttggcctcccaaagtgccgagattacaaccatgagccatggagcccgacaagagtagccttttatttgcagaccattagagaaaaagttgcgtgtaagtagataagcatacgaatttatcactgcaatactgtttgtagagatcacagagctgttaggctaggaagaagtttttagcagttagcactagaaagcaaaactttggaaacttccatttcatcaaaagtgacctcatctgagtagggcatgtgagggaaggacctttttactcgacaaggggaacttgccagttcttgtttgtgaaccttgaagaaagtggagcatttttattttgggaccattctaggttgtggtagttccttggtactcggggttggagaatctccctctgctgctggaccttctgcctcctcatgctgtaatatgcataagaggtgtcctagaagtattcaggaacaggctgtggttgctttgttgttctgtgactgttgaactctttatatagcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttcttttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatccacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatggaatgggagtcagctgtggtacaaagtacgctgcttagttctactgattttttattttttatttttacataagactttgatggtaaaggaagcagtgtgtgagcaagctgactcctgtcttgtcaagtaccaggtccactctgatgagcccctgtggacagcactgctgtaactccccaagcctgggctcaggaggtgggccctaagcgctgttcccagctcttcctccatgctgtcagctcttccaccattcttcctggcgtcattctaaggtcctgtcttcccccgccctcttccttcctggcttctacgctcagctcaagtagtagctgtttgggtacttttcacccagacttaggaaatgttatcagttggtcgtattcctgtcagccctcttactatggaactcaaataggacagattcagctgaattcccagccctgtggttgcactctttgtctgccctgcttccccaaggtagcctgctccctaaaggtcaccgagatactccccatgcaaggtttttgttgtattacacatgacaacatggaataaagtgttttgcaaatttactggatgatatcctactatgtggaacatcctacaacttactcttttcactcaacatttgacttttgaacctggtctgtattgctccgtgcagaccaatgttcattcatttgatatgtctccttgtgccatagaaatagttttacaatagaagcctgtccagagccatgagggagaaggggattgtagagaaacaaggattggcatctggtttatgtttacatcctttagtcctgttaaccgagaagaagatatttttatttccatgtttgcgaaagctttccacaaaaaaaagcatccattttctagacttattaatagggcagtccaaaggttttatttttagatttgaaagaaagcaaagtaggcttctgagatatgcacatttccctgtgtccctgtctcttttgcaacattccacattgctgctaaaacttgaacatgagcactttcaagcatgtgcttactttctatgtatgactcattttttaaaacattaaagcattttcggccgggtgtggtggctcacgcctatattcctagcactttagaaggccgaggcgggtagatcacttgaggtcaggagttcaagaccagcctagccaatatagtgaaaccccatctccactaaaaatacaaaaattagccgggcatggtggcgggcgcctgtaatcccagctactcgggaggctgaggcaggagaattgcttgaacccaggaggtggaggttgcagtgagcagagatcgagccactgcactctagcctaggtgacagagcgagactctgtctcaaaaaaataaaaataaagcattaaagc

SEQ ID NO: 77 - DNA, 4025 bp, Homo sapiens
aggcagaggttgcagtgagccaagatcgtgccattgcactccagcctgggcgacagagtgagactccatctcagaaaaataataatagaaaaaagttatatggggctgggcatggtggctcatgcctgtaatcccagcagtttgggaggctgaggcagcttgatcacttgaggtcaggaattcgagactagcctggccaacatggtgaaactccgtctccactaaaaatacaaaaattagccaagcgtggtggtgcgtgcctgtagtcccagctacttgggaagctgaggcaggagaatcgcctgaacctgggaggcagaggttgcagtgagccaagatcatgccgttgcactccagcctggacgacaagagcggaactccgtctcaaaaaaaaaaaaaaaagagttatattgtaaagtatctctgctaccctgccccaaacattcatttctttccctggaggcagccactattacctgtttctttaaaaaaaaaaaaaaattgtggccgggcacggtggctcacgcctgtaatcctagcactttgggaggtggaggtgggtggatcatgaggtcaagagatcgagaccatcttggccaacatggtaaaaccccatctctactaaaaatacaaaaaattagccgggcatggtggcgggcacctgtagtcccagctactcgggaggctgaggcaggagaatcgcttgaacctgggaggcagaggttgcagtgaactgagatcacgccgctgcactccagcctggcaacagaatgagactccatctcaaaaaaaaaagcgtgtgtgtacccgtgtgttaaatttttattataaaatatatataacaggctgggcgtggtggctcacgcctgtaatcccagcactttgggaggccgaggcaggctgatcacgaggtcaggagatcgagaccatcctggcgagcacggtgaaacctcgtctttactaaaaatacaaaaaattagccgggcatggtggcgggcgcctgtagtcccagctactctgagagcctgaggcaggagaatggcgtgaacccaggaggcggagcttgcagtgagccgagatcgcgtcactgcactccagcctgggcgacagaccgagactccgtctcaaaaaatatatatcgatatatataacaatttacagttttaatcatcttaactgtacagttcagtggcactgagtacattcacattgttgtacagccattactaccatccatctctacaacctttcgtcttgcaaaactgaaatttcatacctattaaacactaactcccacttctcccctttcccccaccccaccctctggcaactactattctactctttgtctctattggacatatttttgtgtgtttaggtttgtgtatatattttacatgtgtgtataaatacacaagggtatgtgggcgttgtgtttttacacatactataaaatattgtgcacatttgtttattttaatgtatcctgtagattatttagaatcggttcatacagagccgtatcattccttttaagggttgggtttaaatagtctgttatggatgtaccacaatttatttaaccagtttttaaattttttacttattttttttaatgtttttttagagacaggatcccactccatcacccagactggagtgcaacagcatgatcatagcttactgcagccttgaactccggggctgatgtgatcctcccacctcaggctctcttgtagctgggactacagggatgtgccgccatgcctggctaaattttttatttttatttttatttttatttttggtagacacggggtttcactgtgttgcccaggctggtcttgaactccttgggcttgagtaatcctcctgccttggcctcccaaagtgccgagattacaaccatgagccatggagcccgacaagagtagccttttatttgcagaccattagagaaaaagttgcgtgtaagtagataagcatacgaatttatcactgcaatactgtttgtagagatcacagagctgttaggctaggaagaagtttttagcagttagcactagaaagcaaaactttggaaacttccatttcatcaaaagtgacctcatctgagtagggcatgtgagggaaggacctttttactcgacaaggggaacttgccagttcttgtttgtgaaccttgaagaaagtggagcatttttattttgggaccattctaggttgtggtagttccttggtactcggggttggagaatctccctctgctgctggaccttctgcctcctcatgctgtaatatgcataagaggtgtcctagaagtattcaggaacaggctgtggttgctttgttgttctgtgactgttgaactctttatatagcagtacttttttaagctgtactaattgagcatttattatgtgtcagttactgtgctagctgctggaaactatcctaccctcagcagtcttctggtctaatgggaggtacagacaggcaaatgggctatgactttacaagaggctaacttctgtgatggagagaagttccagccactaagggagcacataaaaatcagaggagatcctaccaagaattgggaggtaggtcagggaggagacttctttgaaaaatggcatctaagacctgaacagcaaggaaacattagctaggtcaaggacaaagcatcagtggggagagatgcatgagtcttttggaaggaccagcatgtgtagaggctctgacaggagagaatctctcaggcccattcagagagtccactgtgtgaagacgaggcatgaacaaccagccaggacatgtggagaggagcatttttctttttttcttttttctttcttttttttttttttttttttttgagacgtctttctctgtcacccaggctggagtgcaatggcatgatctcggctcactgcaacccccacttccagggttcaagcaattcttctgccttagcctcccaagcagctaggattacaggcacccgccaccatgcccggttaatttttgtatttttagtagagacggagtttcaccatgttggcctcaaactcctgaccttaggtgatccacccgtctcggcctcccagagtgctgggattacaggtgagagcccccacgcccggccaggctcggctttctttccaggccccgtcacactcttagatgttccctgggccccagaaggcagcgtgaggtgctctgcccatctatgctgtccttttccaccccaccctatccactgggcccctggggctcccactccactccaggtctcttcatggacccttctttcccttcacttctgtcccaggagacctgggagactcatgggaacaggcatcatcttctccagcacagttcattgtctaatgcacgaaagtgctgggctgtgagaaggtcaggagcttacatggaatgggagtcagctgtggtacaaagtacgctgcttagttctactgattttttattttttatttttacataagactttgatggtaaaggaagcagtgtgtgagcaagctgactcctgtcttgtcaagtaccaggtccactctgatgagcccctgtggacagcactgctgtaactccccaagcctgggctcaggaggtgggccctaagcgctgttcccagctcttcctccatgctgtcagctcttccaccattcttcctggcgtcattctaaggtcctgtcttcccccgccctcttccttcctggcttctacgctcagctcaagtagtagctgtttgggtacttttcacccagacttaggaaatgttatcagttggtcgtattcctgtcagccctcttactatggaactcaaataggacagattcagctgaattcccagccctgtggttgcactctttgtctgccctgcttccccaaggtagcctgctccctaaaggtcaccgagatactccccatgcaaggtttttgttgtattacacatgacaacatggaataaagtgttttgcaaatttactggatgatatcctact

SEQ ID NO: 78 - DNA, 4046 bp, Homo sapiens
actgaacctcaaaagataattttaggtaccatcctggtagctgtagagcagcaacagaccagtaaaagacttggttggtgttgcccttcttctgggtttgattacatgagtaattgtgtgaatagtctctaagttgtatgctctgagctttcgtttttagcttataaaagtgctactcttgggccagcatagtatcagaaattagctaattcatatggggcagtttaggctttaactaggaaatgatggttatcttaatgacaaaaaaggtactgacaaaagtccttttttgaacatgtgttcaaaagaaaaagagaaactatcaaactaataactgagtttgttgaacatcgagattgactgatctgagaggcttaaaactgattgccctgaaatagacttgcatgttttggatgatggctttgggtctcccagagcacttggtttcccttggtgctgattttttctctcaggattaaagcccctttatgtgatgttgttacagcagcttattgcaacttcattcagctgcttgaaaaagaagggagactgcctctaggttccatgtgttctttcagggatggtattttgatgttgcgtattctcttgaacatgtattcttccctgagaatttctgtgtgccgtggtagaagaaatacttgccagaaatcgccactcatggtatgcttttgtagtgtcgaagtgtcccctagaggtgacaaggcttgtgatagtgttgattctaacaagcatgaatctttcctttattttagcactgtgtgttacgtgccagtaatttgcagcttatcctttgtttctagctaggtaagctgggaaatagcctagtactttgtctatgtgtttatcttcaaaatgtcccaaatagccctgggaaaaaggtcgtgcagctcaatgggggctttcaacttacaattttctttgttttaggctccataaaaatacagactcaccagttcctgctttgatgtgacatgtgactccccagaatacaccttgcttctgtagaccagctccaacaggattccatggtagctgggatgttagggctcaggtaagtaaccttcctttttttttttttagtatatgtcctggtttggccatctgttttttttttttttaaaaaaaaaaaaaaaaggaaaagaggaaaaaaatatactactcttggacagtataaaagtaccccaaagactaaagacataactgtgccaaactgtgccatataataaaaaaaagtcacttccctgagccctgaaaggtcagtgtgtgtagggttacttggtcgccacagcgtgatctgggggcgggcgtcagattagagccggaactggtgatctgcaacttcagttcaccttgaagcaggtcagctgagctgagagcgcttgcactgagcccttttgcgctgctgctgttgccttagcggtcttcagcatgtgtttgctttggtttggggtaaatggcttagtggtcaacattagtgagcagtggtaatgcattttcagatatgggaactggtatgtggttggttccctagaaggacaccctcctgaaagctgtctcagaacaccgggggccatggctaatgtcatgtgcttgctacactcctcccatggtaactaaagagagtacccagatatacatctggttcttgggactctagaggaggatgagtactttgtaaaaacctgggggccccagtcattctaggtctgacactcaggtgctgtatcagctgcagtttgaactacttggcaccattgtgtggactttagttttgtaaaaatgaatggttccttaatttctcaaccttcaggctcaacatctcaagctgtttgttgttgttgttgttgttgttgttttgttttgtctttttgattagtggtcactccgcatttgatgttttgacatgtggatttcagaacttctgtgtggtaaagcagaatgttccaattgaattttcccattttttttcccctaagcaaaaatgtgagttttcacttatgcggccattgtgattccgactgagaccctaagtcgttctttgttgtctctctagtggtttctgacacctcagtgtgaagctgttgtagacatccataagaaatagcctgcttagggattatgtgagggcaaggtttggctgaaggagaatagaaggtgtggaaggaagcggaagaccagaagagcatcacactgcctcaagtcccaaatttgattctgctcctgatcctgtgactcaaattgtcattctcttttactgctgtggggtgtgctctgggcccagctgacaggacattctttgtactccacgtatttatgctggtgggagttgtatggctagtgctttgtgctttgtctcagaaattgtgtggactaaatgtaatatgggcagtgaatgggtttcttctggaagatgttaggcctggagggtggtttgggtttttacgagtctttttctcagattacagattacgaatggatgttataaaacaggcagtgttgacaccatacagtttctcctaagaaatgtacagagagttcaacctgaggaagctaattgaaaataaacttttaaaaagaaatgtagaaagaggaaatttaaaaagtatcttatgaatgggaaagatgtagccatttgagcttcaaagaacttttgagggaattctcaaaggacagtacccgtctttagtagataaatgcttgatatctatttttcttcttttactttttaaagaattactaaaataatacatggatttatagaaaaatcaaaccacttaaaaattgatcaggtggctgggcaaggtggctcatgcctgtaatcacagcgctttgggaggcctaggcgggtggatcacctgaagtcaggagttcgagaccagcctggctaacacggcgaaaccccatctctattaaaaatacaaaaattagctggccatggtggcttgagcgtgtagtcccagctactcggaaggctgaggcaggagaatcacttgaacctgggaggcggaggttgcagtgagccaagatcacaccactgcactcctgcctgggtgacagagtgagactcggtctcaaaaaaaaaaaaaaaaaaaagtatcaggtaaaaaaatgaaagctccccgcttaatctctgctcccactacccagaataactgctgttaatagcttaatgtagatccttctaagtcttctaagactaaactgtgtactttttgtgttgtaattaacaggagggtttttgttttgttttgttttttctttttttgagatggagtcttgctctgtcatccaggctggagtacagtggcacaatcttggctcactgcaacctccacctcctgggttcaagtgattctcctgcctcagcctcctgagtagctgggattacaggcgcctgccaccacacccagctaatttttgtatttttagtagagatgggtttcaccatgttggccaggctggtgtcgaactcctgacctcaggcgatccacctgccttggcctcccaaagtgctgggattacaggcgtgagccaccgtgcctggcctcaggatggtgttatatatacatattctgcatttttccatctcatatattcatctctgcctcatttcttttaaatagcagtgtagtccagggctgacttaccgtcatgcatttcgttgtctctctatgttattaaaaatgctacaggattgaaattcctcatgtgccagtcattttgaagaatggctgcctagacttggaatttctggtggataccaccacatcactgtccaaaatggctatcccagttcccacaacagtctgagaaagtgccattttcccatatcgtcccagaattggatatacatcttttaaattggtgccgcttggattattactgaggctaaacctcaataatcattgtcatagctcttaatgtattaaagatgttaactctttgtcatgcagatattttcctgttttgtcttacgtcttgattcttgtctttctgatatataaaatttatgttatgatttattc

SEQ ID NO: 79 - DNA, 4053 bp, Homo sapiens
tagccgagtaatactattaacttgacttctgggatttcaaagtattctatgacttgactgtttaagggaattatgaggcctcactgaacctcaaaagataattttaggtaccatcctggtagctgtagagcagcaacagaccagtaaaagacttggttggtgttgcccttcttctgggtttgattacatgagtaattgtgtgaatagtctctaagttgtatgctctgagctttcgtttttagcttataaaagtgctactcttgggccagcatagtatcagaaattagctaattcatatggggcagtttaggctttaactaggaaatgatggttatcttaatgacaaaaaaggtactgacaaaagtccttttttgaacatgtgttcaaaagaaaaagagaaactatcaaactaataactgagtttgttgaacatcgagattgactgatctgagaggcttaaaactgattgccctgaaatagacttgcatgttttggatgatggctttgggtctcccagagcacttggtttcccttggtgctgattttttctctcaggattaaagcccctttatgtgatgttgttacagcagcttattgcaacttcattcagctgcttgaaaaagaagggagactgcctctaggttccatgtgttctttcagggatggtattttgatgttgcgtattctcttgaacatgtattcttccctgagaatttctgtgtgccgtggtagaagaaatacttgccagaaatcgccactcatggtatgcttttgtagtgtcgaagtgtcccctagaggtgacaaggcttgtgatagtgttgattctaacaagcatgaatctttcctttattttagcactgtgtgttacgtgccagtaatttgcagcttatcctttgtttctagctaggtaagctgggaaatagcctagtactttgtctatgtgtttatcttcaaaatgtcccaaatagccctgggaaaaaggtcgtgcagctcaatgggggctttcaacttacaattttctttgttttaggctccataaaaatacagactcaccagttcctgctttgatgtgacatgtgactccccagaatacaccttgcttctgtagaccagctccaacaggattccatggtagctgggatgttagggctcaggtaagtaaccttcctttttttttttttagtatatgtcctggtttggccatctgttttttttttttttaaaaaaaaaaaaaaaaggaaaagaggaaaaaaatatactactcttggacagtataaaagtaccccaaagactaaagacataactgtgccaaactgtgccatataataaaaaaaagtcacttccctgagccctgaaaggtcagtgtgtgtagggttacttggtcgccacagcgtgatctgggggcgggcgtcagattagagccggaactggtgatctgcaacttcagttcaccttgaagcaggtcagctgagctgagagcgcttgcactgagcccttttgcgctgctgctgttgccttagcggtcttcagcatgtgtttgctttggtttggggtaaatggcttagtggtcaacattagtgagcagtggtaatgcattttcagatatgggaactggtatgtggttggttccctagaaggacaccctcctgaaagctgtctcagaacaccgggggccatggctaatgtcatgtgcttgctacactcctcccatggtaactaaagagagtacccagatatacatctggttcttgggactctagaggaggatgagtactttgtaaaaacctgggggccccagtcattctaggtctgacactcaggtgctgtatcagctgcagtttgaactacttggcaccattgtgtggactttagttttgtaaaaatgaatggttccttaatttctcaaccttcaggctcaacatctcaagctgtttgttgttgttgttgttgttgttgttttgttttgtctttttgattagtggtcactccgcatttgatgttttgacatgtggatttcagaacttctgtgtggtaaagcagaatgttccaattgaattttcccattttttttcccctaagcaaaaatgtgagttttcacttatgcggccattgtgattccgactgagaccctaagtcgttctttgttgtctctctagtggtttctgacacctcagtgtgaagctgttgtagacatccataagaaatagcctgcttagggattatgtgagggcaaggtttggctgaaggagaatagaaggtgtggaaggaagcggaagaccagaagagcatcacactgcctcaagtcccaaatttgattctgctcctgatcctgtgactcaaattgtcattctcttttactgctgtggggtgtgctctgggcccagctgacaggacattctttgtactccacgtatttatgctggtgggagttgtatggctagtgctttgtgctttgtctcagaaattgtgtggactaaatgtaatatgggcagtgaatgggtttcttctggaagatgttaggcctggagggtggtttgggtttttacgagtctttttctcagattacagattacgaatggatgttataaaacaggcagtgttgacaccatacagtttctcctaagaaatgtacagagagttcaacctgaggaagctaattgaaaataaacttttaaaaagaaatgtagaaagaggaaatttaaaaagtatcttatgaatgggaaagatgtagccatttgagcttcaaagaacttttgagggaattctcaaaggacagtacccgtctttagtagataaatgcttgatatctatttttcttcttttactttttaaagaattactaaaataatacatggatttatagaaaaatcaaaccacttaaaaattgatcaggtggctgggcaaggtggctcatgcctgtaatcacagcgctttgggaggcctaggcgggtggatcacctgaagtcaggagttcgagaccagcctggctaacacggcgaaaccccatctctattaaaaatacaaaaattagctggccatggtggcttgagcgtgtagtcccagctactcggaaggctgaggcaggagaatcacttgaacctgggaggcggaggttgcagtgagccaagatcacaccactgcactcctgcctgggtgacagagtgagactcggtctcaaaaaaaaaaaaaaaaaaaagtatcaggtaaaaaaatgaaagctccccgcttaatctctgctcccactacccagaataactgctgttaatagcttaatgtagatccttctaagtcttctaagactaaactgtgtactttttgtgttgtaattaacaggagggtttttgttttgttttgttttttctttttttgagatggagtcttgctctgtcatccaggctggagtacagtggcacaatcttggctcactgcaacctccacctcctgggttcaagtgattctcctgcctcagcctcctgagtagctgggattacaggcgcctgccaccacacccagctaatttttgtatttttagtagagatgggtttcaccatgttggccaggctggtgtcgaactcctgacctcaggcgatccacctgccttggcctcccaaagtgctgggattacaggcgtgagccaccgtgcctggcctcaggatggtgttatatatacatattctgcatttttccatctcatatattcatctctgcctcatttcttttaaatagcagtgtagtccagggctgacttaccgtcatgcatttcgttgtctctctatgttattaaaaatgctacaggattgaaattcctcatgtgccagtcattttgaagaatggctgcctagacttggaatttctggtggataccaccacatcactgtccaaaatggctatcccagttcccacaacagtctgagaaagtgccattttcccatatcgtcccagaattggatatacatcttttaaattggtgccgcttggattattactgaggctaaacctcaataatcattgtcatagctcttaatgtattaaagatgttaactctttgtcatg

SEQ ID NO: 80 - DNA, 4059 bp, Homo sapiens
tttttttttttttttagtcgagacggggtttcaccatcttggccacgctggtcttgaactcctgacctcgtgatccacccgcttcagcctcccaaagtgcagggattacaggcgtgagccaccgcacccagcctctggctcttttctttttgacatgaaatcttaagttaattatcttaaactttaagaactagaaggattcttagtccagcaccatcagtttacaaacaaaaaaaacttgtgtccctgagaagttgtgacttttccagggcctcctagccaggataccagtttggtttttattatatagctagccgagtaatactattaacttgacttctgggatttcaaagtattctatgacttgactgtttaagggaattatgaggcctcactgaacctcaaaagataattttaggtaccatcctggtagctgtagagcagcaacagaccagtaaaagacttggttggtgttgcccttcttctgggtttgattacatgagtaattgtgtgaatagtctctaagttgtatgctctgagctttcgtttttagcttataaaagtgctactcttgggccagcatagtatcagaaattagctaattcatatggggcagtttaggctttaactaggaaatgatggttatcttaatgacaaaaaaggtactgacaaaagtccttttttgaacatgtgttcaaaagaaaaagagaaactatcaaactaataactgagtttgttgaacatcgagattgactgatctgagaggcttaaaactgattgccctgaaatagacttgcatgttttggatgatggctttgggtctcccagagcacttggtttcccttggtgctgattttttctctcaggattaaagcccctttatgtgatgttgttacagcagcttattgcaacttcattcagctgcttgaaaaagaagggagactgcctctaggttccatgtgttctttcagggatggtattttgatgttgcgtattctcttgaacatgtattcttccctgagaatttctgtgtgccgtggtagaagaaatacttgccagaaatcgccactcatggtatgcttttgtagtgtcgaagtgtcccctagaggtgacaaggcttgtgatagtgttgattctaacaagcatgaatctttcctttattttagcactgtgtgttacgtgccagtaatttgcagcttatcctttgtttctagctaggtaagctgggaaatagcctagtactttgtctatgtgtttatcttcaaaatgtcccaaatagccctgggaaaaaggtcgtgcagctcaatgggggctttcaacttacaattttctttgttttaggctccataaaaatacagactcaccagttcctgctttgatgtgacatgtgactccccagaatacaccttgcttctgtagaccagctccaacaggattccatggtagctgggatgttagggctcaggtaagtaaccttcctttttttttttttagtatatgtcctggtttggccatctgttttttttttttttaaaaaaaaaaaaaaaaggaaaagaggaaaaaaatatactactcttggacagtataaaagtaccccaaagactaaagacataactgtgccaaactgtgccatataataaaaaaaagtcacttccctgagccctgaaaggtcagtgtgtgtagggttacttggtcgccacagcgtgatctgggggcgggcgtcagattagagccggaactggtgatctgcaacttcagttcaccttgaagcaggtcagctgagctgagagcgcttgcactgagcccttttgcgctgctgctgttgccttagcggtcttcagcatgtgtttgctttggtttggggtaaatggcttagtggtcaacattagtgagcagtggtaatgcattttcagatatgggaactggtatgtggttggttccctagaaggacaccctcctgaaagctgtctcagaacaccgggggccatggctaatgtcatgtgcttgctacactcctcccatggtaactaaagagagtacccagatatacatctggttcttgggactctagaggaggatgagtactttgtaaaaacctgggggccccagtcattctaggtctgacactcaggtgctgtatcagctgcagtttgaactacttggcaccattgtgtggactttagttttgtaaaaatgaatggttccttaatttctcaaccttcaggctcaacatctcaagctgtttgttgttgttgttgttgttgttgttttgttttgtctttttgattagtggtcactccgcatttgatgttttgacatgtggatttcagaacttctgtgtggtaaagcagaatgttccaattgaattttcccattttttttcccctaagcaaaaatgtgagttttcacttatgcggccattgtgattccgactgagaccctaagtcgttctttgttgtctctctagtggtttctgacacctcagtgtgaagctgttgtagacatccataagaaatagcctgcttagggattatgtgagggcaaggtttggctgaaggagaatagaaggtgtggaaggaagcggaagaccagaagagcatcacactgcctcaagtcccaaatttgattctgctcctgatcctgtgactcaaattgtcattctcttttactgctgtggggtgtgctctgggcccagctgacaggacattctttgtactccacgtatttatgctggtgggagttgtatggctagtgctttgtgctttgtctcagaaattgtgtggactaaatgtaatatgggcagtgaatgggtttcttctggaagatgttaggcctggagggtggtttgggtttttacgagtctttttctcagattacagattacgaatggatgttataaaacaggcagtgttgacaccatacagtttctcctaagaaatgtacagagagttcaacctgaggaagctaattgaaaataaacttttaaaaagaaatgtagaaagaggaaatttaaaaagtatcttatgaatgggaaagatgtagccatttgagcttcaaagaacttttgagggaattctcaaaggacagtacccgtctttagtagataaatgcttgatatctatttttcttcttttactttttaaagaattactaaaataatacatggatttatagaaaaatcaaaccacttaaaaattgatcaggtggctgggcaaggtggctcatgcctgtaatcacagcgctttgggaggcctaggcgggtggatcacctgaagtcaggagttcgagaccagcctggctaacacggcgaaaccccatctctattaaaaatacaaaaattagctggccatggtggcttgagcgtgtagtcccagctactcggaaggctgaggcaggagaatcacttgaacctgggaggcggaggttgcagtgagccaagatcacaccactgcactcctgcctgggtgacagagtgagactcggtctcaaaaaaaaaaaaaaaaaaaagtatcaggtaaaaaaatgaaagctccccgcttaatctctgctcccactacccagaataactgctgttaatagcttaatgtagatccttctaagtcttctaagactaaactgtgtactttttgtgttgtaattaacaggagggtttttgttttgttttgttttttctttttttgagatggagtcttgctctgtcatccaggctggagtacagtggcacaatcttggctcactgcaacctccacctcctgggttcaagtgattctcctgcctcagcctcctgagtagctgggattacaggcgcctgccaccacacccagctaatttttgtatttttagtagagatgggtttcaccatgttggccaggctggtgtcgaactcctgacctcaggcgatccacctgccttggcctcccaaagtgctgggattacaggcgtgagccaccgtgcctggcctcaggatggtgttatatatacatattctgcatttttccatctcatatattcatctctgcctcatttcttttaaatagcagtgtagtccagggctgactt

SEQ ID NO: 81 - DNA, 4043 bp, Homo sapiens
tcccgggctcaagcagttctctgcctcagcctcccaagtagctgggattacaggcacctgccaccacgcctggctaatttttgtattttttttttttttttttttttttttttagtcgagacggggtttcaccatcttggccacgctggtcttgaactcctgacctcgtgatccacccgcttcagcctcccaaagtgcagggattacaggcgtgagccaccgcacccagcctctggctcttttctttttgacatgaaatcttaagttaattatcttaaactttaagaactagaaggattcttagtccagcaccatcagtttacaaacaaaaaaaacttgtgtccctgagaagttgtgacttttccagggcctcctagccaggataccagtttggtttttattatatagctagccgagtaatactattaacttgacttctgggatttcaaagtattctatgacttgactgtttaagggaattatgaggcctcactgaacctcaaaagataattttaggtaccatcctggtagctgtagagcagcaacagaccagtaaaagacttggttggtgttgcccttcttctgggtttgattacatgagtaattgtgtgaatagtctctaagttgtatgctctgagctttcgtttttagcttataaaagtgctactcttgggccagcatagtatcagaaattagctaattcatatggggcagtttaggctttaactaggaaatgatggttatcttaatgacaaaaaaggtactgacaaaagtccttttttgaacatgtgttcaaaagaaaaagagaaactatcaaactaataactgagtttgttgaacatcgagattgactgatctgagaggcttaaaactgattgccctgaaatagacttgcatgttttggatgatggctttgggtctcccagagcacttggtttcccttggtgctgattttttctctcaggattaaagcccctttatgtgatgttgttacagcagcttattgcaacttcattcagctgcttgaaaaagaagggagactgcctctaggttccatgtgttctttcagggatggtattttgatgttgcgtattctcttgaacatgtattcttccctgagaatttctgtgtgccgtggtagaagaaatacttgccagaaatcgccactcatggtatgcttttgtagtgtcgaagtgtcccctagaggtgacaaggcttgtgatagtgttgattctaacaagcatgaatctttcctttattttagcactgtgtgttacgtgccagtaatttgcagcttatcctttgtttctagctaggtaagctgggaaatagcctagtactttgtctatgtgtttatcttcaaaatgtcccaaatagccctgggaaaaaggtcgtgcagctcaatgggggctttcaacttacaattttctttgttttaggctccataaaaatacagactcaccagttcctgctttgatgtgacatgtgactccccagaatacaccttgcttctgtagaccagctccaacaggattccatggtagctgggatgttagggctcaggtaagtaaccttcctttttttttttttagtatatgtcctggtttggccatctgttttttttttttttaaaaaaaaaaaaaaaaggaaaagaggaaaaaaatatactactcttggacagtataaaagtaccccaaagactaaagacataactgtgccaaactgtgccatataataaaaaaaagtcacttccctgagccctgaaaggtcagtgtgtgtagggttacttggtcgccacagcgtgatctgggggcgggcgtcagattagagccggaactggtgatctgcaacttcagttcaccttgaagcaggtcagctgagctgagagcgcttgcactgagcccttttgcgctgctgctgttgccttagcggtcttcagcatgtgtttgctttggtttggggtaaatggcttagtggtcaacattagtgagcagtggtaatgcattttcagatatgggaactggtatgtggttggttccctagaaggacaccctcctgaaagctgtctcagaacaccgggggccatggctaatgtcatgtgcttgctacactcctcccatggtaactaaagagagtacccagatatacatctggttcttgggactctagaggaggatgagtactttgtaaaaacctgggggccccagtcattctaggtctgacactcaggtgctgtatcagctgcagtttgaactacttggcaccattgtgtggactttagttttgtaaaaatgaatggttccttaatttctcaaccttcaggctcaacatctcaagctgtttgttgttgttgttgttgttgttgttttgttttgtctttttgattagtggtcactccgcatttgatgttttgacatgtggatttcagaacttctgtgtggtaaagcagaatgttccaattgaattttcccattttttttcccctaagcaaaaatgtgagttttcacttatgcggccattgtgattccgactgagaccctaagtcgttctttgttgtctctctagtggtttctgacacctcagtgtgaagctgttgtagacatccataagaaatagcctgcttagggattatgtgagggcaaggtttggctgaaggagaatagaaggtgtggaaggaagcggaagaccagaagagcatcacactgcctcaagtcccaaatttgattctgctcctgatcctgtgactcaaattgtcattctcttttactgctgtggggtgtgctctgggcccagctgacaggacattctttgtactccacgtatttatgctggtgggagttgtatggctagtgctttgtgctttgtctcagaaattgtgtggactaaatgtaatatgggcagtgaatgggtttcttctggaagatgttaggcctggagggtggtttgggtttttacgagtctttttctcagattacagattacgaatggatgttataaaacaggcagtgttgacaccatacagtttctcctaagaaatgtacagagagttcaacctgaggaagctaattgaaaataaacttttaaaaagaaatgtagaaagaggaaatttaaaaagtatcttatgaatgggaaagatgtagccatttgagcttcaaagaacttttgagggaattctcaaaggacagtacccgtctttagtagataaatgcttgatatctatttttcttcttttactttttaaagaattactaaaataatacatggatttatagaaaaatcaaaccacttaaaaattgatcaggtggctgggcaaggtggctcatgcctgtaatcacagcgctttgggaggcctaggcgggtggatcacctgaagtcaggagttcgagaccagcctggctaacacggcgaaaccccatctctattaaaaatacaaaaattagctggccatggtggcttgagcgtgtagtcccagctactcggaaggctgaggcaggagaatcacttgaacctgggaggcggaggttgcagtgagccaagatcacaccactgcactcctgcctgggtgacagagtgagactcggtctcaaaaaaaaaaaaaaaaaaaagtatcaggtaaaaaaatgaaagctccccgcttaatctctgctcccactacccagaataactgctgttaatagcttaatgtagatccttctaagtcttctaagactaaactgtgtactttttgtgttgtaattaacaggagggtttttgttttgttttgttttttctttttttgagatggagtcttgctctgtcatccaggctggagtacagtggcacaatcttggctcactgcaacctccacctcctgggttcaagtgattctcctgcctcagcctcctgagtagctgggattacaggcgcctgccaccacacccagctaatttttgtatttttagtagagatgggtttcaccatgttggccaggctggtgtcgaactcctgacctcaggcgatccacctgccttggcctcccaaagtgctgggattacaggcgtgag

SEQ ID NO: 82 - DNA, 4078 bp, Homo sapiens
ctcctctcggagagagggctgtggtaaaagccgtccggaaaatggccgccgccgccgccgccgcgccgagcggaggaggaggaggaggcgaggaggagagactgtgagtgggaccgccgtggccgcgggcggggacccttgccggggggcgggggtcaggggcgggacgtggcgcgggaggggcccgcggggtcggacgacacggctggcggatggcgtccctcctctctaccctccccctcccgccgccgccggtggcgactctcccctcggcccgtcacccgtgctcgcgggtgaccgtcctcggcgcggcctccctggagccgccttcgcctgacgcccctcttcctcccgccctcgacgcgcatcccggcccccggccccgcgggcgcccctgtcgccggggttcgcctgtcggggctgcgcgcgctcctgcccttctcggggctttgggccgcggcgccgtcgcgcgcccgcggccccggcctctccctggatcgcgctctccccctccctccctcgcgcgccccctctcccgttactcggcccccccaccggcgcgcgtgcgcacttcgcctcccgtcgggagagtgcgccacaagggctcctgagctctcacccccatctctgggctttgcctccccctccttctcgcccattccatgaatttctgccccccgctacccccccgcgagcgagtaggtccaccggctcctttccccatctagcaggaacaagtaggtggggattattatccacaaaagggactagacattgtgttctgggtcccacaactcatcataaagaggtggttatagttcccatcaggagccgtgggtaggggactgtgcgtccagcagcacccgaggctcttcggcgccagaggctctaaggtgcgagcgtgtccccagggtgctcagaggttctttggagtgctgtggcctcggaatgtgagcaccctcccatcctaccctccccttcgccggcgatcttccagttacataagtggagtgggacatagtaggtaacgggctctcatcgccctggagcgctcgggatcaccggtaccagatggggcaagttcatcgcgacgctgtggctcctgttaattgtgcctgaaaggttatcctctgttcagtttggtcatgaccgaatcacccaaactgaaactcagatgacttttatatggcagtggcaatgtttctgtggttttgcactaaagacttaaggtcattatgaagagtgtaaaaggattgctgtcgcaggggagaccgtttatgacattgctaagtatggaccccgagggggaaaaagctcattctggaattgctctgtggcggttgcttctgttgcgagtgtgttcgggtgtgggttggtcacagcagaaatgggctccaccacaaaattgatattcctgactcatggtcaggcagatgtgtgcttctggttatttttccaggaacaggaatgggctctgccgagcctttcacacgttgtgtctctgctgtgcgggatcagtaccccagactgtgagataacaggatcgaattcaggggttggttggtgatccaggaaccatacctacttggatgtgatactgagtggcctagacgttgtaggactctcataagttttagacattttgttatactgtaaaaatgaagcatatacggcctcagtagtaacattgcactaataggtaattattactctagagaattttgggttccatggctggaatgttcatcagtatctcagcaatttcagttaataaccagattaagctgacctcttgagtcttttgaaatctgctgggtccctataataagacagggtctggattttttaatcttttgggaatttccaccaaggatttagggaaataggcttttatgggcttttcaggatttctatttcaaatcccaatgaggaagtctaggaaacacttgcttttattttcttgcctgaatatgtcagaaccttaaatcacccaatcaatctagaagtactacagttgattaaagtaagtcaccacaggtcacccattcgtggcaggtcagctaggtggctgatcactggaatacagtcatatccccaggcatacacacgagcctcacttgacgatcccaaagtttgtacatctgagcttgagacgtgacaagttgaggtctctgctttgttcttcatagttggcagtttgtctcctcgggtgcccctccggttagctgtttatcatacgtctagccctatcaacagtgcaggcagcttccagagtatagttttctctgcaaagtgcctggtggaggggtacctccttttccattgtcctaatggctccactgggcttccataccagccctttccagtgtcttaacagctcaaagaaacccatctgtggctttcttgttagcactggcctatcacaccttcctattgcctgttaactaaaattttgcctggaatgctttaagcttagagtactgggtctttgtttcacccgattgataggagagtgtcatgcagtcagccgaactccgacttctgtgctgtttaaatccttaggtaggtctggggcaaggcacaaaccactgtgtattcaaagggttatggtgcttgcattctgtgtgtatatgtttgtaatttccaaccagagtcgtttcccgtgcctgccctgcctctgtgcaatctagtctagtagggtagggaggcaagctgtggagtttgaaaaaaaaaaaaaaagctagatgagtttaataggctgttaccccctccagaacattcctcccatgtggagatgaaacgagaagttcatttctttaacctaaaataaagaacaacagagataaaattgttagttccttattggagcctggtttccattgctaatgtacctgcttgggactctgcatgataaatgacgtgtcctggaacctgaaatcttttataaaggttaatatcagcagaaatcttttaattagctaagagcagcttgttctcaagctgcccgagttatcttggaggagagaatcacaggaaatgtttgatatttctagtaaccagtgttttcagtgcgtggggtaaagcacactcctagactggccagtcccaaagagtgtggcaggacacctgcttgttttccctgccctctgctatggtgacatccttgcagaccagtcttgcgtggctggcagacgcaatctttttttcttgggtagagcattatcaccgctgcgatggaaggaccttgtcctcggtgcctccataccagccctttccagtgaaactactgctgtcccggcaagcccctgtgcgtgtgcatcattccgggtaggacaagatgtgaacaggtccctcttctttgggcttaagtagaagttgtgctcttctgcttttacctgtgtgctcttctgcttttacctgttctcttctgcctttctcttgcaagaaacctgtcgaaagcttgctttgcatgccattgcttaaatactttgatggtatgtatggtatgtgggataactgagtgggagccggaattggggggtgggcagggcatccccacccccacccccacatcaaagggggaatgaccatttcgttagagaataaagcctgagtcttataacttcttcaagcacatgtatgctgggtctcctggcgtgtgaatgtgttcccgctgtgctgtgtggctgttttgcagttactgtagacactgtagtctgggctctcattattgcctctgaagttgacaggaccaagccttagtaaggatgcacttgtcttcctagcccaagagctaggggtgttttatatatatattaactttcttttttagatttcataaactgctctcattttctcttttctttctttctttttttttttttttttttgagacagtctcactctgtcacccatgctggagtgcagtggcacgatctcagctcactgcaacctctgcctcccgggctcaagcagttctctgcctcagcctcccaagtagctgggattacaggcacctgccaccacgcctggctaatttttgtattttttttttttttttttttttttttttagtcga

SEQ ID NO: 83 - DNA, 4044 bp, Homo sapiens
caagccgcctcttttccccaaacgacggccgaaagcagccaatcaacagctggaggggtccgcccccttttccctggccgaaatggacaggaaatctcgccaattgacggcatcgccgctgagacctcccccctcccccgtcctccccgtcccagcccggccatcacagccaatgacgggcgggctcgcagcggcgccgagggcggggcgcgggcgcgcaggtgcagcagcgcgcgggccggccaagagggcggggcgcgacgtcggccgtgcggggtcccggcgtcggcggcgcgcgcgctccctcctctcggagagagggctgtggtaaaagccgtccggaaaatggccgccgccgccgccgccgcgccgagcggaggaggaggaggaggcgaggaggagagactgtgagtgggaccgccgtggccgcgggcggggacccttgccggggggcgggggtcaggggcgggacgtggcgcgggaggggcccgcggggtcggacgacacggctggcggatggcgtccctcctctctaccctccccctcccgccgccgccggtggcgactctcccctcggcccgtcacccgtgctcgcgggtgaccgtcctcggcgcggcctccctggagccgccttcgcctgacgcccctcttcctcccgccctcgacgcgcatcccggcccccggccccgcgggcgcccctgtcgccggggttcgcctgtcggggctgcgcgcgctcctgcccttctcggggctttgggccgcggcgccgtcgcgcgcccgcggccccggcctctccctggatcgcgctctccccctccctccctcgcgcgccccctctcccgttactcggcccccccaccggcgcgcgtgcgcacttcgcctcccgtcgggagagtgcgccacaagggctcctgagctctcacccccatctctgggctttgcctccccctccttctcgcccattccatgaatttctgccccccgctacccccccgcgagcgagtaggtccaccggctcctttccccatctagcaggaacaagtaggtggggattattatccacaaaagggactagacattgtgttctgggtcccacaactcatcataaagaggtggttatagttcccatcaggagccgtgggtaggggactgtgcgtccagcagcacccgaggctcttcggcgccagaggctctaaggtgcgagcgtgtccccagggtgctcagaggttctttggagtgctgtggcctcggaatgtgagcaccctcccatcctaccctccccttcgccggcgatcttccagttacataagtggagtgggacatagtaggtaacgggctctcatcgccctggagcgctcgggatcaccggtaccagatggggcaagttcatcgcgacgctgtggctcctgttaattgtgcctgaaaggttatcctctgttcagtttggtcatgaccgaatcacccaaactgaaactcagatgacttttatatggcagtggcaatgtttctgtggttttgcactaaagacttaaggtcattatgaagagtgtaaaaggattgctgtcgcaggggagaccgtttatgacattgctaagtatggaccccgagggggaaaaagctcattctggaattgctctgtggcggttgcttctgttgcgagtgtgttcgggtgtgggttggtcacagcagaaatgggctccaccacaaaattgatattcctgactcatggtcaggcagatgtgtgcttctggttatttttccaggaacaggaatgggctctgccgagcctttcacacgttgtgtctctgctgtgcgggatcagtaccccagactgtgagataacaggatcgaattcaggggttggttggtgatccaggaaccatacctacttggatgtgatactgagtggcctagacgttgtaggactctcataagttttagacattttgttatactgtaaaaatgaagcatatacggcctcagtagtaacattgcactaataggtaattattactctagagaattttgggttccatggctggaatgttcatcagtatctcagcaatttcagttaataaccagattaagctgacctcttgagtcttttgaaatctgctgggtccctataataagacagggtctggattttttaatcttttgggaatttccaccaaggatttagggaaataggcttttatgggcttttcaggatttctatttcaaatcccaatgaggaagtctaggaaacacttgcttttattttcttgcctgaatatgtcagaaccttaaatcacccaatcaatctagaagtactacagttgattaaagtaagtcaccacaggtcacccattcgtggcaggtcagctaggtggctgatcactggaatacagtcatatccccaggcatacacacgagcctcacttgacgatcccaaagtttgtacatctgagcttgagacgtgacaagttgaggtctctgctttgttcttcatagttggcagtttgtctcctcgggtgcccctccggttagctgtttatcatacgtctagccctatcaacagtgcaggcagcttccagagtatagttttctctgcaaagtgcctggtggaggggtacctccttttccattgtcctaatggctccactgggcttccataccagccctttccagtgtcttaacagctcaaagaaacccatctgtggctttcttgttagcactggcctatcacaccttcctattgcctgttaactaaaattttgcctggaatgctttaagcttagagtactgggtctttgtttcacccgattgataggagagtgtcatgcagtcagccgaactccgacttctgtgctgtttaaatccttaggtaggtctggggcaaggcacaaaccactgtgtattcaaagggttatggtgcttgcattctgtgtgtatatgtttgtaatttccaaccagagtcgtttcccgtgcctgccctgcctctgtgcaatctagtctagtagggtagggaggcaagctgtggagtttgaaaaaaaaaaaaaaagctagatgagtttaataggctgttaccccctccagaacattcctcccatgtggagatgaaacgagaagttcatttctttaacctaaaataaagaacaacagagataaaattgttagttccttattggagcctggtttccattgctaatgtacctgcttgggactctgcatgataaatgacgtgtcctggaacctgaaatcttttataaaggttaatatcagcagaaatcttttaattagctaagagcagcttgttctcaagctgcccgagttatcttggaggagagaatcacaggaaatgtttgatatttctagtaaccagtgttttcagtgcgtggggtaaagcacactcctagactggccagtcccaaagagtgtggcaggacacctgcttgttttccctgccctctgctatggtgacatccttgcagaccagtcttgcgtggctggcagacgcaatctttttttcttgggtagagcattatcaccgctgcgatggaaggaccttgtcctcggtgcctccataccagccctttccagtgaaactactgctgtcccggcaagcccctgtgcgtgtgcatcattccgggtaggacaagatgtgaacaggtccctcttctttgggcttaagtagaagttgtgctcttctgcttttacctgtgtgctcttctgcttttacctgttctcttctgcctttctcttgcaagaaacctgtcgaaagcttgctttgcatgccattgcttaaatactttgatggtatgtatggtatgtgggataactgagtgggagccggaattggggggtgggcagggcatccccacccccacccccacatcaaagggggaatgaccatttcgttagagaataaagcctgagtcttataacttcttcaagcacatgtatgctgggtctcctggcgtgtgaatgtgttcccgctgtgctgtgtggctgttttgcagttactgtagacactgtagtctgggctctcattattgcctctga

SEQ ID NO: 84 - DNA, 4063 bp, Homo sapiens
caacactgacttcctcgttagtccccaacatgccaggcatagtctctcctcatgtcctttgaacttgcctggaatgttctttccccagatattcatatgagggagtaaaatgagggtgaaaaccagcagatatctaaatagcacccccttcacttagtttatctttctcaaagcccttatcactatgtgaaatgatatattatacttatttgtatgctagtatgaatcttcccggcaagaatgttagtttgctgtctgttcagtaccgtgcatccagagcctggaagagtgcctggcacatagcaggtagtcaataaatgaatgggggcaagcagccaaatcagaatcaggttttcttgctaagcatagaactaacagaaggatcattgaatggattggataatgactggcatcagggtaaggtccccttaacaaacactcctgtcctgaacacctggttagctaacagttttctcatactcttattttcccaaaacacaattgctggatctcagctccaaatcaactcttctaggaaagtgaaaaattgctggatctcagctcccaaatcatatcttccaggcagagctaacattgccccttattcacacctccaccaaaccatctgatccaacagtgacaggtgtcacgaggccttggcatgcactctcttcccccgccagagttctgcgaaagccagggttgcgatttgttgtcagtttattccccgcctctatgagagtgtgagcactgggcaggctcggatgaaataatgcattgagtaggcctctgaaaccaaggcccctcagctggggcaacgtcaggctccagggtgggcaactttgctgcttctgccgaagatagtgatattgagaaaatgtgggtgcaatgaaacgcttattgcagcgcactcggtgcatctgtggacagagggtcaatcgcccctcagagcagcgcaaacaggcgtcccaagcctaggccttcacttgccccagcatccgcaagggtccattaatccttaacattcaaattccgcccactaaaccagtccctccgcgcccaagccgcctcttttccccaaacgacggccgaaagcagccaatcaacagctggaggggtccgcccccttttccctggccgaaatggacaggaaatctcgccaattgacggcatcgccgctgagacctcccccctcccccgtcctccccgtcccagcccggccatcacagccaatgacgggcgggctcgcagcggcgccgagggcggggcgcgggcgcgcaggtgcagcagcgcgcgggccggccaagagggcggggcgcgacgtcggccgtgcggggtcccggcgtcggcggcgcgcgcgctccctcctctcggagagagggctgtggtaaaagccgtccggaaaatggccgccgccgccgccgccgcgccgagcggaggaggaggaggaggcgaggaggagagactgtgagtgggaccgccgtggccgcgggcggggacccttgccggggggcgggggtcaggggcgggacgtggcgcgggaggggcccgcggggtcggacgacacggctggcggatggcgtccctcctctctaccctccccctcccgccgccgccggtggcgactctcccctcggcccgtcacccgtgctcgcgggtgaccgtcctcggcgcggcctccctggagccgccttcgcctgacgcccctcttcctcccgccctcgacgcgcatcccggcccccggccccgcgggcgcccctgtcgccggggttcgcctgtcggggctgcgcgcgctcctgcccttctcggggctttgggccgcggcgccgtcgcgcgcccgcggccccggcctctccctggatcgcgctctccccctccctccctcgcgcgccccctctcccgttactcggcccccccaccggcgcgcgtgcgcacttcgcctcccgtcgggagagtgcgccacaagggctcctgagctctcacccccatctctgggctttgcctccccctccttctcgcccattccatgaatttctgccccccgctacccccccgcgagcgagtaggtccaccggctcctttccccatctagcaggaacaagtaggtggggattattatccacaaaagggactagacattgtgttctgggtcccacaactcatcataaagaggtggttatagttcccatcaggagccgtgggtaggggactgtgcgtccagcagcacccgaggctcttcggcgccagaggctctaaggtgcgagcgtgtccccagggtgctcagaggttctttggagtgctgtggcctcggaatgtgagcaccctcccatcctaccctccccttcgccggcgatcttccagttacataagtggagtgggacatagtaggtaacgggctctcatcgccctggagcgctcgggatcaccggtaccagatggggcaagttcatcgcgacgctgtggctcctgttaattgtgcctgaaaggttatcctctgttcagtttggtcatgaccgaatcacccaaactgaaactcagatgacttttatatggcagtggcaatgtttctgtggttttgcactaaagacttaaggtcattatgaagagtgtaaaaggattgctgtcgcaggggagaccgtttatgacattgctaagtatggaccccgagggggaaaaagctcattctggaattgctctgtggcggttgcttctgttgcgagtgtgttcgggtgtgggttggtcacagcagaaatgggctccaccacaaaattgatattcctgactcatggtcaggcagatgtgtgcttctggttatttttccaggaacaggaatgggctctgccgagcctttcacacgttgtgtctctgctgtgcgggatcagtaccccagactgtgagataacaggatcgaattcaggggttggttggtgatccaggaaccatacctacttggatgtgatactgagtggcctagacgttgtaggactctcataagttttagacattttgttatactgtaaaaatgaagcatatacggcctcagtagtaacattgcactaataggtaattattactctagagaattttgggttccatggctggaatgttcatcagtatctcagcaatttcagttaataaccagattaagctgacctcttgagtcttttgaaatctgctgggtccctataataagacagggtctggattttttaatcttttgggaatttccaccaaggatttagggaaataggcttttatgggcttttcaggatttctatttcaaatcccaatgaggaagtctaggaaacacttgcttttattttcttgcctgaatatgtcagaaccttaaatcacccaatcaatctagaagtactacagttgattaaagtaagtcaccacaggtcacccattcgtggcaggtcagctaggtggctgatcactggaatacagtcatatccccaggcatacacacgagcctcacttgacgatcccaaagtttgtacatctgagcttgagacgtgacaagttgaggtctctgctttgttcttcatagttggcagtttgtctcctcgggtgcccctccggttagctgtttatcatacgtctagccctatcaacagtgcaggcagcttccagagtatagttttctctgcaaagtgcctggtggaggggtacctccttttccattgtcctaatggctccactgggcttccataccagccctttccagtgtcttaacagctcaaagaaacccatctgtggctttcttgttagcactggcctatcacaccttcctattgcctgttaactaaaattttgcctggaatgctttaagcttagagtactgggtctttgtttcacccgattgataggagagtgtcatgcagtcagccgaactccgacttctgtgctgtttaaatccttaggtaggtctggggcaaggcacaaaccactgtgtattcaaagggttatggtgcttgcattctgtgtgtatatgtttgtaatttccaaccagagtcgtttcccgtgcctgccctgcctctgtgcaatctagtctagtagg

SEQ ID NO: 85 - DNA, 46 bp, Homo sapiens
tctgcatggcgatgggagcagcccaggcatctgcagccagacctgc

SEQ ID NO: 86 - DNA, 58 bp, Homo sapiens
gggactgaagctcgggcaactcggagagcccacttgaagacaaattacaaacacacag

SEQ ID NO: 87 - DNA, 42 bp, Homo sapiens
cgggcaggtaggccagggtgccccgcactgtctgtgtccggg

SEQ ID NO: 88 - DNA, 81 bp, Homo sapiens
aaggctgaattccttcctccttgtctcgaatcttccctggggggcaggggacacctaccttggtagaagaaggggctggag

SEQ ID NO: 89 - DNA, 45 bp, Homo sapiens
ccgagctcaggccctgaatgggtctgggagcctggaaaagcttca

SEQ ID NO: 90 - DNA, 46 bp, Homo sapiens
accaaacccaaacagaaaaaccccagaaagacaagtaaagggcaaa

SEQ ID NO: 91 - DNA, 45 bp, Homo sapiens
aaggggactgggggagtcaggccaccccagtggactccagctccc

SEQ ID NO: 92 - DNA, 50 bp, Homo sapiens
gggaggggtagacctggggggagctcgacgacatacagtattgtcaggag

SEQ ID NO: 93 - DNA, 52 bp, Homo sapiens
atcttcataatgttcaagtacagacaaaattgaaattgaggtcacaccccaa

SEQ ID NO: 94 - DNA, 46 bp, Homo sapiens
gttgctcttacttacttgatcaaatacacatcatacttcccagcag

SEQ ID NO: 95 - DNA, 42 bp, Homo sapiens
cagccttcaggcagggtggggtcatcatacatgggtccccgg

SEQ ID NO: 96 - DNA, 63 bp, Homo sapiens
gtttatattacccaaaataaaattcaaactaaaagtaacaaaaccttattacacttaatgcaa

SEQ ID NO: 97 - DNA, 42 bp, Homo sapiens
cacagttcacaagaggagggaagaccaatggagtcccagggg

SEQ ID NO: 98 - DNA, 45 bp, Homo sapiens
aacagtggacatggcatttgtctatttggtcttctgatctacctt

SEQ ID NO: 99 - DNA, 47 bp, Homo sapiens
aaggaagagggcgggggaagacaggaccttagaatgacgccaggaag

SEQ ID NO: 100 - DNA, 51 bp, Homo sapiens
agggaaagaagggtccatgaagagacctggagtggagtgggagccccaggg

SEQ ID NO: 101 - DNA, 64 bp, Homo sapiens
acataaaggggctttaatcctgagagaaaaaatcagcaccaagggaaaccaagtgctctgggag

SEQ ID NO: 102 - DNA, 4046 bp, Homo sapiens
gcctccaaaagtgctggtattataggcatgagccacctcgcccagctgagggttcctaagcagtggttcttcaaatagtacctgggatggaaaattcctgctggggcttcctatttcctgaaagcacagagtggggcaggcaccctcgggctaaaggaggtgctactgtcaggaggcgagggaaggagtgggccagggtcttgctaagggaggcatgtggggccggctgggcttctagaggtcgccagagccagtggcctgcccggctgccccacgccctcagcgcagtcgggacagacactctgctctttggggctgacacggatgcgcctgagcaccccagaggccagcctgggcggcagcacctgggagggagctggacgacagcagctgcaggctgtccagggccccatcctcgtacagggccagcttctggaccatcttctgtcgggcagggttgatgataatctgcggtggctctgacgacgatgatgcagagctgccaagggccagtcctggggtggagatggcactcccttagcctcatgctgtggctccccagcccgcagcctagcaccctgcctccctggcctcaggcctgaattcctcagagaagtccaagggcagggcccagctctcaggctaccagacagagccctccttgttcccagccttcaggaatggggtggggggagggctggagagcaagctccacctgggaaggatgtggcctggggaggggaaaccagggttgctaaggtcacagtgagctgaacatttggccctggttctcttctagaaggctggggtggggacttacaggggctttggcccaaagaggccttggtccctctcctgggaacccgtctccccagctaccttccacggctgtgggccgggatcctgggccactcccccagctcgattctcctgccgtgtccccctgaggacagccggcctccctgaggggtgctgggtccagagggcagcttggagtcaagtgccaggagcgcagggcagcagagaggccgcctaggctctcgtcactctccacgggctggttggggcctctctgcagctgctctgctgcctgggcactggctcctgatggcgctgccaggggctgccatggagcagccccactgtgggctctgccagtgctggacacgtaggagttctcctgcggggaaggggggatgcagctggcggcctccgaatgcccgggcacccccgccaccactgcctgcagcttctctagcctctcgtacacctgcaagtggaaaagagggactctcagggtgagatggcagccctggccggtcaccccgtgggcaaaccacagggctgctccaggccgtccgtgacctgccccagggctctaaaatgacataccctgcagctgggaacgctctgcccctcgcccctctgttcccatcacagggagtgctgagaagcgcggctgccaaaagcaaggactgagaatggcctcgttcttttctacaaaatgaatctcactgccccgctgccctcaaacggggcctctccattttcaactgtcaccagaggagaagaggtggggtactagggaggggacagaaaaaggcagatgcagtagtgcagtgcgcccagcagggggcgcggcagcagctctttccttctctctatgtgaagggggtcggagctgggctccgcaaagcaggactgcccggggcccctcagttcagaggggcgctgccccaaacagaaccaaagggcaagcaagaaatgtgtggagactccagagagacctagcaggtgctgagatggggtcactacagagcaaggcctggaatgcgggctttctatctggccaccccgtcccagtgcgcagctggctacctgggtcataggaggcctccttttggcccggcggtgcaggcagcagcaggccagctggcccaggcccaggcccagctcaggtgggcagggcccgggcctggggtccaggtgcttcttgtagatctgcatggcgatgggagcagcccaggcatctgcagccagacctgcttgcagtgtgctctgggtgcttctcaaagccactccagcctcctcagcctcctcttccaccaggtctttctgtgggataaatactgtcagtatggctaccaggtggccacacctgcagctgcagtcctcaggtccttgtcactcaatcgtatgggttttgataaaaaaaaaaaaaaaaaaaaaagagatggggtctcgctttgttggcctggctggtctccaagtaggctcaagtgatcctcccgcctcagcctcccaaagtgctggtgttacaggtgtgagacactgtgccacagctcttggtctttctacaacttactttttttctgagacagggactcattctgtcacccaggctggagtgcagtggtgcaatcatggctcagtgcagcctcaacctcccaggctcgtgatcctcccacctcggcctcccgagcagctgggattacaggtgtgtaccaccatgcctatcttgctatgttgcccaggctggtctccaactcccaggctcaagcgatcctcctgcctcagattcccgagtagcttctagagatttattaaacacctactgtgggccagtggtgctctgggccctagggatacaggaacaaacagaaccctgggacccggtttgacagagctgacttcctggtgggggagagccccatggagctggggtctgaaggcaggaagtagcctgagagggcagagccgagaaggaaagcgccccacagagaggtgccccacagacaaagaggtaccccagagagagaggcgccccgcagagaggcgcccccagggtggaaacaggaccggaggccatctccagttctgaaatcagacagaccaggaggaaccacctgggtgggcggtggcttttctcgcagagcgaacggcacatactaaggctgtgaagcaggcagcagggagcgccccgagtcccagggacctggggcgttggggggtcaaccacataagggactgggccttcaccccaagagcagagaaaaggcaaaggggcctttgaaaagagcactttggctgcagggtggggagcaagtggggaagtccaaggacccccaaggagcctggtgcgcttcttcagcaggatgcatggatggacggacggggaagggaaaggaaggagggctcaagcccggctcctgggttctcagcggggctgaatcctgacggagaccccacagcacacaggaaccgccccaaacaagaggagaagcagtgaagcaattactggctgagcacattctgtgaagtctgttttgcatatgggaaaacaggcccacaggggagcaggaatttgctggaaggccactgtcaggctggggctaaaacccaggtctctagtctcctggccccaccacagtccacggtgaggcagactgagtggagtaagaccgtgaggcagctcaggctgccctgcacggtgcggagagctcagctgcagcctgctggggcccaggaggttcctcggggcctgcttcttctctaccaccgcctttctccggccagagtcctctgagttccactgcagcttgggtctcagtgccctgggaccgcccttccccctgcccccagcccaggtggggtctgtacaaggcccatagtgtctgcaggacagacaggtttgtcctcggcaaggtaaacgaagttgtttggagccctgcctactttcaaaaatgaggccactgtggcagcagaggcatccatgggcactgcgccccagttatccccgccactggggctgtgcctgctggctgccagcagctgtgtgtccctcctggccctgcctcaaggggctcaccagatacttggtcctggcaccgtgcgtcttcacagccctctgaccagccaaggtctctagcactacctggagagagggaagagggagagcatggcagtggccttggcagggaagaggcctctggtgtggacatggattgggcctgacaagggtgtggacaaaggcagagccagatgtt

SEQ ID NO: 103 - DNA, 4058 bp, Homo sapiens
gcagtgtgctctgggtgcttctcaaagccactccagcctcctcagcctcctcttccaccaggtctttctgtgggataaatactgtcagtatggctaccaggtggccacacctgcagctgcagtcctcaggtccttgtcactcaatcgtatgggttttgataaaaaaaaaaaaaaaaaaaaaagagatggggtctcgctttgttggcctggctggtctccaagtaggctcaagtgatcctcccgcctcagcctcccaaagtgctggtgttacaggtgtgagacactgtgccacagctcttggtctttctacaacttactttttttctgagacagggactcattctgtcacccaggctggagtgcagtggtgcaatcatggctcagtgcagcctcaacctcccaggctcgtgatcctcccacctcggcctcccgagcagctgggattacaggtgtgtaccaccatgcctatcttgctatgttgcccaggctggtctccaactcccaggctcaagcgatcctcctgcctcagattcccgagtagcttctagagatttattaaacacctactgtgggccagtggtgctctgggccctagggatacaggaacaaacagaaccctgggacccggtttgacagagctgacttcctggtgggggagagccccatggagctggggtctgaaggcaggaagtagcctgagagggcagagccgagaaggaaagcgccccacagagaggtgccccacagacaaagaggtaccccagagagagaggcgccccgcagagaggcgcccccagggtggaaacaggaccggaggccatctccagttctgaaatcagacagaccaggaggaaccacctgggtgggcggtggcttttctcgcagagcgaacggcacatactaaggctgtgaagcaggcagcagggagcgccccgagtcccagggacctggggcgttggggggtcaaccacataagggactgggccttcaccccaagagcagagaaaaggcaaaggggcctttgaaaagagcactttggctgcagggtggggagcaagtggggaagtccaaggacccccaaggagcctggtgcgcttcttcagcaggatgcatggatggacggacggggaagggaaaggaaggagggctcaagcccggctcctgggttctcagcggggctgaatcctgacggagaccccacagcacacaggaaccgccccaaacaagaggagaagcagtgaagcaattactggctgagcacattctgtgaagtctgttttgcatatgggaaaacaggcccacaggggagcaggaatttgctggaaggccactgtcaggctggggctaaaacccaggtctctagtctcctggccccaccacagtccacggtgaggcagactgagtggagtaagaccgtgaggcagctcaggctgccctgcacggtgcggagagctcagctgcagcctgctggggcccaggaggttcctcggggcctgcttcttctctaccaccgcctttctccggccagagtcctctgagttccactgcagcttgggtctcagtgccctgggaccgcccttccccctgcccccagcccaggtggggtctgtacaaggcccatagtgtctgcaggacagacaggtttgtcctcggcaaggtaaacgaagttgtttggagccctgcctactttcaaaaatgaggccactgtggcagcagaggcatccatgggcactgcgccccagttatccccgccactggggctgtgcctgctggctgccagcagctgtgtgtccctcctggccctgcctcaaggggctcaccagatacttggtcctggcaccgtgcgtcttcacagccctctgaccagccaaggtctctagcactacctggagagagggaagagggagagcatggcagtggccttggcagggaagaggcctctggtgtggacatggattgggcctgacaagggtgtggacaaaggcagagccagatgttatgggactgaagctcgggcaactcggagagcccacttgaagacaaattacaaacacacagttaggtgcagggtgaggaggagggcctcggagggagggggaccctggagctgcagcctcctggggtcttggcagatggcccctggcccgcagtgcactctgcagcccccacctctgcctgcctgtggcttctcctcctctgagccagcagaggggtcagtggctcaccaccccaaagctgaaggtgtccgtgtccacagccagccttcccgtcttgatgtactcctcgggcaggtaggccagggtgccccgcactgtctgtgtccgggccaccatgctgctctggctggggctggacccggcaaagcggctgaaccgggccaggccaaagtctcccagcttgggtgtcagcctctcatccagaaggacgttggaacttggggagagaagacagtggcgtcagcccggtcctagctcctacacctgcccggcttagataaggctggactcgaggctgccagcccggtgccttgcccacagaaagcgctggcactgccctgagcgctccagctgcctgggggcctctgctcatcagtagggcccatccttggcccgttcccacacctgtgcgatgccggggtgttgaggtcccaggccatgcctgatccccacattgataggacgcggggccccccttgctgcaggccctgccccggcagttctcaagggcccctcctcacctcttgatgtctccatggatgaggctggggctgtcctgatgtagaaactgaattgcccgggctgtacccagaaggatgtccagtcgctgaggccaggagagaggtgggcaggcctgggtctggggtggcaaagggggacaggggaggttgctggatggccgttccttgatcccaaccatccttctacctgtcaccgtgcagcctggaacagccacttcactctctaggcctcagtttcccccttctggaaaacgaggagcaaagtctccgtgacctgcacttcttaagcaatggctggggacacgttcaatagaatctgctgggcttcggctcccagggctcatccctttgtccctggtggtcgggaagtccttgaaggcattcttcccgctctccccaaacgcagcatgcaggaggaggcaagggggccctccctcagctgtaggtggtccagctggtagccccagaccccctcgcctccggggcttgctgatgagaccctccagctacgctgcttgcaaaggggagaggcctgggaaagagctctatagaaaacattgggtcgggccaggcgtggtggctcacgcctgtaatcccagcactttgggaggctgaggcgcgcagaccacctggggtcaggagttcgagactagcctggccaatgtggcaaaacctcatctctactaaaaatacaaaaattaggcaggtgtggtggtgcatgcctgtagtcccagctactcgggaggctgcggcaggaggatcgcctgaacccgggaggtggaggttgtggtgagctgagatcacaccactgcactccagcctggatgacagagcaagactccacctcaaaaaaaaaaaaaaaaaaaaaaaaaaaaaaattgaccccaccgtgggccaaatcctgagccgggtgctgctggggagctggaagtgcaggcctggcctgctggcaggacccactcacacaggctgaaagccctaggccccgcgcccggctccagccaggtgtcaggagtgctttgggtcctgggaagcgtgccgggccaggtgagcctacctggcagtggagacggtcctccagggagccgttgggcaggaagccgtacaccaggcagtagaagccgttctgagcacagtagccagcaaagtccacaatgtttgggtgacgaaacctgtttgaaaaaggggagcactttccatcaggccagactgggtgggcagccctggctggggcctcagctcgcccgggcctgccaggcctcaggtgcccaagggagccaggtcctgtggtgtgcggtctgaagccccacgggacctggtg

SEQ ID NO: 104 - DNA, 4042 bp, Homo sapiens
tgtgccacagctcttggtctttctacaacttactttttttctgagacagggactcattctgtcacccaggctggagtgcagtggtgcaatcatggctcagtgcagcctcaacctcccaggctcgtgatcctcccacctcggcctcccgagcagctgggattacaggtgtgtaccaccatgcctatcttgctatgttgcccaggctggtctccaactcccaggctcaagcgatcctcctgcctcagattcccgagtagcttctagagatttattaaacacctactgtgggccagtggtgctctgggccctagggatacaggaacaaacagaaccctgggacccggtttgacagagctgacttcctggtgggggagagccccatggagctggggtctgaaggcaggaagtagcctgagagggcagagccgagaaggaaagcgccccacagagaggtgccccacagacaaagaggtaccccagagagagaggcgccccgcagagaggcgcccccagggtggaaacaggaccggaggccatctccagttctgaaatcagacagaccaggaggaaccacctgggtgggcggtggcttttctcgcagagcgaacggcacatactaaggctgtgaagcaggcagcagggagcgccccgagtcccagggacctggggcgttggggggtcaaccacataagggactgggccttcaccccaagagcagagaaaaggcaaaggggcctttgaaaagagcactttggctgcagggtggggagcaagtggggaagtccaaggacccccaaggagcctggtgcgcttcttcagcaggatgcatggatggacggacggggaagggaaaggaaggagggctcaagcccggctcctgggttctcagcggggctgaatcctgacggagaccccacagcacacaggaaccgccccaaacaagaggagaagcagtgaagcaattactggctgagcacattctgtgaagtctgttttgcatatgggaaaacaggcccacaggggagcaggaatttgctggaaggccactgtcaggctggggctaaaacccaggtctctagtctcctggccccaccacagtccacggtgaggcagactgagtggagtaagaccgtgaggcagctcaggctgccctgcacggtgcggagagctcagctgcagcctgctggggcccaggaggttcctcggggcctgcttcttctctaccaccgcctttctccggccagagtcctctgagttccactgcagcttgggtctcagtgccctgggaccgcccttccccctgcccccagcccaggtggggtctgtacaaggcccatagtgtctgcaggacagacaggtttgtcctcggcaaggtaaacgaagttgtttggagccctgcctactttcaaaaatgaggccactgtggcagcagaggcatccatgggcactgcgccccagttatccccgccactggggctgtgcctgctggctgccagcagctgtgtgtccctcctggccctgcctcaaggggctcaccagatacttggtcctggcaccgtgcgtcttcacagccctctgaccagccaaggtctctagcactacctggagagagggaagagggagagcatggcagtggccttggcagggaagaggcctctggtgtggacatggattgggcctgacaagggtgtggacaaaggcagagccagatgttatgggactgaagctcgggcaactcggagagcccacttgaagacaaattacaaacacacagttaggtgcagggtgaggaggagggcctcggagggagggggaccctggagctgcagcctcctggggtcttggcagatggcccctggcccgcagtgcactctgcagcccccacctctgcctgcctgtggcttctcctcctctgagccagcagaggggtcagtggctcaccaccccaaagctgaaggtgtccgtgtccacagccagccttcccgtcttgatgtactcctcgggcaggtaggccagggtgccccgcactgtctgtgtccgggccaccatgctgctctggctggggctggacccggcaaagcggctgaaccgggccaggccaaagtctcccagcttgggtgtcagcctctcatccagaaggacgttggaacttggggagagaagacagtggcgtcagcccggtcctagctcctacacctgcccggcttagataaggctggactcgaggctgccagcccggtgccttgcccacagaaagcgctggcactgccctgagcgctccagctgcctgggggcctctgctcatcagtagggcccatccttggcccgttcccacacctgtgcgatgccggggtgttgaggtcccaggccatgcctgatccccacattgataggacgcggggccccccttgctgcaggccctgccccggcagttctcaagggcccctcctcacctcttgatgtctccatggatgaggctggggctgtcctgatgtagaaactgaattgcccgggctgtacccagaaggatgtccagtcgctgaggccaggagagaggtgggcaggcctgggtctggggtggcaaagggggacaggggaggttgctggatggccgttccttgatcccaaccatccttctacctgtcaccgtgcagcctggaacagccacttcactctctaggcctcagtttcccccttctggaaaacgaggagcaaagtctccgtgacctgcacttcttaagcaatggctggggacacgttcaatagaatctgctgggcttcggctcccagggctcatccctttgtccctggtggtcgggaagtccttgaaggcattcttcccgctctccccaaacgcagcatgcaggaggaggcaagggggccctccctcagctgtaggtggtccagctggtagccccagaccccctcgcctccggggcttgctgatgagaccctccagctacgctgcttgcaaaggggagaggcctgggaaagagctctatagaaaacattgggtcgggccaggcgtggtggctcacgcctgtaatcccagcactttgggaggctgaggcgcgcagaccacctggggtcaggagttcgagactagcctggccaatgtggcaaaacctcatctctactaaaaatacaaaaattaggcaggtgtggtggtgcatgcctgtagtcccagctactcgggaggctgcggcaggaggatcgcctgaacccgggaggtggaggttgtggtgagctgagatcacaccactgcactccagcctggatgacagagcaagactccacctcaaaaaaaaaaaaaaaaaaaaaaaaaaaaaaattgaccccaccgtgggccaaatcctgagccgggtgctgctggggagctggaagtgcaggcctggcctgctggcaggacccactcacacaggctgaaagccctaggccccgcgcccggctccagccaggtgtcaggagtgctttgggtcctgggaagcgtgccgggccaggtgagcctacctggcagtggagacggtcctccagggagccgttgggcaggaagccgtacaccaggcagtagaagccgttctgagcacagtagccagcaaagtccacaatgtttgggtgacgaaacctgtttgaaaaaggggagcactttccatcaggccagactgggtgggcagccctggctggggcctcagctcgcccgggcctgccaggcctcaggtgcccaagggagccaggtcctgtggtgtgcggtctgaagccccacgggacctggtgtggctccccctctggcctcacctggacagctgctccacctcggtcaggaagctctgcttcactgcagtccactccaggtcagcgttctgcagcccccagggtgcggtgggggaaggggcagggaagacgggcagcgtgaggctctcgaagcgaaggccttcgggccaccagtgccacctacccgaggcccagaaccaccaaggggccagggaccctacgccagaatgagggctgaaggagttgtgtggggaagcgagggggaaaggct

SEQ ID NO: 105 - DNA, 4081 bp, Homo sapiens
tgccccggcagttctcaagggcccctcctcacctcttgatgtctccatggatgaggctggggctgtcctgatgtagaaactgaattgcccgggctgtacccagaaggatgtccagtcgctgaggccaggagagaggtgggcaggcctgggtctggggtggcaaagggggacaggggaggttgctggatggccgttccttgatcccaaccatccttctacctgtcaccgtgcagcctggaacagccacttcactctctaggcctcagtttcccccttctggaaaacgaggagcaaagtctccgtgacctgcacttcttaagcaatggctggggacacgttcaatagaatctgctgggcttcggctcccagggctcatccctttgtccctggtggtcgggaagtccttgaaggcattcttcccgctctccccaaacgcagcatgcaggaggaggcaagggggccctccctcagctgtaggtggtccagctggtagccccagaccccctcgcctccggggcttgctgatgagaccctccagctacgctgcttgcaaaggggagaggcctgggaaagagctctatagaaaacattgggtcgggccaggcgtggtggctcacgcctgtaatcccagcactttgggaggctgaggcgcgcagaccacctggggtcaggagttcgagactagcctggccaatgtggcaaaacctcatctctactaaaaatacaaaaattaggcaggtgtggtggtgcatgcctgtagtcccagctactcgggaggctgcggcaggaggatcgcctgaacccgggaggtggaggttgtggtgagctgagatcacaccactgcactccagcctggatgacagagcaagactccacctcaaaaaaaaaaaaaaaaaaaaaaaaaaaaaaattgaccccaccgtgggccaaatcctgagccgggtgctgctggggagctggaagtgcaggcctggcctgctggcaggacccactcacacaggctgaaagccctaggccccgcgcccggctccagccaggtgtcaggagtgctttgggtcctgggaagcgtgccgggccaggtgagcctacctggcagtggagacggtcctccagggagccgttgggcaggaagccgtacaccaggcagtagaagccgttctgagcacagtagccagcaaagtccacaatgtttgggtgacgaaacctgtttgaaaaaggggagcactttccatcaggccagactgggtgggcagccctggctggggcctcagctcgcccgggcctgccaggcctcaggtgcccaagggagccaggtcctgtggtgtgcggtctgaagccccacgggacctggtgtggctccccctctggcctcacctggacagctgctccacctcggtcaggaagctctgcttcactgcagtccactccaggtcagcgttctgcagcccccagggtgcggtgggggaaggggcagggaagacgggcagcgtgaggctctcgaagcgaaggccttcgggccaccagtgccacctacccgaggcccagaaccaccaaggggccagggaccctacgccagaatgagggctgaaggagttgtgtggggaagcgagggggaaaggctggagaagtggtgagggttatctgatggccttccagggtccctgccagggtgcgacactcacctccttcagcctcttcacagcatacaccgtgttcctcatcaccgcccggtacacgcacccaaagccaccctccccgatcttgagctcctccgagaagttgtgggtgccccgggaaatctcacagaggggccagcaaaacggaaaggggcgggctccctgcaggagggacactgagctctctgggcctggctgtgggaagagagcctggatcaggtggggtccctgtctcttcccttctgcccaaggctccaggctctccccaccacagctgcctcccagctgacccagcttggctgactggggctctgcgctacatcaaaggctgaattccttcctccttgtctcgaatcttccctggggggcaggggacacctaccttggtagaagaaggggctggagatggcggtggaggccacagggaagcagggcttgggaccaggccgagctcaggccctgaatgggtctgggagcctggaaaagcttcataaagacaccagtgagaggcaggcagagaccagcagcagggtctacagccgtggccgtggtcaaggtgggctcttctttgggtccaccgagcctaacaaccgggccctcttacctggggagaggaaggtggaggctgaggatggcaacttccgggggctccaggcctcggcctcggcgggtgcagggatgctgctgggcctcggggcagtggtgcctggggacggaagcggggcgggagggtgccctgggacgccaaggaaggaaaggaaggttgaggcccgggtgggggagccccgtggggcccgccggcctcccagccgtggggtgcccggagtcccgcgctcacaggctgtgatgatgtcccgcgcacggagcagctgcaggtgcgtgaggatgtgcacgaggtcggccacacgggcgttgcggttgatccagggccacaggacgctggccgtgcgctgcccggagcgctcgcacagccgcagctcggtctggtcgcgcacgatcagggcggctgcggggcggggggcgtcaggcgtcggcgccaggagcccgcgcgcctcccgccccccggcagcccgccgccacccaccgaactggcaccagtcggcgggctccagggcgtccatcactttgtagaagcggcacatgacccagggcggcacctcgtacaagaagtgctgggcgccgggggctgcgggctcccccgggcccggccccccggccatggctgccgccgccgggccgggacctgccggggcctctcagggccgcggcgggcgcgggcctgggccggccgggtccgcggacactgactcacttccccttcgagccggcctcgtgcgacgcccggcggggcggaaggggcggtgcccgggcccgccgccatcttgcgcgccgcggccgcgcgctgggtcacacgggggcgccccgcgccggggagggcccgggtcccggcgggttccgcgagcggcgatcggcctcccgggctcgcccgggcggggctctggaggacgaacggcggctcccggcgttggggacagagggcagggcggaggcccgggctgctcggaaaggggccggggccgggccttccgaaagctcctgggcggccctgccggaaccctgctctccactgcggcctgcagggctgttaccaggagccctgcctgcccgccccacgtctagccccctgcacacggcagcagccttgagccattcagtctccttaggtgtcctgaaatatgccgagaacgctgcccgccacagccgtgagtgtatgcgttgctgctgccccagccctcatttggcaagggtgagctcaggcagctgtggtgaaggcttcctgagcccgccggcagagctcctgccaccccgtacctgtcccctcctgggcatcgtccttgattacttgtctggaccgccacccccggtccccgccctgagatggggaagaccccacaagcagcaacgcagacttactcttttgtttctccagctggatgtctcctccagcgacagttccccttgccctcttgatcctgacagcgaaggggttccccacccctagccctacagacttaggacttttcctagaaacgagaagtgcccaaggcccacagctggcccctgttggagtctctttcctgaagccaccaccactgtggccactcccaaggaagatgccaaccataccatgaaacccatggcttctcacgggacagactttactgagatgtaccaactcaagtatctgaaatgactgcacacccatgctaacctccacgggggcacttggtcctacttacacacaaaggcccatcagctcacggaacagggctggcatacgagatgctcaatgcatacaagttgacttttcaaccctgggatctacctttgaaggccaggccttc

SEQ ID NO: 106 - DNA, 4045 bp, Homo sapiens
ggccaggagagaggtgggcaggcctgggtctggggtggcaaagggggacaggggaggttgctggatggccgttccttgatcccaaccatccttctacctgtcaccgtgcagcctggaacagccacttcactctctaggcctcagtttcccccttctggaaaacgaggagcaaagtctccgtgacctgcacttcttaagcaatggctggggacacgttcaatagaatctgctgggcttcggctcccagggctcatccctttgtccctggtggtcgggaagtccttgaaggcattcttcccgctctccccaaacgcagcatgcaggaggaggcaagggggccctccctcagctgtaggtggtccagctggtagccccagaccccctcgcctccggggcttgctgatgagaccctccagctacgctgcttgcaaaggggagaggcctgggaaagagctctatagaaaacattgggtcgggccaggcgtggtggctcacgcctgtaatcccagcactttgggaggctgaggcgcgcagaccacctggggtcaggagttcgagactagcctggccaatgtggcaaaacctcatctctactaaaaatacaaaaattaggcaggtgtggtggtgcatgcctgtagtcccagctactcgggaggctgcggcaggaggatcgcctgaacccgggaggtggaggttgtggtgagctgagatcacaccactgcactccagcctggatgacagagcaagactccacctcaaaaaaaaaaaaaaaaaaaaaaaaaaaaaaattgaccccaccgtgggccaaatcctgagccgggtgctgctggggagctggaagtgcaggcctggcctgctggcaggacccactcacacaggctgaaagccctaggccccgcgcccggctccagccaggtgtcaggagtgctttgggtcctgggaagcgtgccgggccaggtgagcctacctggcagtggagacggtcctccagggagccgttgggcaggaagccgtacaccaggcagtagaagccgttctgagcacagtagccagcaaagtccacaatgtttgggtgacgaaacctgtttgaaaaaggggagcactttccatcaggccagactgggtgggcagccctggctggggcctcagctcgcccgggcctgccaggcctcaggtgcccaagggagccaggtcctgtggtgtgcggtctgaagccccacgggacctggtgtggctccccctctggcctcacctggacagctgctccacctcggtcaggaagctctgcttcactgcagtccactccaggtcagcgttctgcagcccccagggtgcggtgggggaaggggcagggaagacgggcagcgtgaggctctcgaagcgaaggccttcgggccaccagtgccacctacccgaggcccagaaccaccaaggggccagggaccctacgccagaatgagggctgaaggagttgtgtggggaagcgagggggaaaggctggagaagtggtgagggttatctgatggccttccagggtccctgccagggtgcgacactcacctccttcagcctcttcacagcatacaccgtgttcctcatcaccgcccggtacacgcacccaaagccaccctccccgatcttgagctcctccgagaagttgtgggtgccccgggaaatctcacagaggggccagcaaaacggaaaggggcgggctccctgcaggagggacactgagctctctgggcctggctgtgggaagagagcctggatcaggtggggtccctgtctcttcccttctgcccaaggctccaggctctccccaccacagctgcctcccagctgacccagcttggctgactggggctctgcgctacatcaaaggctgaattccttcctccttgtctcgaatcttccctggggggcaggggacacctaccttggtagaagaaggggctggagatggcggtggaggccacagggaagcagggcttgggaccaggccgagctcaggccctgaatgggtctgggagcctggaaaagcttcataaagacaccagtgagaggcaggcagagaccagcagcagggtctacagccgtggccgtggtcaaggtgggctcttctttgggtccaccgagcctaacaaccgggccctcttacctggggagaggaaggtggaggctgaggatggcaacttccgggggctccaggcctcggcctcggcgggtgcagggatgctgctgggcctcggggcagtggtgcctggggacggaagcggggcgggagggtgccctgggacgccaaggaaggaaaggaaggttgaggcccgggtgggggagccccgtggggcccgccggcctcccagccgtggggtgcccggagtcccgcgctcacaggctgtgatgatgtcccgcgcacggagcagctgcaggtgcgtgaggatgtgcacgaggtcggccacacgggcgttgcggttgatccagggccacaggacgctggccgtgcgctgcccggagcgctcgcacagccgcagctcggtctggtcgcgcacgatcagggcggctgcggggcggggggcgtcaggcgtcggcgccaggagcccgcgcgcctcccgccccccggcagcccgccgccacccaccgaactggcaccagtcggcgggctccagggcgtccatcactttgtagaagcggcacatgacccagggcggcacctcgtacaagaagtgctgggcgccgggggctgcgggctcccccgggcccggccccccggccatggctgccgccgccgggccgggacctgccggggcctctcagggccgcggcgggcgcgggcctgggccggccgggtccgcggacactgactcacttccccttcgagccggcctcgtgcgacgcccggcggggcggaaggggcggtgcccgggcccgccgccatcttgcgcgccgcggccgcgcgctgggtcacacgggggcgccccgcgccggggagggcccgggtcccggcgggttccgcgagcggcgatcggcctcccgggctcgcccgggcggggctctggaggacgaacggcggctcccggcgttggggacagagggcagggcggaggcccgggctgctcggaaaggggccggggccgggccttccgaaagctcctgggcggccctgccggaaccctgctctccactgcggcctgcagggctgttaccaggagccctgcctgcccgccccacgtctagccccctgcacacggcagcagccttgagccattcagtctccttaggtgtcctgaaatatgccgagaacgctgcccgccacagccgtgagtgtatgcgttgctgctgccccagccctcatttggcaagggtgagctcaggcagctgtggtgaaggcttcctgagcccgccggcagagctcctgccaccccgtacctgtcccctcctgggcatcgtccttgattacttgtctggaccgccacccccggtccccgccctgagatggggaagaccccacaagcagcaacgcagacttactcttttgtttctccagctggatgtctcctccagcgacagttccccttgccctcttgatcctgacagcgaaggggttccccacccctagccctacagacttaggacttttcctagaaacgagaagtgcccaaggcccacagctggcccctgttggagtctctttcctgaagccaccaccactgtggccactcccaaggaagatgccaaccataccatgaaacccatggcttctcacgggacagactttactgagatgtaccaactcaagtatctgaaatgactgcacacccatgctaacctccacgggggcacttggtcctacttacacacaaaggcccatcagctcacggaacagggctggcatacgagatgctcaatgcatacaagttgacttttcaaccctgggatctacctttgaaggccaggccttccgagggtaccttctagcatgtgcatgtgaagctggactcctttgagcagttgtctcctccagccccttaccaacctggtgaggctg

SEQ ID NO: 107 - DNA, 4046 bp, Homo sapiens
tgccaggcccttcccgtcacacgctggagcagtgtgcctggagagcactggcttggaagaagctgaggggccagcgaggccagcatatggaggaggcttcccttggccgctcgtggcaggcctgaaggcagctacctgtgtccagggacagccagatccaatgaggaaacgcagcaccatgctgtcatgtgagctggagggggacttctgtcttataatgaaagcccagaccttgagtcactttcacagagagatttatcgagaatgctaacagcacaggatacagtacttcccaacaaaaggtgcaaacgcgtcacttagaaaggcatgctgagtattctttgctttcacatgtattaaaaaacttacaaaaataaaataaaactgcgtgctgcccatcttttccaatagtaaaagaaccttatgaaaaaatcacttgatttttacaacaaaagacacaaacggacatttttatgtaaatttataaggcaaactctttatataataaataggttacagggattcagtggggggggggtgtttttgaaacgtatacaggtacattcagacaggtttactgaaatggtacaaatttccttaataaattgccttttgtttttaaatatatcagtgctttcagtcatttggctatacacaaagaaccttttttctgaacactacaaaaaagcaatcaataatttttgtttttaaaacgacctacttattttctaaagtaattgtcccaaaacacaaaaactgaaggtgaatacgatacagggcttttagagacatctccagctaagtgtgtcccggcctctccctgtgccccaagtgcacctctcccaacctcagacaggtttccaggctggagccagctcccttctgcacagggtggcctgtgttactggcaatgctgtccatagctctcggcctctgggctggcacaggggagcatgacttcaactcaggagggggcagacaccctgcctagctcttccagatgctgcacccggcatgcaatggtcactacagtcagcactctccgcctctcagaggagggaggggctgtcaggtgttttgggagcccaaaaccatgcctaatgagggtaatggcttttctaaggagatgttttcgccatggaatgggaaggggttttctcacatctaagttttgctggcgatcgggtgacagccaagagagtgcaagccccctccatggtcattttattgccctgggaaggggagggtggggaatagagatgtcacagtgttgagccctggaggatggggtgggatgtgacggaagtgtcttaaacagtaatgcccacggggcacaccttggagagagaatgcccaccacctggcctgtccaggaagagctgcatctgccaacattagcctgacctgtgcccacagcagagcgtcccagcctcctgcttgggtgggcccagccccattctccccagctcttcagctctgcacacacacatcccctcctggctcccctcaaggaaacatcaatcttgcctttccttaaaagcacgggatggtggtaataatctcggggggaggggaagcaaaacaagaatccactgggcggaacaaaacctggttttgcagtgacttggaaagtggcaacacatcagctattcggcttgctggcttggagtgggactcctgggctccactgctttgggtggcttctggctgatctgggcaggggtcatctgttcagctctcccctctcatctcagtcaccatccccctccctccgaatgcttttgtttgtaaagaaaaagtgtctagaaatatttgtctctggaacaattactttaaacatagttacaatacagacttcagttcaaacacagaagagatttacttagcaaaattcctttcacccaccaaaaattacacaaatataagcctcaacaccacagttaagaggaccagtagagagaacctcatgtttggaacacaaaaggagaaataaaaaccaaaccaaacccaaacagaaaaaccccagaaagacaagtaaagggcaaagaaggaaggggaaggggagcaaacacagcacacgttacagtgtccagatacacgggagcccagcatgggcaagggctcggcacacattgagtaacagtcctggtgatatttggtcatatattcattgactactgactctggagcggctgttattgattgaagcagtgacaaatcaaacggaaaggaggccgtggtagcaagggaaggagcaggcttcaagttctgcaagccttttgcactccactgtccagctccccagaaacactgaaccgggtgggccccgctccatccgggcagggctagaggtcaccgggtgaggctaactcgggcgtcgatttcatgtcagtcagaaaacacgcacgtggacgcacgcagacacccacctgttcacggccaaacatcagcggcaacggcctcctcgcctcctctgcccctatcccaggctgggtgggaaagagcatcatgacccactgctaacactgaacacacgccggagctggccccggatgtgggcccagaggctgccccagccctggtcctccgaagggctcacgggtagcccggccactgaaagggcctatggctgtttttcttttggattcaggcctcagaagaagcaatgacagcagggagggaagcttttggccctggtgattataatgctctctgctttggaagaacaagtttctggatttttttggtgtttctaattattaaaaaaagatgatcaaaaagaactgttacagctaaactctctagcagatattgctcattaagaattacaaaagcaaatgcaattactcgtaggatgggggagaagaaagggacatttctggagtcttcactactcctggaggggaccccttggactgacgcacatgattctggggtccctggcgttctacctggtgcagctcacaggttccgagacaggccaggcctcccgtctccgctccagcccccaggctcgacagagtgggaaggatgaaacacactcggaccctactggcagggaggcctgcgaggctgactccacatgggctcaccctgaccaggtcacgggaaggggactgggggagtcaggccaccccagtggactccagctcccagaggtggaaggcgaccaggctgtgccgactacgttccggacttcagcaggtcaagggagcgctcctgcacccagaaccttgggacctctttcacaagcacgggagaaacaagagtgcaaaacctgggtgctgcctggagcctccttcacctggcacaggaaagcccttgaaagaagcgaggaaaagaccacgaatctgcttggacagaagaagtgaccagcagacagatttgtcgtttttttttcttttttttctttttttattttcccttgtcctatgctatggttatcagaaatattgtaattaagcaacaggtataattttaacaggtctttttttgtgtgtgtggagccacaagcaaaatgagtttataattgtgcaatatacagatatatatataaaaattcaactgctttgtgtgtctagtcggtgcgttaaataaaagggacagaaaaactaaaagcaaaactaaaaagcaaaacaaaagcccaggatagaggagacaaagcaggcctatgcgcacagtctatgtgttactggatataatcagggtcaccaggaagaacagctttgccacttgacacacaaacactgcggggagaggggctatcagtgggcaggagccaaacctcttggccttttcacctcatctgctctcactgctgagcaggacctgattaaaggtaggacagaatgggggtttgggggcaaagagatttccaaattccccaaatgttcttgaattcaaaggtaggatttcctccagggtctgggctctgcctgtgcacaagtcggagcccggagcgggagctgggggttgtgctccctccttgcactgccctcacacctgcttccttctgcctcctgacagggcaggcagggggccttggg

SEQ ID NO: 108 - DNA, 4045 bp, Homo sapiens
atggcttttctaaggagatgttttcgccatggaatgggaaggggttttctcacatctaagttttgctggcgatcgggtgacagccaagagagtgcaagccccctccatggtcattttattgccctgggaaggggagggtggggaatagagatgtcacagtgttgagccctggaggatggggtgggatgtgacggaagtgtcttaaacagtaatgcccacggggcacaccttggagagagaatgcccaccacctggcctgtccaggaagagctgcatctgccaacattagcctgacctgtgcccacagcagagcgtcccagcctcctgcttgggtgggcccagccccattctccccagctcttcagctctgcacacacacatcccctcctggctcccctcaaggaaacatcaatcttgcctttccttaaaagcacgggatggtggtaataatctcggggggaggggaagcaaaacaagaatccactgggcggaacaaaacctggttttgcagtgacttggaaagtggcaacacatcagctattcggcttgctggcttggagtgggactcctgggctccactgctttgggtggcttctggctgatctgggcaggggtcatctgttcagctctcccctctcatctcagtcaccatccccctccctccgaatgcttttgtttgtaaagaaaaagtgtctagaaatatttgtctctggaacaattactttaaacatagttacaatacagacttcagttcaaacacagaagagatttacttagcaaaattcctttcacccaccaaaaattacacaaatataagcctcaacaccacagttaagaggaccagtagagagaacctcatgtttggaacacaaaaggagaaataaaaaccaaaccaaacccaaacagaaaaaccccagaaagacaagtaaagggcaaagaaggaaggggaaggggagcaaacacagcacacgttacagtgtccagatacacgggagcccagcatgggcaagggctcggcacacattgagtaacagtcctggtgatatttggtcatatattcattgactactgactctggagcggctgttattgattgaagcagtgacaaatcaaacggaaaggaggccgtggtagcaagggaaggagcaggcttcaagttctgcaagccttttgcactccactgtccagctccccagaaacactgaaccgggtgggccccgctccatccgggcagggctagaggtcaccgggtgaggctaactcgggcgtcgatttcatgtcagtcagaaaacacgcacgtggacgcacgcagacacccacctgttcacggccaaacatcagcggcaacggcctcctcgcctcctctgcccctatcccaggctgggtgggaaagagcatcatgacccactgctaacactgaacacacgccggagctggccccggatgtgggcccagaggctgccccagccctggtcctccgaagggctcacgggtagcccggccactgaaagggcctatggctgtttttcttttggattcaggcctcagaagaagcaatgacagcagggagggaagcttttggccctggtgattataatgctctctgctttggaagaacaagtttctggatttttttggtgtttctaattattaaaaaaagatgatcaaaaagaactgttacagctaaactctctagcagatattgctcattaagaattacaaaagcaaatgcaattactcgtaggatgggggagaagaaagggacatttctggagtcttcactactcctggaggggaccccttggactgacgcacatgattctggggtccctggcgttctacctggtgcagctcacaggttccgagacaggccaggcctcccgtctccgctccagcccccaggctcgacagagtgggaaggatgaaacacactcggaccctactggcagggaggcctgcgaggctgactccacatgggctcaccctgaccaggtcacgggaaggggactgggggagtcaggccaccccagtggactccagctcccagaggtggaaggcgaccaggctgtgccgactacgttccggacttcagcaggtcaagggagcgctcctgcacccagaaccttgggacctctttcacaagcacgggagaaacaagagtgcaaaacctgggtgctgcctggagcctccttcacctggcacaggaaagcccttgaaagaagcgaggaaaagaccacgaatctgcttggacagaagaagtgaccagcagacagatttgtcgtttttttttcttttttttctttttttattttcccttgtcctatgctatggttatcagaaatattgtaattaagcaacaggtataattttaacaggtctttttttgtgtgtgtggagccacaagcaaaatgagtttataattgtgcaatatacagatatatatataaaaattcaactgctttgtgtgtctagtcggtgcgttaaataaaagggacagaaaaactaaaagcaaaactaaaaagcaaaacaaaagcccaggatagaggagacaaagcaggcctatgcgcacagtctatgtgttactggatataatcagggtcaccaggaagaacagctttgccacttgacacacaaacactgcggggagaggggctatcagtgggcaggagccaaacctcttggccttttcacctcatctgctctcactgctgagcaggacctgattaaaggtaggacagaatgggggtttgggggcaaagagatttccaaattccccaaatgttcttgaattcaaaggtaggatttcctccagggtctgggctctgcctgtgcacaagtcggagcccggagcgggagctgggggttgtgctccctccttgcactgccctcacacctgcttccttctgcctcctgacagggcaggcagggggccttggggaggcagtgagaggccagctcagaaggctcagctgatccgaggcgagcagagcaggagtgggcaaggcaggctgcccctcaggcagaagtgccttcctagttccctgggtgttttcctgacacgtcagcgctggggcaggctctgtcaagatgagaagagtgggaaggagggtggtgctgggccttccaggtcactggtgaacgctccaccttccataccactcccaaaagacaggttcagaagccatgtcctcaggtcggctacctccagattccccttgcctgtaatgctcaccaggcatctcaggccaagtgctaagtatttttagatcagcactgttgtaaaagcttgctcgtattcattcaaaaacatcgaaatgtaattttctgccaaatgttttctaggttttccttctaaattgttgagaactgacttcagtgttcagcttttcccctctaatatgtaattttagaccctgggggaggcagtatcctaacgatttataacaagtagactatgccttttctaaagattgatacaatatctaaaagagaaagacaccaaaatggagagaatcaacaaatcccgtcagagcagagagaagagtaggaagacccggagggagcagggctctgcccccccaccgggcaggtcctccagacccactccatggtaggaactctagaaacagctgactccctgaagtctaggacacaggtcctagaatctgcaggtgtgaacttgaaacaggaatccatttggggcaatgacacaggctaaaaatgtatatgcccaaagatcttcttaaagaactggtacctgtaacctcccctggcccagtcagcccagagagcctgactggaatgctctggaaaaggagctgtggttagacgggggacacagagttctggctgtcaggctccacttgggctaaaccaattccagatggtcccgcgcaggggactccgctcgtatccctctgctccctcctgggcttgagccgcttactaagtgatttaaaattcagagattctgtcagctaaagaaactcctttctccacccaacttggcagtttgtgtctggttattaccctctttcgccatcac

SEQ ID NO: 109 - DNA, 4050 bp, Homo sapiens
ttgtgcaatatacagatatatatataaaaattcaactgctttgtgtgtctagtcggtgcgttaaataaaagggacagaaaaactaaaagcaaaactaaaaagcaaaacaaaagcccaggatagaggagacaaagcaggcctatgcgcacagtctatgtgttactggatataatcagggtcaccaggaagaacagctttgccacttgacacacaaacactgcggggagaggggctatcagtgggcaggagccaaacctcttggccttttcacctcatctgctctcactgctgagcaggacctgattaaaggtaggacagaatgggggtttgggggcaaagagatttccaaattccccaaatgttcttgaattcaaaggtaggatttcctccagggtctgggctctgcctgtgcacaagtcggagcccggagcgggagctgggggttgtgctccctccttgcactgccctcacacctgcttccttctgcctcctgacagggcaggcagggggccttggggaggcagtgagaggccagctcagaaggctcagctgatccgaggcgagcagagcaggagtgggcaaggcaggctgcccctcaggcagaagtgccttcctagttccctgggtgttttcctgacacgtcagcgctggggcaggctctgtcaagatgagaagagtgggaaggagggtggtgctgggccttccaggtcactggtgaacgctccaccttccataccactcccaaaagacaggttcagaagccatgtcctcaggtcggctacctccagattccccttgcctgtaatgctcaccaggcatctcaggccaagtgctaagtatttttagatcagcactgttgtaaaagcttgctcgtattcattcaaaaacatcgaaatgtaattttctgccaaatgttttctaggttttccttctaaattgttgagaactgacttcagtgttcagcttttcccctctaatatgtaattttagaccctgggggaggcagtatcctaacgatttataacaagtagactatgccttttctaaagattgatacaatatctaaaagagaaagacaccaaaatggagagaatcaacaaatcccgtcagagcagagagaagagtaggaagacccggagggagcagggctctgcccccccaccgggcaggtcctccagacccactccatggtaggaactctagaaacagctgactccctgaagtctaggacacaggtcctagaatctgcaggtgtgaacttgaaacaggaatccatttggggcaatgacacaggctaaaaatgtatatgcccaaagatcttcttaaagaactggtacctgtaacctcccctggcccagtcagcccagagagcctgactggaatgctctggaaaaggagctgtggttagacgggggacacagagttctggctgtcaggctccacttgggctaaaccaattccagatggtcccgcgcaggggactccgctcgtatccctctgctccctcctgggcttgagccgcttactaagtgatttaaaattcagagattctgtcagctaaagaaactcctttctccacccaacttggcagtttgtgtctggttattaccctctttcgccatcactgtcacagcaatgaaaagctgggcagagaagcaggtgacaatttggggctgctccctgtcccaggtgcactgttcatgcttcgggcctggaatgatgccacccaacagaagattgtctgcacccgcactggcgctcacgagtagcagcttccgccatccagcgagctgagaagctggggccgttggctagtttggcactgatggattgggggatgtggcgtttctgggtgtcccctgtgtcttttgatatgggaatacagcatcaacagaagggagctgtgctagcgcctggctgtgaccaagtatctccagctcactgagctgtcaagaccggcaatcccactggctatgacaagcccaccagcaggcagggccgggaggggtagacctggggggagctcgacgacatacagtattgtcaggagaggaggtagtaactaacaactggaacaagggtgggggagactgtggatgtggccttaatgacctagccccatgggtactggaaagctgtcggtcaattctgctgttcacaaattcactgaaagaggcccccatcttcataatgttcaagtacagacaaaattgaaattgaggtcacaccccaaaactgggccggacacagctggtgagaatcctgcagcttaaggctttccctccaacctcctgtcaacctgaccccaaggcaggggcagcatgagagctgcagggcccctgcctgccagggcgataaaccgccaaggctgcctgctgaaaggcgactgactcgtgatgcctttgggaaagacgagggaatgaggaagaaagggggaaatagagagaaaaccctaaggagcctcaggccccactggcagctctggaataaactggaagggaaagaggctgggcaactgcctctttgagggagctgcaggtggggcccgaatgaaataaagtgacgcttgaaatgctgtgttcccaaccacgactgccccatcggccctgaatgaactgtcatgggtgacaggggggcctggtgggccacgcactcctcttaccaggaccagatgacgcccaggtgacggggaagcagctctggacaatgattccagaagccacattacatttgactaagtataatacataaaaacccaactgaccaaaataaacatcttctcagtgacaacctggtcggatgctgcgctctcgtggataagtgtcctttggtagtgccaggagttcgaggccactatgggggcaggagccttctgtccttggaggaagagttctggaggactcaccctctcttctgaccccccttcccttcctggggaagagtcagaagtgaagctgggggggtcatcagcagagcaggtggaagggatcagggatcagggattgggctgatgggagtttggttgcaggacttgcttttacagcataaggaaatggacacatatatgctagaaagtccaactatgagactctacaaacagaacggggcaaactccctcacttctaaccattccagaagagacaaacacggttttttcttaagctactgattggaactgtcaactatggttcctgatcactaaagactggcaaggaagtgctagacagtttctatgatgtttcactccttcatgattacaccatagtaaggaagccagggacaataactgaaatacacaagacaacacacacttgacagttcatggcagcagctcacatgggacatgcctgtgggtgtttctggaagcataagactgctgtctcatttgctactttgataaggtacttctcagttggacagatttagatataagagacatctctgtaaacacagaaaaggatataccaatatgatgaagatatgcagctagataaggacttcctgaacagaggttaaaaagatgggatcccacatgaaaactgatcaattaaaaacccacagcaagcccatgcctctaagcccctacaccacagctatggaccagacagacagtgaaatgtgtggtgttctggccccctgtctgcatcgagcaaaagcaaaacattgccattcaagaagaactccgagggaaaagggggagcagaggaagggctggggacccaggtactggtcccagctcgggtcttgggagttctgcattggtaccgctactgccctgctgcactacgctagactctggacttctgagtgaggtcaaggtcggctggcatggagcccctgttgggccactcgatgactggcaggccacaggaggcctctgtgctttcctcaactaccaaatcgggcccagctcctccagtccacttctctagagtagaagggtgaaaaggctcgttgttcagggtgggaaatgccttttgctttttcttaccagggaagagggggctacctaggagagcaagaccttgctgctctcttgctcttcacaga

SEQ ID NO: 110 - DNA, 4052 bp, Homo sapiens
ccaggaagaacagctttgccacttgacacacaaacactgcggggagaggggctatcagtgggcaggagccaaacctcttggccttttcacctcatctgctctcactgctgagcaggacctgattaaaggtaggacagaatgggggtttgggggcaaagagatttccaaattccccaaatgttcttgaattcaaaggtaggatttcctccagggtctgggctctgcctgtgcacaagtcggagcccggagcgggagctgggggttgtgctccctccttgcactgccctcacacctgcttccttctgcctcctgacagggcaggcagggggccttggggaggcagtgagaggccagctcagaaggctcagctgatccgaggcgagcagagcaggagtgggcaaggcaggctgcccctcaggcagaagtgccttcctagttccctgggtgttttcctgacacgtcagcgctggggcaggctctgtcaagatgagaagagtgggaaggagggtggtgctgggccttccaggtcactggtgaacgctccaccttccataccactcccaaaagacaggttcagaagccatgtcctcaggtcggctacctccagattccccttgcctgtaatgctcaccaggcatctcaggccaagtgctaagtatttttagatcagcactgttgtaaaagcttgctcgtattcattcaaaaacatcgaaatgtaattttctgccaaatgttttctaggttttccttctaaattgttgagaactgacttcagtgttcagcttttcccctctaatatgtaattttagaccctgggggaggcagtatcctaacgatttataacaagtagactatgccttttctaaagattgatacaatatctaaaagagaaagacaccaaaatggagagaatcaacaaatcccgtcagagcagagagaagagtaggaagacccggagggagcagggctctgcccccccaccgggcaggtcctccagacccactccatggtaggaactctagaaacagctgactccctgaagtctaggacacaggtcctagaatctgcaggtgtgaacttgaaacaggaatccatttggggcaatgacacaggctaaaaatgtatatgcccaaagatcttcttaaagaactggtacctgtaacctcccctggcccagtcagcccagagagcctgactggaatgctctggaaaaggagctgtggttagacgggggacacagagttctggctgtcaggctccacttgggctaaaccaattccagatggtcccgcgcaggggactccgctcgtatccctctgctccctcctgggcttgagccgcttactaagtgatttaaaattcagagattctgtcagctaaagaaactcctttctccacccaacttggcagtttgtgtctggttattaccctctttcgccatcactgtcacagcaatgaaaagctgggcagagaagcaggtgacaatttggggctgctccctgtcccaggtgcactgttcatgcttcgggcctggaatgatgccacccaacagaagattgtctgcacccgcactggcgctcacgagtagcagcttccgccatccagcgagctgagaagctggggccgttggctagtttggcactgatggattgggggatgtggcgtttctgggtgtcccctgtgtcttttgatatgggaatacagcatcaacagaagggagctgtgctagcgcctggctgtgaccaagtatctccagctcactgagctgtcaagaccggcaatcccactggctatgacaagcccaccagcaggcagggccgggaggggtagacctggggggagctcgacgacatacagtattgtcaggagaggaggtagtaactaacaactggaacaagggtgggggagactgtggatgtggccttaatgacctagccccatgggtactggaaagctgtcggtcaattctgctgttcacaaattcactgaaagaggcccccatcttcataatgttcaagtacagacaaaattgaaattgaggtcacaccccaaaactgggccggacacagctggtgagaatcctgcagcttaaggctttccctccaacctcctgtcaacctgaccccaaggcaggggcagcatgagagctgcagggcccctgcctgccagggcgataaaccgccaaggctgcctgctgaaaggcgactgactcgtgatgcctttgggaaagacgagggaatgaggaagaaagggggaaatagagagaaaaccctaaggagcctcaggccccactggcagctctggaataaactggaagggaaagaggctgggcaactgcctctttgagggagctgcaggtggggcccgaatgaaataaagtgacgcttgaaatgctgtgttcccaaccacgactgccccatcggccctgaatgaactgtcatgggtgacaggggggcctggtgggccacgcactcctcttaccaggaccagatgacgcccaggtgacggggaagcagctctggacaatgattccagaagccacattacatttgactaagtataatacataaaaacccaactgaccaaaataaacatcttctcagtgacaacctggtcggatgctgcgctctcgtggataagtgtcctttggtagtgccaggagttcgaggccactatgggggcaggagccttctgtccttggaggaagagttctggaggactcaccctctcttctgaccccccttcccttcctggggaagagtcagaagtgaagctgggggggtcatcagcagagcaggtggaagggatcagggatcagggattgggctgatgggagtttggttgcaggacttgcttttacagcataaggaaatggacacatatatgctagaaagtccaactatgagactctacaaacagaacggggcaaactccctcacttctaaccattccagaagagacaaacacggttttttcttaagctactgattggaactgtcaactatggttcctgatcactaaagactggcaaggaagtgctagacagtttctatgatgtttcactccttcatgattacaccatagtaaggaagccagggacaataactgaaatacacaagacaacacacacttgacagttcatggcagcagctcacatgggacatgcctgtgggtgtttctggaagcataagactgctgtctcatttgctactttgataaggtacttctcagttggacagatttagatataagagacatctctgtaaacacagaaaaggatataccaatatgatgaagatatgcagctagataaggacttcctgaacagaggttaaaaagatgggatcccacatgaaaactgatcaattaaaaacccacagcaagcccatgcctctaagcccctacaccacagctatggaccagacagacagtgaaatgtgtggtgttctggccccctgtctgcatcgagcaaaagcaaaacattgccattcaagaagaactccgagggaaaagggggagcagaggaagggctggggacccaggtactggtcccagctcgggtcttgggagttctgcattggtaccgctactgccctgctgcactacgctagactctggacttctgagtgaggtcaaggtcggctggcatggagcccctgttgggccactcgatgactggcaggccacaggaggcctctgtgctttcctcaactaccaaatcgggcccagctcctccagtccacttctctagagtagaagggtgaaaaggctcgttgttcagggtgggaaatgccttttgctttttcttaccagggaagagggggctacctaggagagcaagaccttgctgctctcttgctcttcacagacaggccaggtcggactcagcagagcccaaggcctcctcagggctcaaaacagggtggggctggtactggcagcaggaggacaaagggcaggcagagttctggggactggagccgacaagtgtggttgggcaccgcggctgcctggaagagaagggatgaactaggaaggaggaggatggagga

SEQ ID NO: 111 - DNA, 4046 bp, Homo sapiens
aatgctccaactactcccaccctgaagccacgaaactctaagtttactgaaagaaaaaaaaatattttttatttcagttaatcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgcct

SEQ ID NO: 112 - DNA, 4042 bp, Homo sapiens
tcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacct

SEQ ID NO: 113 - DNA, 4063 bp, Homo sapiens
aagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaacttatggtgcgcccacacactggagtactgtgcagatccaaagggactaaacaagagctctaagaactgcgatggagtcatttccaggatccactgtgaagcaaagggagcaaagcgcaaacatatctactgcattctaccaaagaaagaagggggggtattaaggaaggacacaccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgt

SEQ ID NO: 114 - DNA, 4042 bp, Homo sapiens
gaccccagtctctacaaaaaatataaaaattagccaggtgtggtggtgcatacctgtagtctcagctacttgggaggctgaggtgggaggactgcttgagcccaggaggttgaggctgcagtgagtcgtgactgtgccattgcattccagcctgggtgacaaagggagaccttatctcaaaaaaaaaaaaaaaaagcccattctaactatgggaagatatagagtagagggagtggggcaggagggcacaagatgccacaggggggctctgcagaagcagatgttgggtcacggtttgaggtgtaagatgttcatcaggaactgacatccataaagggaggtgggaagaagtcaaagagaaggccctataagggccttgtacccttacctcgctcagtcaccagggtgctgtcctggaaatggcgtgaccttgggtgaggaggctcttgcagctgaggctaaccggagtgtccgcagggcatccagagaggagagtgacctccgggtctgccacgtgagactactgcagagtctaggcagggatgcagggagctggtctaggtgccatccctgaagggcatgggcaccgggacagcgaaagggcgagagatccaggactctggcttccgtttctcatgtttttgatactgaggtatttagctttctagaggcctaaagggcagctggatgtatgaatctggagttcaggggagaggtctgaagagccaggcgagtgcgtgagggcgtgctgaatataagtgtaaacaaccctccccctgctatttggagttgtgatgaggagaaagaatcagcagaggagacagagaaagaggagtcagtgcagagaaggaagatcagacatatctgtcaagattattggtggcaatcaatagaaaccaactctagctgatttatgcagacaaggactgatgaaaagctattgaagatgcatgtggtgatggttgcacaatataaatgtgctcaataccacagaattgtacacttaaaaatggttaaggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaaga

SEQ ID NO: 115 - DNA, 4045 bp, Homo sapiens
aggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaata

SEQ ID NO: 116 - DNA, 4047 bp, Homo sapiens
actcctgggctcaagtgatctgccctccacgggcttccaaagcactgggattacaggcacgagccaccatgcccagctaaaaatctgggttttcagagacattagtgaaaataaagagtgaatgtttttcccatccaaggtcacagacccggctgaattctcaaccaaagttggaggccttggtctagaaagatacataccaaatattaacagcagttttttttttttttggatagtggaatcgccagagtgattctattttgttttatgatatttttgtagagatagggtctcaatatgttgctcaggctggtcttgaactcctgggctcaaaagatcctcccaccttggcctcccaaagtgctgggattacaggcgtgagccatggcatgcctggcctaattttttatctttgtacctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggc

SEQ ID NO: 117 - DNA, 4051 bp, Homo sapiens
acctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggctgcagtaagctatgatcatgctgttgcactccagtctgggtgatggagtgggatcctgtctctaaaaaaacattaaaaaaaataagtaaaaaatttaaaaactggttaaataaattgtggtacatccataacagactatttaaacccaacccttaaaaggaatgatacggctctgtatgaaccgattctaaataatctacaggatacattaaaataaacaaatgtgcacaatattttatagtatgtgtaaaaacacaacgcccacatacccttgtgtatttatacacacatgtaaaatatatacacaaacctaaacacacaaaaatatgtccaatagagacaaagagtagaatagtagttgccagagggtggggtgggggaaaggggagaagtgggagttagtgtttaataggtatgaaa

SEQ ID NO: 118 - DNA, 4064 bp, Homo sapiens
cgtaatctgtaatctgagaaaaagactcgtaaaaacccaaaccaccctccaggcctaacatcttccagaagaaacccattcactgcccatattacatttagtccacacaatttctgagacaaagcacaaagcactagccatacaactcccaccagcataaatacgtggagtacaaagaatgtcctgtcagctgggcccagagcacaccccacagcagtaaaagagaatgacaatttgagtcacaggatcaggagcagaatcaaatttgggacttgaggcagtgtgatgctcttctggtcttccgcttccttccacaccttctattctccttcagccaaaccttgccctcacataatccctaagcaggctatttcttatggatgtctacaacagcttcacactgaggtgtcagaaaccactagagagacaacaaagaacgacttagggtctcagtcggaatcacaatggccgcataagtgaaaactcacatttttgcttaggggaaaaaaaatgggaaaattcaattggaacattctgctttaccacacagaagttctgaaatccacatgtcaaaacatcaaatgcggagtgaccactaatcaaaaagacaaaacaaaacaacaacaacaacaacaacaacaaacagcttgagatgttgagcctgaaggttgagaaattaaggaaccattcatttttacaaaactaaagtccacacaatggtgccaagtagttcaaactgcagctgatacagcacctgagtgtcagacctagaatgactggggcccccaggtttttacaaagtactcatcctcctctagagtcccaagaaccagatgtatatctgggtactctctttagttaccatgggaggagtgtagcaagcacatgacattagccatggcccccggtgttctgagacagctttcaggagggtgtccttctagggaaccaaccacataccagttcccatatctgaaaatgcattaccactgctcactaatgttgaccactaagccatttaccccaaaccaaagcaaacacatgctgaagaccgctaaggcaacagcagcagcgcaaaagggctcagtgcaagcgctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaaattactggcacgtaacacacagtgctaaaataaaggaaagattcatgcttgttagaatcaacactatcacaagccttgtcacctctaggggacacttcgacactacaaaagcataccatgagtggcgatttctggcaagtatttcttctaccacggcacacagaaattctcagggaagaatacatgttcaagagaatacgcaacatcaaaataccatccctgaaagaacacatggaacctagaggcagtctcccttctttttcaagcagctgaatgaagttgcaataagctgctgtaacaacatcacataaaggggctttaatcctgagagaaaaaatcagcaccaagggaaaccaagtgctctgggagacccaaagccatcatccaaaacatgcaagtctatttcagggcaatcagttttaagcctctcagatcagtcaatctcgatgttcaacaaactcagttattagtttgatagtttctctttttcttttgaacacatgttcaaaaaaggacttttgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtctcaaaaaaaaaaaaaaaaaaagaaagaaagaaaagagaaaatgagagcagtttatgaaatctaaaaaagaaagttaatatatatataaaacacccctagctcttgggctaggaagacaagtgcatccttactaaggcttggtcctgtcaacttcagaggcaataatgagagcccagactacagtgtctacagtaactgcaaaacagccacacagcacagcgggaacacattcacacgccaggagacccagcatacatgtgcttgaagaagttataagactcaggctttattctctaacgaaatggtcattccccctttgatgtgggggtgggggtggggatgccctgcccaccccccaattccggctcccactcagttatcccacataccatacataccatcaaagtatttaagcaatggcatgcaaagcaagctttcgacaggtttcttgcaagagaaaggcagaagagaacaggtaaaagcagaagagcacacaggtaaaagcagaagagcacaacttctacttaagcccaaagaagagggacctgttcacatcttgtcctacccggaatgatgcacacgcacaggggcttgccgggacagcagtagtttcactggaaagggctggtatggaggcaccgaggacaaggtccttccatcgcagcggtgataatgctctacccaagaaaaaaagattgcgtctgccagccacgcaagactggtctgcaaggatgtcaccatagcagagggcagggaaaacaagcaggtgtcctgccacactctttgggactggccagtctaggagtgtgctttaccccacgcactgaaaacactggttactagaaatatcaaacatttcctgtgattctctcctccaagataactcgggcagcttgagaacaagctgctcttagctaattaaaagatttctgctgatattaacctttataaaagatttcaggttccaggacacgtcatttatcatgcagagtcccaagcaggtacattagcaat

SEQ ID NO: 119 - DNA, 15 bp, Homo sapiens
gctggagagtggtag

SEQ ID NO: 120 - DNA, 15 bp, Homo sapiens
tgctggagagtggta

SEQ ID NO: 121 - DNA, 15 bp, Homo sapiens
ttgctggagagtggt

SEQ ID NO: 122 - DNA, 15 bp, Homo sapiens
gttgctggagagtgg

SEQ ID NO: 123 - DNA, 15 bp, Homo sapiens
tgttgctggagagtg

SEQ ID NO: 124 - DNA, 15 bp, Homo sapiens
gtgttgctggagagt

SEQ ID NO: 125 - DNA, 15 bp, Homo sapiens
agtgttgctggagag

SEQ ID NO: 126 - DNA, 15 bp, Homo sapiens
cagtgttgctggaga

SEQ ID NO: 127 - DNA, 15 bp, Homo sapiens
tcagtgttgctggag

SEQ ID NO: 128 - DNA, 15 bp, Homo sapiens
gtcagtgttgctgga

SEQ ID NO: 129 - DNA, 15 bp, Homo sapiens
agtcagtgttgctgg

SEQ ID NO: 130 - DNA, 15 bp, Homo sapiens
aagtcagtgttgctg

SEQ ID NO: 131 - DNA, 15 bp, Homo sapiens
gaagtcagtgttgct

SEQ ID NO: 132 - DNA, 15 bp, Homo sapiens
ggaagtcagtgttgc

SEQ ID NO: 133 - DNA, 15 bp, Homo sapiens
aggaagtcagtgttg

SEQ ID NO: 134 - DNA, 15 bp, Homo sapiens
gaggaagtcagtgtt

SEQ ID NO: 135 - DNA, 15 bp, Homo sapiens
cgaggaagtcagtgt

SEQ ID NO: 136 - DNA, 15 bp, Homo sapiens
acgaggaagtcagtg

SEQ ID NO: 137 - DNA, 15 bp, Homo sapiens
aacgaggaagtcagt

SEQ ID NO: 138 - DNA, 15 bp, Homo sapiens
taacgaggaagtcag

SEQ ID NO: 139 - DNA, 15 bp, Homo sapiens
ctaacgaggaagtca

SEQ ID NO: 140 - DNA, 15 bp, Homo sapiens
actaacgaggaagtc

SEQ ID NO: 141 - DNA, 15 bp, Homo sapiens
gactaacgaggaagt

SEQ ID NO: 142 - DNA, 15 bp, Homo sapiens
ggactaacgaggaag

SEQ ID NO: 143 - DNA, 15 bp, Homo sapiens
gggactaacgaggaa

SEQ ID NO: 144 - DNA, 15 bp, Homo sapiens
ggggactaacgagga

SEQ ID NO: 145 - DNA, 15 bp, Homo sapiens
tggggactaacgagg

SEQ ID NO: 146 - DNA, 15 bp, Homo sapiens
ttggggactaacgag

SEQ ID NO: 147 - DNA, 15 bp, Homo sapiens
gttggggactaacga

SEQ ID NO: 148 - DNA, 15 bp, Homo sapiens
tgttggggactaacg

SEQ ID NO: 149 - DNA, 15 bp, Homo sapiens
atgttggggactaac

SEQ ID NO: 150 - DNA, 15 bp, Homo sapiens
catgttggggactaa

SEQ ID NO: 151 - DNA, 15 bp, Homo sapiens
gcatgttggggacta

SEQ ID NO: 152 - DNA, 15 bp, Homo sapiens
ggcatgttggggact

SEQ ID NO: 153 - DNA, 15 bp, Homo sapiens
tggcatgttggggac

SEQ ID NO: 154 - DNA, 15 bp, Homo sapiens
ctggcatgttgggga

SEQ ID NO: 155 - DNA, 15 bp, Homo sapiens
cctggcatgttgggg

SEQ ID NO: 156 - DNA, 15 bp, Homo sapiens
gcctggcatgttggg

SEQ ID NO: 157 - DNA, 15 bp, Homo sapiens
tgcctggcatgttgg

SEQ ID NO: 158 - DNA, 15 bp, Homo sapiens
atgcctggcatgttg

SEQ ID NO: 159 - DNA, 15 bp, Homo sapiens
tatgcctggcatgtt

SEQ ID NO: 160 - DNA, 15 bp, Homo sapiens
ctatgcctggcatgt

SEQ ID NO: 161 - DNA, 15 bp, Homo sapiens
actatgcctggcatg

SEQ ID NO: 162 - DNA, 15 bp, Homo sapiens
gactatgcctggcat

SEQ ID NO: 163 - DNA, 15 bp, Homo sapiens
agactatgcctggca

SEQ ID NO: 164 - DNA, 15 bp, Homo sapiens
gagactatgcctggc

SEQ ID NO: 165 - DNA, 15 bp, Homo sapiens
agagactatgcctgg

SEQ ID NO: 166 - DNA, 15 bp, Homo sapiens
gagagactatgcctg

SEQ ID NO: 167 - DNA, 15 bp, Homo sapiens
ggagagactatgcct

SEQ ID NO: 168 - DNA, 15 bp, Homo sapiens
aggagagactatgcc

SEQ ID NO: 169 - DNA, 15 bp, Homo sapiens
gaggagagactatgc

SEQ ID NO: 170 - DNA, 15 bp, Homo sapiens
tgaggagagactatg

SEQ ID NO: 171 - DNA, 15 bp, Homo sapiens
atgaggagagactat

SEQ ID NO: 172 - DNA, 15 bp, Homo sapiens
catgaggagagacta

SEQ ID NO: 173 - DNA, 15 bp, Homo sapiens
acatgaggagagact

SEQ ID NO: 174 - DNA, 15 bp, Homo sapiens
gacatgaggagagac

SEQ ID NO: 175 - DNA, 15 bp, Homo sapiens
ggacatgaggagaga

SEQ ID NO: 176 - DNA, 15 bp, Homo sapiens
aggacatgaggagag

SEQ ID NO: 177 - DNA, 15 bp, Homo sapiens
aaggacatgaggaga

SEQ ID NO: 178 - DNA, 15 bp, Homo sapiens
aaaggacatgaggag

SEQ ID NO: 179 - DNA, 15 bp, Homo sapiens
caaaggacatgagga

SEQ ID NO: 180 - DNA, 15 bp, Homo sapiens
tcaaaggacatgagg

SEQ ID NO: 181 - DNA, 15 bp, Homo sapiens
ttcaaaggacatgag

SEQ ID NO: 182 - DNA, 15 bp, Homo sapiens
gttcaaaggacatga

SEQ ID NO: 183 - DNA, 15 bp, Homo sapiens
agttcaaaggacatg

SEQ ID NO: 184 - DNA, 15 bp, Homo sapiens
aagttcaaaggacat

SEQ ID NO: 185 - DNA, 15 bp, Homo sapiens
caagttcaaaggaca

SEQ ID NO: 186 - DNA, 15 bp, Homo sapiens
gcaagttcaaaggac

SEQ ID NO: 187 - DNA, 15 bp, Homo sapiens
ggcaagttcaaagga

SEQ ID NO: 188 - DNA, 15 bp, Homo sapiens
aggcaagttcaaagg

SEQ ID NO: 189 - DNA, 15 bp, Homo sapiens
caggcaagttcaaag

SEQ ID NO: 190 - DNA, 15 bp, Homo sapiens
ccaggcaagttcaaa

SEQ ID NO: 191 - DNA, 15 bp, Homo sapiens
tccaggcaagttcaa

SEQ ID NO: 192 - DNA, 15 bp, Homo sapiens
ttccaggcaagttca

SEQ ID NO: 193 - DNA, 15 bp, Homo sapiens
attccaggcaagttc

SEQ ID NO: 194 - DNA, 15 bp, Homo sapiens
cattccaggcaagtt

SEQ ID NO: 195 - DNA, 15 bp, Homo sapiens
acattccaggcaagt

SEQ ID NO: 196 - DNA, 15 bp, Homo sapiens
aacattccaggcaag

SEQ ID NO: 197 - DNA, 15 bp, Homo sapiens
gaacattccaggcaa

SEQ ID NO: 198 - DNA, 15 bp, Homo sapiens
agaacattccaggca

SEQ ID NO: 199 - DNA, 15 bp, Homo sapiens
aagaacattccaggc

SEQ ID NO: 200 - DNA, 15 bp, Homo sapiens
aaagaacattccagg

SEQ ID NO: 201 - DNA, 15 bp, Homo sapiens
gaaagaacattccag

SEQ ID NO: 202 - DNA, 15 bp, Homo sapiens
ggaaagaacattcca

SEQ ID NO: 203 - DNA, 15 bp, Homo sapiens
gggaaagaacattcc

SEQ ID NO: 204 - DNA, 15 bp, Homo sapiens
ggggaaagaacattc

SEQ ID NO: 205 - DNA, 15 bp, Homo sapiens
tggggaaagaacatt

SEQ ID NO: 206 - DNA, 15 bp, Homo sapiens
ctggggaaagaacat

SEQ ID NO: 207 - DNA, 15 bp, Homo sapiens
tctggggaaagaaca

SEQ ID NO: 208 - DNA, 15 bp, Homo sapiens
atctggggaaagaac

SEQ ID NO: 209 - DNA, 15 bp, Homo sapiens
tatctggggaaagaa

SEQ ID NO: 210 - DNA, 15 bp, Homo sapiens
atatctggggaaaga

SEQ ID NO: 211 - DNA, 15 bp, Homo sapiens
aatatctggggaaag

SEQ ID NO: 212 - DNA, 15 bp, Homo sapiens
gaatatctggggaaa

SEQ ID NO: 213 - DNA, 15 bp, Homo sapiens
tgaatatctggggaa

SEQ ID NO: 214 - DNA, 15 bp, Homo sapiens
atgaatatctgggga

SEQ ID NO: 215 - DNA, 15 bp, Homo sapiens
tatgaatatctgggg

SEQ ID NO: 216 - DNA, 15 bp, Homo sapiens
atatgaatatctggg

SEQ ID NO: 217 - DNA, 15 bp, Homo sapiens
catatgaatatctgg

SEQ ID NO: 218 - DNA, 15 bp, Homo sapiens
tcatatgaatatctg

SEQ ID NO: 219 - DNA, 15 bp, Homo sapiens
ctcatatgaatatct

SEQ ID NO: 220 - DNA, 15 bp, Homo sapiens
cctcatatgaatatc

SEQ ID NO: 221 - DNA, 15 bp, Homo sapiens
ccctcatatgaatat

SEQ ID NO: 222 - DNA, 15 bp, Homo sapiens
tccctcatatgaata

SEQ ID NO: 223 - DNA, 15 bp, Homo sapiens
ctccctcatatgaat

SEQ ID NO: 224 - DNA, 15 bp, Homo sapiens
actccctcatatgaa

SEQ ID NO: 225 - DNA, 15 bp, Homo sapiens
tactccctcatatga

SEQ ID NO: 226 - DNA, 15 bp, Homo sapiens
ttactccctcatatg

SEQ ID NO: 227 - DNA, 15 bp, Homo sapiens
tttactccctcatat

SEQ ID NO: 228 - DNA, 15 bp, Homo sapiens
ttttactccctcata

SEQ ID NO: 229 - DNA, 15 bp, Homo sapiens
attttactccctcat

SEQ ID NO: 230 - DNA, 15 bp, Homo sapiens
cattttactccctca

SEQ ID NO: 231 - DNA, 15 bp, Homo sapiens
tcattttactccctc

SEQ ID NO: 232 - DNA, 15 bp, Homo sapiens
ctcattttactccct

SEQ ID NO: 233 - DNA, 15 bp, Homo sapiens
cctcattttactccc

SEQ ID NO: 234 - DNA, 15 bp, Homo sapiens
ccctcattttactcc

SEQ ID NO: 235 - DNA, 15 bp, Homo sapiens
accctcattttactc

SEQ ID NO: 236 - DNA, 15 bp, Homo sapiens
caccctcattttact

SEQ ID NO: 237 - DNA, 15 bp, Homo sapiens
tcaccctcattttac

SEQ ID NO: 238 - DNA, 15 bp, Homo sapiens
ttcaccctcatttta

SEQ ID NO: 239 - DNA, 15 bp, Homo sapiens
tttcaccctcatttt

SEQ ID NO: 240 - DNA, 15 bp, Homo sapiens
ttttcaccctcattt

SEQ ID NO: 241 - DNA, 15 bp, Homo sapiens
gttttcaccctcatt

SEQ ID NO: 242 - DNA, 15 bp, Homo sapiens
ggttttcaccctcat

SEQ ID NO: 243 - DNA, 15 bp, Homo sapiens
tggttttcaccctca

SEQ ID NO: 244 - DNA, 15 bp, Homo sapiens
ctggttttcaccctc

SEQ ID NO: 245 - DNA, 15 bp, Homo sapiens
gctggttttcaccct

SEQ ID NO: 246 - DNA, 15 bp, Homo sapiens
tgctggttttcaccc

SEQ ID NO: 247 - DNA, 15 bp, Homo sapiens
ctgctggttttcacc

SEQ ID NO: 248 - DNA, 15 bp, Homo sapiens
tctgctggttttcac

SEQ ID NO: 249 - DNA, 15 bp, Homo sapiens
atctgctggttttca

SEQ ID NO: 250 - DNA, 15 bp, Homo sapiens
tatctgctggttttc

SEQ ID NO: 251 - DNA, 15 bp, Homo sapiens
atatctgctggtttt

SEQ ID NO: 252 - DNA, 15 bp, Homo sapiens
gatatctgctggttt

SEQ ID NO: 253 - DNA, 15 bp, Homo sapiens
agatatctgctggtt

SEQ ID NO: 254 - DNA, 15 bp, Homo sapiens
tagatatctgctggt

SEQ ID NO: 255 - DNA, 15 bp, Homo sapiens
ttagatatctgctgg

SEQ ID NO: 256 - DNA, 15 bp, Homo sapiens
tttagatatctgctg

SEQ ID NO: 257 - DNA, 15 bp, Homo sapiens
atttagatatctgct

SEQ ID NO: 258 - DNA, 15 bp, Homo sapiens
tatttagatatctgc

SEQ ID NO: 259 - DNA, 15 bp, Homo sapiens
ctatttagatatctg

SEQ ID NO: 260 - DNA, 15 bp, Homo sapiens
gctatttagatatct

SEQ ID NO: 261 - DNA, 15 bp, Homo sapiens
tgctatttagatatc

SEQ ID NO: 262 - DNA, 15 bp, Homo sapiens
gtgctatttagatat

SEQ ID NO: 263 - DNA, 15 bp, Homo sapiens
ggtgctatttagata

SEQ ID NO: 264 - DNA, 15 bp, Homo sapiens
gggtgctatttagat

SEQ ID NO: 265 - DNA, 15 bp, Homo sapiens
ggggtgctatttaga

SEQ ID NO: 266 - DNA, 15 bp, Homo sapiens
gggggtgctatttag

SEQ ID NO: 267 - DNA, 15 bp, Homo sapiens
agggggtgctattta

SEQ ID NO: 268 - DNA, 15 bp, Homo sapiens
aagggggtgctattt

SEQ ID NO: 269 - DNA, 15 bp, Homo sapiens
gaagggggtgctatt

SEQ ID NO: 270 - DNA, 15 bp, Homo sapiens
tgaagggggtgctat

SEQ ID NO: 271 - DNA, 15 bp, Homo sapiens
gtgaagggggtgcta

SEQ ID NO: 272 - DNA, 15 bp, Homo sapiens
agtgaagggggtgct

SEQ ID NO: 273 - DNA, 15 bp, Homo sapiens
aagtgaagggggtgc

SEQ ID NO: 274 - DNA, 15 bp, Homo sapiens
taagtgaagggggtg

SEQ ID NO: 275 - DNA, 15 bp, Homo sapiens
ctaagtgaagggggt

SEQ ID NO: 276 - DNA, 15 bp, Homo sapiens
actaagtgaaggggg

SEQ ID NO: 277 - DNA, 15 bp, Homo sapiens
aactaagtgaagggg

SEQ ID NO: 278 - DNA, 15 bp, Homo sapiens
aaactaagtgaaggg

SEQ ID NO: 279 - DNA, 15 bp, Homo sapiens
taaactaagtgaagg

SEQ ID NO: 280 - DNA, 15 bp, Homo sapiens
ataaactaagtgaag

SEQ ID NO: 281 - DNA, 15 bp, Homo sapiens
gataaactaagtgaa

SEQ ID NO: 282 - DNA, 15 bp, Homo sapiens
agataaactaagtga

SEQ ID NO: 283 - DNA, 15 bp, Homo sapiens
aagataaactaagtg

SEQ ID NO: 284 - DNA, 15 bp, Homo sapiens
aaagataaactaagt

SEQ ID NO: 285 - DNA, 15 bp, Homo sapiens
gaaagataaactaag

SEQ ID NO: 286 - DNA, 15 bp, Homo sapiens
agaaagataaactaa

SEQ ID NO: 287 - DNA, 15 bp, Homo sapiens
gagaaagataaacta

SEQ ID NO: 288 - DNA, 15 bp, Homo sapiens
tgagaaagataaact

SEQ ID NO: 289 - DNA, 15 bp, Homo sapiens
ttgagaaagataaac

SEQ ID NO: 290 - DNA, 15 bp, Homo sapiens
tttgagaaagataaa

SEQ ID NO: 291 - DNA, 15 bp, Homo sapiens
ctttgagaaagataa

SEQ ID NO: 292 - DNA, 15 bp, Homo sapiens
gctttgagaaagata

SEQ ID NO: 293 - DNA, 15 bp, Homo sapiens
ggctttgagaaagat

SEQ ID NO: 294 - DNA, 15 bp, Homo sapiens
gggctttgagaaaga

SEQ ID NO: 295 - DNA, 15 bp, Homo sapiens
agggctttgagaaag

SEQ ID NO: 296 - DNA, 15 bp, Homo sapiens
aagggctttgagaaa

SEQ ID NO: 297 - DNA, 15 bp, Homo sapiens
taagggctttgagaa

SEQ ID NO: 298 - DNA, 15 bp, Homo sapiens
ataagggctttgaga

SEQ ID NO: 299 - DNA, 15 bp, Homo sapiens
gataagggctttgag

SEQ ID NO: 300 - DNA, 15 bp, Homo sapiens
tgataagggctttga

SEQ ID NO: 301 - DNA, 15 bp, Homo sapiens
gtgataagggctttg

SEQ ID NO: 302 - DNA, 15 bp, Homo sapiens
agtgataagggcttt

SEQ ID NO: 303 - DNA, 15 bp, Homo sapiens
tagtgataagggctt

SEQ ID NO: 304 - DNA, 15 bp, Homo sapiens
atagtgataagggct

SEQ ID NO: 305 - DNA, 15 bp, Homo sapiens
catagtgataagggc

SEQ ID NO: 306 - DNA, 15 bp, Homo sapiens
acatagtgataaggg

SEQ ID NO: 307 - DNA, 15 bp, Homo sapiens
cacatagtgataagg

SEQ ID NO: 308 - DNA, 15 bp, Homo sapiens
tcacatagtgataag

SEQ ID NO: 309 - DNA, 15 bp, Homo sapiens
ttcacatagtgataa

SEQ ID NO: 310 - DNA, 15 bp, Homo sapiens
tttcacatagtgata

SEQ ID NO: 311 - DNA, 15 bp, Homo sapiens
atttcacatagtgat

SEQ ID NO: 312 - DNA, 15 bp, Homo sapiens
catttcacatagtga

SEQ ID NO: 313 - DNA, 15 bp, Homo sapiens
tcatttcacatagtg

SEQ ID NO: 314 - DNA, 15 bp, Homo sapiens
atcatttcacatagt

SEQ ID NO: 315 - DNA, 15 bp, Homo sapiens
tatcatttcacatag

SEQ ID NO: 316 - DNA, 15 bp, Homo sapiens
atatcatttcacata

SEQ ID NO: 317 - DNA, 15 bp, Homo sapiens
tatatcatttcacat

SEQ ID NO: 318 - DNA, 15 bp, Homo sapiens
atatatcatttcaca

SEQ ID NO: 319 - DNA, 15 bp, Homo sapiens
aatatatcatttcac

SEQ ID NO: 320 - DNA, 15 bp, Homo sapiens
taatatatcatttca

SEQ ID NO: 321 - DNA, 15 bp, Homo sapiens
ataatatatcatttc

SEQ ID NO: 322 - DNA, 15 bp, Homo sapiens
tataatatatcattt

SEQ ID NO: 323 - DNA, 15 bp, Homo sapiens
gtataatatatcatt

SEQ ID NO: 324 - DNA, 15 bp, Homo sapiens
agtataatatatcat

SEQ ID NO: 325 - DNA, 15 bp, Homo sapiens
aagtataatatatca

SEQ ID NO: 326 - DNA, 15 bp, Homo sapiens
taagtataatatatc

SEQ ID NO: 327 - DNA, 15 bp, Homo sapiens
ataagtataatatat

SEQ ID NO: 328 - DNA, 15 bp, Homo sapiens
aataagtataatata

SEQ ID NO: 329 - DNA, 15 bp, Homo sapiens
aaataagtataatat

SEQ ID NO: 330 - DNA, 15 bp, Homo sapiens
caaataagtataata

SEQ ID NO: 331 - DNA, 15 bp, Homo sapiens
acaaataagtataat

SEQ ID NO: 332 - DNA, 15 bp, Homo sapiens
tacaaataagtataa

SEQ ID NO: 333 - DNA, 15 bp, Homo sapiens
atacaaataagtata

SEQ ID NO: 334 - DNA, 15 bp, Homo sapiens
catacaaataagtat

SEQ ID NO: 335 - DNA, 15 bp, Homo sapiens
gcatacaaataagta

SEQ ID NO: 336 - DNA, 15 bp, Homo sapiens
agcatacaaataagt

SEQ ID NO: 337 - DNA, 15 bp, Homo sapiens
tagcatacaaataag

SEQ ID NO: 338 - DNA, 15 bp, Homo sapiens
ctagcatacaaataa

SEQ ID NO: 339 - DNA, 15 bp, Homo sapiens
actagcatacaaata

SEQ ID NO: 340 - DNA, 15 bp, Homo sapiens
tactagcatacaaat

SEQ ID NO: 341 - DNA, 15 bp, Homo sapiens
atactagcatacaaa

SEQ ID NO: 342 - DNA, 15 bp, Homo sapiens
catactagcatacaa

SEQ ID NO: 343 - DNA, 15 bp, Homo sapiens
tcatactagcataca

SEQ ID NO: 344 - DNA, 15 bp, Homo sapiens
ttcatactagcatac

SEQ ID NO: 345 - DNA, 15 bp, Homo sapiens
attcatactagcata

SEQ ID NO: 346 - DNA, 15 bp, Homo sapiens
gattcatactagcat

SEQ ID NO: 347 - DNA, 15 bp, Homo sapiens
agattcatactagca

SEQ ID NO: 348 - DNA, 15 bp, Homo sapiens
aagattcatactagc

SEQ ID NO: 349 - DNA, 15 bp, Homo sapiens
gaagattcatactag

SEQ ID NO: 350 - DNA, 15 bp, Homo sapiens
ggaagattcatacta

SEQ ID NO: 351 - DNA, 15 bp, Homo sapiens
gggaagattcatact

SEQ ID NO: 352 - DNA, 15 bp, Homo sapiens
cgggaagattcatac

SEQ ID NO: 353 - DNA, 15 bp, Homo sapiens
ccgggaagattcata

SEQ ID NO: 354 - DNA, 15 bp, Homo sapiens
gccgggaagattcat

SEQ ID NO: 355 - DNA, 15 bp, Homo sapiens
tgccgggaagattca

SEQ ID NO: 356 - DNA, 15 bp, Homo sapiens
ttgccgggaagattc

SEQ ID NO: 357 - DNA, 15 bp, Homo sapiens
cttgccgggaagatt

SEQ ID NO: 358 - DNA, 15 bp, Homo sapiens
tcttgccgggaagat

SEQ ID NO: 359 - DNA, 15 bp, Homo sapiens
ttcttgccgggaaga

SEQ ID NO: 360 - DNA, 15 bp, Homo sapiens
attcttgccgggaag

SEQ ID NO: 361 - DNA, 15 bp, Homo sapiens
cattcttgccgggaa

SEQ ID NO: 362 - DNA, 15 bp, Homo sapiens
acattcttgccggga

SEQ ID NO: 363 - DNA, 15 bp, Homo sapiens
aacattcttgccggg

SEQ ID NO: 364 - DNA, 15 bp, Homo sapiens
taacattcttgccgg

SEQ ID NO: 365 - DNA, 15 bp, Homo sapiens
ctaacattcttgccg

SEQ ID NO: 366 - DNA, 15 bp, Homo sapiens
actaacattcttgcc

SEQ ID NO: 367 - DNA, 15 bp, Homo sapiens
aactaacattcttgc

SEQ ID NO: 368 - DNA, 15 bp, Homo sapiens
aaactaacattcttg

SEQ ID NO: 369 - DNA, 15 bp, Homo sapiens
caaactaacattctt

SEQ ID NO: 370 - DNA, 15 bp, Homo sapiens
gcaaactaacattct

SEQ ID NO: 371 - DNA, 15 bp, Homo sapiens
agcaaactaacattc

SEQ ID NO: 372 - DNA, 15 bp, Homo sapiens
cagcaaactaacatt

SEQ ID NO: 373 - DNA, 15 bp, Homo sapiens
acagcaaactaacat

SEQ ID NO: 374 - DNA, 15 bp, Homo sapiens
gacagcaaactaaca

SEQ ID NO: 375 - DNA, 15 bp, Homo sapiens
agacagcaaactaac

SEQ ID NO: 376 - DNA, 15 bp, Homo sapiens
cagacagcaaactaa

SEQ ID NO: 377 - DNA, 15 bp, Homo sapiens
acagacagcaaacta

SEQ ID NO: 378 - DNA, 15 bp, Homo sapiens
aacagacagcaaact

SEQ ID NO: 379 - DNA, 15 bp, Homo sapiens
gaacagacagcaaac

SEQ ID NO: 380 - DNA, 15 bp, Homo sapiens
tgaacagacagcaaa

SEQ ID NO: 381 - DNA, 15 bp, Homo sapiens
ctgaacagacagcaa

SEQ ID NO: 382 - DNA, 15 bp, Homo sapiens
actgaacagacagca

SEQ ID NO: 383 - DNA, 15 bp, Homo sapiens
tactgaacagacagc

SEQ ID NO: 384 - DNA, 15 bp, Homo sapiens
gtactgaacagacag

SEQ ID NO: 385 - DNA, 15 bp, Homo sapiens
ggtactgaacagaca

SEQ ID NO: 386 - DNA, 15 bp, Homo sapiens
cggtactgaacagac

SEQ ID NO: 387 - DNA, 15 bp, Homo sapiens
acggtactgaacaga

SEQ ID NO: 388 - DNA, 15 bp, Homo sapiens
cacggtactgaacag

SEQ ID NO: 389 - DNA, 15 bp, Homo sapiens
gcacggtactgaaca

SEQ ID NO: 390 - DNA, 15 bp, Homo sapiens
tgcacggtactgaac

SEQ ID NO: 391 - DNA, 15 bp, Homo sapiens
atgcacggtactgaa

SEQ ID NO: 392 - DNA, 15 bp, Homo sapiens
gatgcacggtactga

SEQ ID NO: 393 - DNA, 15 bp, Homo sapiens
ggatgcacggtactg

SEQ ID NO: 394 - DNA, 15 bp, Homo sapiens
tggatgcacggtact

SEQ ID NO: 395 - DNA, 15 bp, Homo sapiens
ctggatgcacggtac

SEQ ID NO: 396 - DNA, 15 bp, Homo sapiens
tctggatgcacggta

SEQ ID NO: 397 - DNA, 15 bp, Homo sapiens
ctctggatgcacggt

SEQ ID NO: 398 - DNA, 15 bp, Homo sapiens
gctctggatgcacgg

SEQ ID NO: 399 - DNA, 15 bp, Homo sapiens
ggctctggatgcacg

SEQ ID NO: 400 - DNA, 15 bp, Homo sapiens
aggctctggatgcac

SEQ ID NO: 401 - DNA, 15 bp, Homo sapiens
caggctctggatgca

SEQ ID NO: 402 - DNA, 15 bp, Homo sapiens
ccaggctctggatgc

SEQ ID NO: 403 - DNA, 15 bp, Homo sapiens
tccaggctctggatg

SEQ ID NO: 404 - DNA, 15 bp, Homo sapiens
ttccaggctctggat

SEQ ID NO: 405 - DNA, 15 bp, Homo sapiens
cttccaggctctgga

SEQ ID NO: 406 - DNA, 15 bp, Homo sapiens
tcttccaggctctgg

SEQ ID NO: 407 - DNA, 15 bp, Homo sapiens
ctcttccaggctctg

SEQ ID NO: 408 - DNA, 15 bp, Homo sapiens
actcttccaggctct

SEQ ID NO: 409 - DNA, 15 bp, Homo sapiens
cactcttccaggctc

SEQ ID NO: 410 - DNA, 15 bp, Homo sapiens
gcactcttccaggct

SEQ ID NO: 411 - DNA, 15 bp, Homo sapiens
ggcactcttccaggc

SEQ ID NO: 412 - DNA, 15 bp, Homo sapiens
aggcactcttccagg

SEQ ID NO: 413 - DNA, 15 bp, Homo sapiens
caggcactcttccag

SEQ ID NO: 414 - DNA, 15 bp, Homo sapiens
ccaggcactcttcca

SEQ ID NO: 415 - DNA, 15 bp, Homo sapiens
gccaggcactcttcc

SEQ ID NO: 416 - DNA, 15 bp, Homo sapiens
tgccaggcactcttc

SEQ ID NO: 417 - DNA, 15 bp, Homo sapiens
gtgccaggcactctt

SEQ ID NO: 418 - DNA, 15 bp, Homo sapiens
tgtgccaggcactct

SEQ ID NO: 419 - DNA, 15 bp, Homo sapiens
atgtgccaggcactc

SEQ ID NO: 420 - DNA, 15 bp, Homo sapiens
tatgtgccaggcact

SEQ ID NO: 421 - DNA, 15 bp, Homo sapiens
ctatgtgccaggcac

SEQ ID NO: 422 - DNA, 15 bp, Homo sapiens
gctatgtgccaggca

SEQ ID NO: 423 - DNA, 15 bp, Homo sapiens
tgctatgtgccaggc

SEQ ID NO: 424 - DNA, 15 bp, Homo sapiens
ctgctatgtgccagg

SEQ ID NO: 425 - DNA, 15 bp, Homo sapiens
cctgctatgtgccag

SEQ ID NO: 426 - DNA, 15 bp, Homo sapiens
acctgctatgtgcca

SEQ ID NO: 427 - DNA, 15 bp, Homo sapiens
tacctgctatgtgcc

SEQ ID NO: 428 - DNA, 15 bp, Homo sapiens
ctacctgctatgtgc

SEQ ID NO: 429 - DNA, 15 bp, Homo sapiens
actacctgctatgtg

SEQ ID NO: 430 - DNA, 15 bp, Homo sapiens
gactacctgctatgt

SEQ ID NO: 431 - DNA, 15 bp, Homo sapiens
tgactacctgctatg

SEQ ID NO: 432 - DNA, 15 bp, Homo sapiens
ttgactacctgctat

SEQ ID NO: 433 - DNA, 15 bp, Homo sapiens
attgactacctgcta

SEQ ID NO: 434 - DNA, 15 bp, Homo sapiens
tattgactacctgct

SEQ ID NO: 435 - DNA, 15 bp, Homo sapiens
ttattgactacctgc

SEQ ID NO: 436 - DNA, 15 bp, Homo sapiens
tttattgactacctg

SEQ ID NO: 437 - DNA, 15 bp, Homo sapiens
atttattgactacct

SEQ ID NO: 438 - DNA, 15 bp, Homo sapiens
catttattgactacc

SEQ ID NO: 439 - DNA, 15 bp, Homo sapiens
tcatttattgactac

SEQ ID NO: 440 - DNA, 15 bp, Homo sapiens
ttcatttattgacta

SEQ ID NO: 441 - DNA, 15 bp, Homo sapiens
attcatttattgact

SEQ ID NO: 442 - DNA, 15 bp, Homo sapiens
cattcatttattgac

SEQ ID NO: 443 - DNA, 15 bp, Homo sapiens
ccattcatttattga

SEQ ID NO: 444 - DNA, 15 bp, Homo sapiens
cccattcatttattg

SEQ ID NO: 445 - DNA, 15 bp, Homo sapiens
ccccattcatttatt

SEQ ID NO: 446 - DNA, 15 bp, Homo sapiens
cccccattcatttat

SEQ ID NO: 447 - DNA, 15 bp, Homo sapiens
gcccccattcattta

SEQ ID NO: 448 - DNA, 15 bp, Homo sapiens
tgcccccattcattt

SEQ ID NO: 449 - DNA, 15 bp, Homo sapiens
ttgcccccattcatt

SEQ ID NO: 450 - DNA, 15 bp, Homo sapiens
cttgcccccattcat

SEQ ID NO: 451 - DNA, 15 bp, Homo sapiens
gcttgcccccattca

SEQ ID NO: 452 - DNA, 15 bp, Homo sapiens
tgcttgcccccattc

SEQ ID NO: 453 - DNA, 15 bp, Homo sapiens
ctgcttgcccccatt

SEQ ID NO: 454 - DNA, 15 bp, Homo sapiens
gctgcttgcccccat

SEQ ID NO: 455 - DNA, 15 bp, Homo sapiens
ggctgcttgccccca

SEQ ID NO: 456 - DNA, 15 bp, Homo sapiens
tggctgcttgccccc

SEQ ID NO: 457 - DNA, 15 bp, Homo sapiens
ttggctgcttgcccc

SEQ ID NO: 458 - DNA, 15 bp, Homo sapiens
tttggctgcttgccc

SEQ ID NO: 459 - DNA, 15 bp, Homo sapiens
atttggctgcttgcc

SEQ ID NO: 460 - DNA, 15 bp, Homo sapiens
gatttggctgcttgc

SEQ ID NO: 461 - DNA, 15 bp, Homo sapiens
tgatttggctgcttg

SEQ ID NO: 462 - DNA, 15 bp, Homo sapiens
ctgatttggctgctt

SEQ ID NO: 463 - DNA, 15 bp, Homo sapiens
tctgatttggctgct

SEQ ID NO: 464 - DNA, 15 bp, Homo sapiens
ttctgatttggctgc

SEQ ID NO: 465 - DNA, 15 bp, Homo sapiens
attctgatttggctg

SEQ ID NO: 466 - DNA, 15 bp, Homo sapiens
gattctgatttggct

SEQ ID NO: 467 - DNA, 15 bp, Homo sapiens
tgattctgatttggc

SEQ ID NO: 468 - DNA, 15 bp, Homo sapiens
ctgattctgatttgg

SEQ ID NO: 469 - DNA, 15 bp, Homo sapiens
cctgattctgatttg

SEQ ID NO: 470 - DNA, 15 bp, Homo sapiens
acctgattctgattt

SEQ ID NO: 471 - DNA, 15 bp, Homo sapiens
aacctgattctgatt

SEQ ID NO: 472 - DNA, 15 bp, Homo sapiens
aaacctgattctgat

SEQ ID NO: 473 - DNA, 15 bp, Homo sapiens
aaaacctgattctga

SEQ ID NO: 474 - DNA, 15 bp, Homo sapiens
gaaaacctgattctg

SEQ ID NO: 475 - DNA, 15 bp, Homo sapiens
agaaaacctgattct

SEQ ID NO: 476 - DNA, 15 bp, Homo sapiens
aagaaaacctgattc

SEQ ID NO: 477 - DNA, 15 bp, Homo sapiens
caagaaaacctgatt

SEQ ID NO: 478 - DNA, 15 bp, Homo sapiens
gcaagaaaacctgat

SEQ ID NO: 479 - DNA, 15 bp, Homo sapiens
agcaagaaaacctga

SEQ ID NO: 480 - DNA, 15 bp, Homo sapiens
tagcaagaaaacctg

SEQ ID NO: 481 - DNA, 15 bp, Homo sapiens
ttagcaagaaaacct

SEQ ID NO: 482 - DNA, 15 bp, Homo sapiens
cttagcaagaaaacc

SEQ ID NO: 483 - DNA, 15 bp, Homo sapiens
gcttagcaagaaaac

SEQ ID NO: 484 - DNA, 15 bp, Homo sapiens
tgcttagcaagaaaa

SEQ ID NO: 485 - DNA, 15 bp, Homo sapiens
atgcttagcaagaaa

SEQ ID NO: 486 - DNA, 15 bp, Homo sapiens
tatgcttagcaagaa

SEQ ID NO: 487 - DNA, 15 bp, Homo sapiens
ctatgcttagcaaga

SEQ ID NO: 488 - DNA, 15 bp, Homo sapiens
tctatgcttagcaag

SEQ ID NO: 489 - DNA, 15 bp, Homo sapiens
ttctatgcttagcaa

SEQ ID NO: 490 - DNA, 15 bp, Homo sapiens
gttctatgcttagca

SEQ ID NO: 491 - DNA, 15 bp, Homo sapiens
agttctatgcttagc

SEQ ID NO: 492 - DNA, 15 bp, Homo sapiens
tagttctatgcttag

SEQ ID NO: 493 - DNA, 15 bp, Homo sapiens
ttagttctatgctta

SEQ ID NO: 494 - DNA, 15 bp, Homo sapiens
gttagttctatgctt

SEQ ID NO: 495 - DNA, 15 bp, Homo sapiens
tgttagttctatgct

SEQ ID NO: 496 - DNA, 15 bp, Homo sapiens
ctgttagttctatgc

SEQ ID NO: 497 - DNA, 15 bp, Homo sapiens
tctgttagttctatg

SEQ ID NO: 498 - DNA, 15 bp, Homo sapiens
ttctgttagttctat

SEQ ID NO: 499 - DNA, 15 bp, Homo sapiens
cttctgttagttcta

SEQ ID NO: 500 - DNA, 15 bp, Homo sapiens
ccttctgttagttct

SEQ ID NO: 501 - DNA, 15 bp, Homo sapiens
tccttctgttagttc

SEQ ID NO: 502 - DNA, 15 bp, Homo sapiens
atccttctgttagtt

SEQ ID NO: 503 - DNA, 15 bp, Homo sapiens
gatccttctgttagt

SEQ ID NO: 504 - DNA, 15 bp, Homo sapiens
tgatccttctgttag

SEQ ID NO: 505 - DNA, 15 bp, Homo sapiens
atgatccttctgtta

SEQ ID NO: 506 - DNA, 15 bp, Homo sapiens
aatgatccttctgtt

SEQ ID NO: 507 - DNA, 15 bp, Homo sapiens
caatgatccttctgt

SEQ ID NO: 508 - DNA, 15 bp, Homo sapiens
tcaatgatccttctg

SEQ ID NO: 509 - DNA, 15 bp, Homo sapiens
ttcaatgatccttct

SEQ ID NO: 510 - DNA, 15 bp, Homo sapiens
attcaatgatccttc

SEQ ID NO: 511 - DNA, 15 bp, Homo sapiens
cattcaatgatcctt

SEQ ID NO: 512 - DNA, 15 bp, Homo sapiens
ccattcaatgatcct

SEQ ID NO: 513 - DNA, 15 bp, Homo sapiens
tccattcaatgatcc

SEQ ID NO: 514 - DNA, 15 bp, Homo sapiens
atccattcaatgatc

SEQ ID NO: 515 - DNA, 15 bp, Homo sapiens
aatccattcaatgat

SEQ ID NO: 516 - DNA, 15 bp, Homo sapiens
caatccattcaatga

SEQ ID NO: 517 - DNA, 15 bp, Homo sapiens
ccaatccattcaatg

SEQ ID NO: 518 - DNA, 15 bp, Homo sapiens
tccaatccattcaat

SEQ ID NO: 519 - DNA, 15 bp, Homo sapiens
atccaatccattcaa

SEQ ID NO: 520 - DNA, 15 bp, Homo sapiens
tatccaatccattca

SEQ ID NO: 521 - DNA, 15 bp, Homo sapiens
ttatccaatccattc

SEQ ID NO: 522 - DNA, 15 bp, Homo sapiens
attatccaatccatt

SEQ ID NO: 523 - DNA, 15 bp, Homo sapiens
cattatccaatccat

SEQ ID NO: 524 - DNA, 15 bp, Homo sapiens
tcattatccaatcca

SEQ ID NO: 525 - DNA, 15 bp, Homo sapiens
gtcattatccaatcc

SEQ ID NO: 526 - DNA, 15 bp, Homo sapiens
agtcattatccaatc

SEQ ID NO: 527 - DNA, 15 bp, Homo sapiens
cagtcattatccaat

SEQ ID NO: 528 - DNA, 15 bp, Homo sapiens
ccagtcattatccaa

SEQ ID NO: 529 - DNA, 15 bp, Homo sapiens
gccagtcattatcca

SEQ ID NO: 530 - DNA, 15 bp, Homo sapiens
tgccagtcattatcc

SEQ ID NO: 531 - DNA, 15 bp, Homo sapiens
atgccagtcattatc

SEQ ID NO: 532 - DNA, 15 bp, Homo sapiens
gatgccagtcattat

SEQ ID NO: 533 - DNA, 15 bp, Homo sapiens
tgatgccagtcatta

SEQ ID NO: 534 - DNA, 15 bp, Homo sapiens
ctgatgccagtcatt

SEQ ID NO: 535 - DNA, 15 bp, Homo sapiens
cctgatgccagtcat

SEQ ID NO: 536 - DNA, 15 bp, Homo sapiens
ccctgatgccagtca

SEQ ID NO: 537 - DNA, 15 bp, Homo sapiens
accctgatgccagtc

SEQ ID NO: 538 - DNA, 15 bp, Homo sapiens
taccctgatgccagt

SEQ ID NO: 539 - DNA, 15 bp, Homo sapiens
ttaccctgatgccag

SEQ ID NO: 540 - DNA, 15 bp, Homo sapiens
cttaccctgatgcca

SEQ ID NO: 541 - DNA, 15 bp, Homo sapiens
ccttaccctgatgcc

SEQ ID NO: 542 - DNA, 15 bp, Homo sapiens
accttaccctgatgc

SEQ ID NO: 543 - DNA, 15 bp, Homo sapiens
gaccttaccctgatg

SEQ ID NO: 544 - DNA, 15 bp, Homo sapiens
ggaccttaccctgat

SEQ ID NO: 545 - DNA, 15 bp, Homo sapiens
gggaccttaccctga

SEQ ID NO: 546 - DNA, 15 bp, Homo sapiens
ggggaccttaccctg

SEQ ID NO: 547 - DNA, 15 bp, Homo sapiens
aggggaccttaccct

SEQ ID NO: 548 - DNA, 15 bp, Homo sapiens
aaggggaccttaccc

SEQ ID NO: 549 - DNA, 15 bp, Homo sapiens
taaggggaccttacc

SEQ ID NO: 550 - DNA, 15 bp, Homo sapiens
ttaaggggaccttac

SEQ ID NO: 551 - DNA, 15 bp, Homo sapiens
gttaaggggacctta

SEQ ID NO: 552 - DNA, 15 bp, Homo sapiens
tgttaaggggacctt

SEQ ID NO: 553 - DNA, 15 bp, Homo sapiens
ttgttaaggggacct

SEQ ID NO: 554 - DNA, 15 bp, Homo sapiens
tttgttaaggggacc

SEQ ID NO: 555 - DNA, 15 bp, Homo sapiens
gtttgttaaggggac

SEQ ID NO: 556 - DNA, 15 bp, Homo sapiens
tgtttgttaagggga

SEQ ID NO: 557 - DNA, 15 bp, Homo sapiens
gtgtttgttaagggg

SEQ ID NO: 558 - DNA, 15 bp, Homo sapiens
agtgtttgttaaggg

SEQ ID NO: 559 - DNA, 15 bp, Homo sapiens
gagtgtttgttaagg

SEQ ID NO: 560 - DNA, 15 bp, Homo sapiens
ggagtgtttgttaag

SEQ ID NO: 561 - DNA, 15 bp, Homo sapiens
aggagtgtttgttaa

SEQ ID NO: 562 - DNA, 15 bp, Homo sapiens
caggagtgtttgtta

SEQ ID NO: 563 - DNA, 15 bp, Homo sapiens
acaggagtgtttgtt

SEQ ID NO: 564 - DNA, 15 bp, Homo sapiens
gacaggagtgtttgt

SEQ ID NO: 565 - DNA, 15 bp, Homo sapiens
ggacaggagtgtttg

SEQ ID NO: 566 - DNA, 15 bp, Homo sapiens
aggacaggagtgttt

SEQ ID NO: 567 - DNA, 15 bp, Homo sapiens
caggacaggagtgtt

SEQ ID NO: 568 - DNA, 15 bp, Homo sapiens
tcaggacaggagtgt

SEQ ID NO: 569 - DNA, 15 bp, Homo sapiens
ttcaggacaggagtg

SEQ ID NO: 570 - DNA, 15 bp, Homo sapiens
gttcaggacaggagt

SEQ ID NO: 571 - DNA, 15 bp, Homo sapiens
tgttcaggacaggag

SEQ ID NO: 572 - DNA, 15 bp, Homo sapiens
gtgttcaggacagga

SEQ ID NO: 573 - DNA, 15 bp, Homo sapiens
ggtgttcaggacagg

SEQ ID NO: 574 - DNA, 15 bp, Homo sapiens
aggtgttcaggacag

SEQ ID NO: 575 - DNA, 15 bp, Homo sapiens
caggtgttcaggaca

SEQ ID NO: 576 - DNA, 15 bp, Homo sapiens
ccaggtgttcaggac

SEQ ID NO: 577 - DNA, 15 bp, Homo sapiens
accaggtgttcagga

SEQ ID NO: 578 - DNA, 15 bp, Homo sapiens
aaccaggtgttcagg

SEQ ID NO: 579 - DNA, 15 bp, Homo sapiens
taaccaggtgttcag

SEQ ID NO: 580 - DNA, 15 bp, Homo sapiens
ctaaccaggtgttca

SEQ ID NO: 581 - DNA, 15 bp, Homo sapiens
gctaaccaggtgttc

SEQ ID NO: 582 - DNA, 15 bp, Homo sapiens
agctaaccaggtgtt

SEQ ID NO: 583 - DNA, 15 bp, Homo sapiens
tagctaaccaggtgt

SEQ ID NO: 584 - DNA, 15 bp, Homo sapiens
ttagctaaccaggtg

SEQ ID NO: 585 - DNA, 15 bp, Homo sapiens
gttagctaaccaggt

SEQ ID NO: 586 - DNA, 15 bp, Homo sapiens
tgttagctaaccagg

SEQ ID NO: 587 - DNA, 15 bp, Homo sapiens
ctgttagctaaccag

SEQ ID NO: 588 - DNA, 15 bp, Homo sapiens
actgttagctaacca

SEQ ID NO: 589 - DNA, 15 bp, Homo sapiens
aactgttagctaacc

SEQ ID NO: 590 - DNA, 15 bp, Homo sapiens
aaactgttagctaac

SEQ ID NO: 591 - DNA, 15 bp, Homo sapiens
aaaactgttagctaa

SEQ ID NO: 592 - DNA, 15 bp, Homo sapiens
gaaaactgttagcta

SEQ ID NO: 593 - DNA, 15 bp, Homo sapiens
agaaaactgttagct

SEQ ID NO: 594 - DNA, 15 bp, Homo sapiens
gagaaaactgttagc

SEQ ID NO: 595 - DNA, 15 bp, Homo sapiens
tgagaaaactgttag

SEQ ID NO: 596 - DNA, 15 bp, Homo sapiens
atgagaaaactgtta

SEQ ID NO: 597 - DNA, 15 bp, Homo sapiens
tatgagaaaactgtt

SEQ ID NO: 598 - DNA, 15 bp, Homo sapiens
gtatgagaaaactgt

SEQ ID NO: 599 - DNA, 15 bp, Homo sapiens
agtatgagaaaactg

SEQ ID NO: 600 - DNA, 15 bp, Homo sapiens
gagtatgagaaaact

SEQ ID NO: 601 - DNA, 15 bp, Homo sapiens
agagtatgagaaaac

SEQ ID NO: 602 - DNA, 15 bp, Homo sapiens
aagagtatgagaaaa

SEQ ID NO: 603 - DNA, 15 bp, Homo sapiens
taagagtatgagaaa

SEQ ID NO: 604 - DNA, 15 bp, Homo sapiens
ataagagtatgagaa

SEQ ID NO: 605 - DNA, 15 bp, Homo sapiens
aataagagtatgaga

SEQ ID NO: 606 - DNA, 15 bp, Homo sapiens
aaataagagtatgag

SEQ ID NO: 607 - DNA, 15 bp, Homo sapiens
aaaataagagtatga

SEQ ID NO: 608 - DNA, 15 bp, Homo sapiens
gaaaataagagtatg

SEQ ID NO: 609 - DNA, 15 bp, Homo sapiens
ggaaaataagagtat

SEQ ID NO: 610 - DNA, 15 bp, Homo sapiens
gggaaaataagagta

SEQ ID NO: 611 - DNA, 15 bp, Homo sapiens
tgggaaaataagagt

SEQ ID NO: 612 - DNA, 15 bp, Homo sapiens
ttgggaaaataagag

SEQ ID NO: 613 - DNA, 15 bp, Homo sapiens
tttgggaaaataaga

SEQ ID NO: 614 - DNA, 15 bp, Homo sapiens
ttttgggaaaataag

SEQ ID NO: 615 - DNA, 15 bp, Homo sapiens
gttttgggaaaataa

SEQ ID NO: 616 - DNA, 15 bp, Homo sapiens
tgttttgggaaaata

SEQ ID NO: 617 - DNA, 15 bp, Homo sapiens
gtgttttgggaaaat

SEQ ID NO: 618 - DNA, 15 bp, Homo sapiens
tgtgttttgggaaaa

SEQ ID NO: 619 - DNA, 15 bp, Homo sapiens
ttgtgttttgggaaa

SEQ ID NO: 620 - DNA, 15 bp, Homo sapiens
attgtgttttgggaa

SEQ ID NO: 621 - DNA, 15 bp, Homo sapiens
aattgtgttttggga

SEQ ID NO: 622 - DNA, 15 bp, Homo sapiens
caattgtgttttggg

SEQ ID NO: 623 - DNA, 15 bp, Homo sapiens
gcaattgtgttttgg

SEQ ID NO: 624 - DNA, 15 bp, Homo sapiens
agcaattgtgttttg

SEQ ID NO: 625 - DNA, 15 bp, Homo sapiens
cagcaattgtgtttt

SEQ ID NO: 626 - DNA, 15 bp, Homo sapiens
ccagcaattgtgttt

SEQ ID NO: 627 - DNA, 15 bp, Homo sapiens
tccagcaattgtgtt

SEQ ID NO: 628 - DNA, 15 bp, Homo sapiens
atccagcaattgtgt

SEQ ID NO: 629 - DNA, 15 bp, Homo sapiens
gatccagcaattgtg

SEQ ID NO: 630 - DNA, 15 bp, Homo sapiens
agatccagcaattgt

SEQ ID NO: 631 - DNA, 15 bp, Homo sapiens
gagatccagcaattg

SEQ ID NO: 632 - DNA, 15 bp, Homo sapiens
tgagatccagcaatt

SEQ ID NO: 633 - DNA, 15 bp, Homo sapiens
ctgagatccagcaat

SEQ ID NO: 634 - DNA, 15 bp, Homo sapiens
gctgagatccagcaa

SEQ ID NO: 635 - DNA, 15 bp, Homo sapiens
agctgagatccagca

SEQ ID NO: 636 - DNA, 15 bp, Homo sapiens
gagctgagatccagc

SEQ ID NO: 637 - DNA, 15 bp, Homo sapiens
ggagctgagatccag

SEQ ID NO: 638 - DNA, 15 bp, Homo sapiens
tggagctgagatcca

SEQ ID NO: 639 - DNA, 15 bp, Homo sapiens
ttggagctgagatcc

SEQ ID NO: 640 - DNA, 15 bp, Homo sapiens
tttggagctgagatc

SEQ ID NO: 641 - DNA, 15 bp, Homo sapiens
atttggagctgagat

SEQ ID NO: 642 - DNA, 15 bp, Homo sapiens
gatttggagctgaga

SEQ ID NO: 643 - DNA, 15 bp, Homo sapiens
tgatttggagctgag

SEQ ID NO: 644 - DNA, 15 bp, Homo sapiens
ttgatttggagctga

SEQ ID NO: 645 - DNA, 15 bp, Homo sapiens
gttgatttggagctg

SEQ ID NO: 646 - DNA, 15 bp, Homo sapiens
agttgatttggagct

SEQ ID NO: 647 - DNA, 15 bp, Homo sapiens
gagttgatttggagc

SEQ ID NO: 648 - DNA, 15 bp, Homo sapiens
agagttgatttggag

SEQ ID NO: 649 - DNA, 15 bp, Homo sapiens
aagagttgatttgga

SEQ ID NO: 650 - DNA, 15 bp, Homo sapiens
gaagagttgatttgg

SEQ ID NO: 651 - DNA, 15 bp, Homo sapiens
agaagagttgatttg

SEQ ID NO: 652 - DNA, 15 bp, Homo sapiens
tagaagagttgattt

SEQ ID NO: 653 - DNA, 15 bp, Homo sapiens
ctagaagagttgatt

SEQ ID NO: 654 - DNA, 15 bp, Homo sapiens
cctagaagagttgat

SEQ ID NO: 655 - DNA, 15 bp, Homo sapiens
tcctagaagagttga

SEQ ID NO: 656 - DNA, 15 bp, Homo sapiens
ttcctagaagagttg

SEQ ID NO: 657 - DNA, 15 bp, Homo sapiens
tttcctagaagagtt

SEQ ID NO: 658 - DNA, 15 bp, Homo sapiens
ctttcctagaagagt

SEQ ID NO: 659 - DNA, 15 bp, Homo sapiens
actttcctagaagag

SEQ ID NO: 660 - DNA, 15 bp, Homo sapiens
cactttcctagaaga

SEQ ID NO: 661 - DNA, 15 bp, Homo sapiens
tcactttcctagaag

SEQ ID NO: 662 - DNA, 15 bp, Homo sapiens
ttcactttcctagaa

SEQ ID NO: 663 - DNA, 15 bp, Homo sapiens
tttcactttcctaga

SEQ ID NO: 664 - DNA, 15 bp, Homo sapiens
ttttcactttcctag

SEQ ID NO: 665 - DNA, 15 bp, Homo sapiens
tttttcactttccta

SEQ ID NO: 666 - DNA, 15 bp, Homo sapiens
atttttcactttcct

SEQ ID NO: 667 - DNA, 15 bp, Homo sapiens
aatttttcactttcc

SEQ ID NO: 668 - DNA, 15 bp, Homo sapiens
caatttttcactttc

SEQ ID NO: 669 - DNA, 15 bp, Homo sapiens
gcaatttttcacttt

SEQ ID NO: 670 - DNA, 15 bp, Homo sapiens
agcaatttttcactt

SEQ ID NO: 671 - DNA, 15 bp, Homo sapiens
cagcaatttttcact

SEQ ID NO: 672 - DNA, 15 bp, Homo sapiens
ccagcaatttttcac

SEQ ID NO: 673 - DNA, 15 bp, Homo sapiens
tccagcaatttttca

SEQ ID NO: 674 - DNA, 15 bp, Homo sapiens
atccagcaatttttc

SEQ ID NO: 675 - DNA, 15 bp, Homo sapiens
gatccagcaattttt

SEQ ID NO: 676 - DNA, 15 bp, Homo sapiens
agatccagcaatttt

SEQ ID NO: 677 - DNA, 15 bp, Homo sapiens
gagatccagcaattt

SEQ ID NO: 678 - DNA, 15 bp, Homo sapiens
gggagctgagatcca

SEQ ID NO: 679 - DNA, 15 bp, Homo sapiens
tgggagctgagatcc

SEQ ID NO: 680 - DNA, 15 bp, Homo sapiens
ttgggagctgagatc

SEQ ID NO: 681 - DNA, 15 bp, Homo sapiens
tttgggagctgagat

SEQ ID NO: 682 - DNA, 15 bp, Homo sapiens
atttgggagctgaga

SEQ ID NO: 683 - DNA, 15 bp, Homo sapiens
gatttgggagctgag

SEQ ID NO: 684 - DNA, 15 bp, Homo sapiens
tgatttgggagctga

SEQ ID NO: 685 - DNA, 15 bp, Homo sapiens
atgatttgggagctg

SEQ ID NO: 686 - DNA, 15 bp, Homo sapiens
tatgatttgggagct

SEQ ID NO: 687 - DNA, 15 bp, Homo sapiens
atatgatttgggagc

SEQ ID NO: 688 - DNA, 15 bp, Homo sapiens
gatatgatttgggag

SEQ ID NO: 689 - DNA, 15 bp, Homo sapiens
agatatgatttggga

SEQ ID NO: 690 - DNA, 15 bp, Homo sapiens
aagatatgatttggg

SEQ ID NO: 691 - DNA, 15 bp, Homo sapiens
gaagatatgatttgg

SEQ ID NO: 692 - DNA, 15 bp, Homo sapiens
ggaagatatgatttg

SEQ ID NO: 693 - DNA, 15 bp, Homo sapiens
tggaagatatgattt

SEQ ID NO: 694 - DNA, 15 bp, Homo sapiens
ctggaagatatgatt

SEQ ID NO: 695 - DNA, 15 bp, Homo sapiens
cctggaagatatgat

SEQ ID NO: 696 - DNA, 15 bp, Homo sapiens
gcctggaagatatga

SEQ ID NO: 697 - DNA, 15 bp, Homo sapiens
tgcctggaagatatg

SEQ ID NO: 698 - DNA, 15 bp, Homo sapiens
ctgcctggaagatat

SEQ ID NO: 699 - DNA, 15 bp, Homo sapiens
tctgcctggaagata

SEQ ID NO: 700 - DNA, 15 bp, Homo sapiens
ctctgcctggaagat

SEQ ID NO: 701 - DNA, 15 bp, Homo sapiens
gctctgcctggaaga

SEQ ID NO: 702 - DNA, 15 bp, Homo sapiens
agctctgcctggaag

SEQ ID NO: 703 - DNA, 15 bp, Homo sapiens
tagctctgcctggaa

SEQ ID NO: 704 - DNA, 15 bp, Homo sapiens
ttagctctgcctgga

SEQ ID NO: 705 - DNA, 15 bp, Homo sapiens
gttagctctgcctgg

SEQ ID NO: 706 - DNA, 15 bp, Homo sapiens
tgttagctctgcctg

SEQ ID NO: 707 - DNA, 15 bp, Homo sapiens
atgttagctctgcct

SEQ ID NO: 708 - DNA, 15 bp, Homo sapiens
aatgttagctctgcc

SEQ ID NO: 709 - DNA, 15 bp, Homo sapiens
caatgttagctctgc

SEQ ID NO: 710 - DNA, 15 bp, Homo sapiens
gcaatgttagctctg

SEQ ID NO: 711 - DNA, 15 bp, Homo sapiens
ggcaatgttagctct

SEQ ID NO: 712 - DNA, 15 bp, Homo sapiens
gggcaatgttagctc

SEQ ID NO: 713 - DNA, 15 bp, Homo sapiens
ggggcaatgttagct

SEQ ID NO: 714 - DNA, 15 bp, Homo sapiens
aggggcaatgttagc

SEQ ID NO: 715 - DNA, 15 bp, Homo sapiens
aaggggcaatgttag

SEQ ID NO: 716 - DNA, 15 bp, Homo sapiens
taaggggcaatgtta

SEQ ID NO: 717 - DNA, 15 bp, Homo sapiens
ataaggggcaatgtt

SEQ ID NO: 718 - DNA, 15 bp, Homo sapiens
aataaggggcaatgt

SEQ ID NO: 719 - DNA, 15 bp, Homo sapiens
gaataaggggcaatg

SEQ ID NO: 720 - DNA, 15 bp, Homo sapiens
tgaataaggggcaat

SEQ ID NO: 721 - DNA, 15 bp, Homo sapiens
gtgaataaggggcaa

SEQ ID NO: 722 - DNA, 15 bp, Homo sapiens
tgtgaataaggggca

SEQ ID NO: 723 - DNA, 15 bp, Homo sapiens
gtgtgaataaggggc

SEQ ID NO: 724 - DNA, 15 bp, Homo sapiens
ggtgtgaataagggg

SEQ ID NO: 725 - DNA, 15 bp, Homo sapiens
aggtgtgaataaggg

SEQ ID NO: 726 - DNA, 15 bp, Homo sapiens
gaggtgtgaataagg

SEQ ID NO: 727 - DNA, 15 bp, Homo sapiens
ggaggtgtgaataag

SEQ ID NO: 728 - DNA, 15 bp, Homo sapiens
tggaggtgtgaataa

SEQ ID NO: 729 - DNA, 15 bp, Homo sapiens
gtggaggtgtgaata

SEQ ID NO: 730 - DNA, 15 bp, Homo sapiens
ggtggaggtgtgaat

SEQ ID NO: 731 - DNA, 15 bp, Homo sapiens
tggtggaggtgtgaa

SEQ ID NO: 732 - DNA, 15 bp, Homo sapiens
ttggtggaggtgtga

SEQ ID NO: 733 - DNA, 15 bp, Homo sapiens
tttggtggaggtgtg

SEQ ID NO: 734 - DNA, 15 bp, Homo sapiens
gtttggtggaggtgt

SEQ ID NO: 735 - DNA, 15 bp, Homo sapiens
ggtttggtggaggtg

SEQ ID NO: 736 - DNA, 15 bp, Homo sapiens
tggtttggtggaggt

SEQ ID NO: 737 - DNA, 15 bp, Homo sapiens
atggtttggtggagg

SEQ ID NO: 738 - DNA, 15 bp, Homo sapiens
gatggtttggtggag

SEQ ID NO: 739 - DNA, 15 bp, Homo sapiens
agatggtttggtgga

SEQ ID NO: 740 - DNA, 15 bp, Homo sapiens
cagatggtttggtgg

SEQ ID NO: 741 - DNA, 15 bp, Homo sapiens
tcagatggtttggtg

SEQ ID NO: 742 - DNA, 15 bp, Homo sapiens
atcagatggtttggt

SEQ ID NO: 743 - DNA, 15 bp, Homo sapiens
gatcagatggtttgg

SEQ ID NO: 744 - DNA, 15 bp, Homo sapiens
ggatcagatggtttg

SEQ ID NO: 745 - DNA, 15 bp, Homo sapiens
tggatcagatggttt

SEQ ID NO: 746 - DNA, 15 bp, Homo sapiens
ttggatcagatggtt

SEQ ID NO: 747 - DNA, 15 bp, Homo sapiens
gttggatcagatggt

SEQ ID NO: 748 - DNA, 15 bp, Homo sapiens
tgttggatcagatgg

SEQ ID NO: 749 - DNA, 15 bp, Homo sapiens
ctgttggatcagatg

SEQ ID NO: 750 - DNA, 15 bp, Homo sapiens
actgttggatcagat

SEQ ID NO: 751 - DNA, 15 bp, Homo sapiens
cactgttggatcaga

SEQ ID NO: 752 - DNA, 15 bp, Homo sapiens
tcactgttggatcag

SEQ ID NO: 753 - DNA, 15 bp, Homo sapiens
gtcactgttggatca

SEQ ID NO: 754 - DNA, 15 bp, Homo sapiens
tgtcactgttggatc

SEQ ID NO: 755 - DNA, 15 bp, Homo sapiens
ctgtcactgttggat

SEQ ID NO: 756 - DNA, 15 bp, Homo sapiens
cctgtcactgttgga

SEQ ID NO: 757 - DNA, 15 bp, Homo sapiens
acctgtcactgttgg

SEQ ID NO: 758 - DNA, 15 bp, Homo sapiens
cacctgtcactgttg

SEQ ID NO: 759 - DNA, 15 bp, Homo sapiens
acacctgtcactgtt

SEQ ID NO: 760 - DNA, 15 bp, Homo sapiens
gacacctgtcactgt

SEQ ID NO: 761 - DNA, 15 bp, Homo sapiens
tgacacctgtcactg

SEQ ID NO: 762 - DNA, 15 bp, Homo sapiens
gtgacacctgtcact

SEQ ID NO: 763 - DNA, 15 bp, Homo sapiens
cgtgacacctgtcac

SEQ ID NO: 764 - DNA, 15 bp, Homo sapiens
tcgtgacacctgtca

SEQ ID NO: 765 - DNA, 15 bp, Homo sapiens
ctcgtgacacctgtc

SEQ ID NO: 766 - DNA, 15 bp, Homo sapiens
cctcgtgacacctgt

SEQ ID NO: 767 - DNA, 15 bp, Homo sapiens
gcctcgtgacacctg

SEQ ID NO: 768 - DNA, 15 bp, Homo sapiens
ggcctcgtgacacct

SEQ ID NO: 769 - DNA, 15 bp, Homo sapiens
aggcctcgtgacacc

SEQ ID NO: 770 - DNA, 15 bp, Homo sapiens
aaggcctcgtgacac

SEQ ID NO: 771 - DNA, 15 bp, Homo sapiens
caaggcctcgtgaca

SEQ ID NO: 772 - DNA, 15 bp, Homo sapiens
ccaaggcctcgtgac

SEQ ID NO: 773 - DNA, 15 bp, Homo sapiens
gccaaggcctcgtga

SEQ ID NO: 774 - DNA, 15 bp, Homo sapiens
tgccaaggcctcgtg

SEQ ID NO: 775 - DNA, 15 bp, Homo sapiens
atgccaaggcctcgt

SEQ ID NO: 776 - DNA, 15 bp, Homo sapiens
catgccaaggcctcg

SEQ ID NO: 777 - DNA, 15 bp, Homo sapiens
gcatgccaaggcctc

SEQ ID NO: 778 - DNA, 15 bp, Homo sapiens
tgcatgccaaggcct

SEQ ID NO: 779 - DNA, 15 bp, Homo sapiens
gtgcatgccaaggcc

SEQ ID NO: 780 - DNA, 15 bp, Homo sapiens
agtgcatgccaaggc

SEQ ID NO: 781 - DNA, 15 bp, Homo sapiens
gagtgcatgccaagg

SEQ ID NO: 782 - DNA, 15 bp, Homo sapiens
agagtgcatgccaag

SEQ ID NO: 783 - DNA, 15 bp, Homo sapiens
gagagtgcatgccaa

SEQ ID NO: 784 - DNA, 15 bp, Homo sapiens
agagagtgcatgcca

SEQ ID NO: 785 - DNA, 15 bp, Homo sapiens
aagagagtgcatgcc

SEQ ID NO: 786 - DNA, 15 bp, Homo sapiens
gaagagagtgcatgc

SEQ ID NO: 787 - DNA, 15 bp, Homo sapiens
ggaagagagtgcatg

SEQ ID NO: 788 - DNA, 15 bp, Homo sapiens
gggaagagagtgcat

SEQ ID NO: 789 - DNA, 15 bp, Homo sapiens
ggggaagagagtgca

SEQ ID NO: 790 - DNA, 15 bp, Homo sapiens
gggggaagagagtgc

SEQ ID NO: 791 - DNA, 15 bp, Homo sapiens
cgggggaagagagtg

SEQ ID NO: 792 - DNA, 15 bp, Homo sapiens
gcgggggaagagagt

SEQ ID NO: 793 - DNA, 15 bp, Homo sapiens
ggcgggggaagagag

SEQ ID NO: 794 - DNA, 15 bp, Homo sapiens
tggcgggggaagaga

SEQ ID NO: 795 - DNA, 15 bp, Homo sapiens
ctggcgggggaagag

SEQ ID NO: 796 - DNA, 15 bp, Homo sapiens
tctggcgggggaaga

SEQ ID NO: 797 - DNA, 15 bp, Homo sapiens
ctctggcgggggaag

SEQ ID NO: 798 - DNA, 15 bp, Homo sapiens
actctggcgggggaa

SEQ ID NO: 799 - DNA, 15 bp, Homo sapiens
aactctggcggggga

SEQ ID NO: 800 - DNA, 15 bp, Homo sapiens
gaactctggcggggg

SEQ ID NO: 801 - DNA, 15 bp, Homo sapiens
agaactctggcgggg

SEQ ID NO: 802 - DNA, 15 bp, Homo sapiens
cagaactctggcggg

SEQ ID NO: 803 - DNA, 15 bp, Homo sapiens
gcagaactctggcgg

SEQ ID NO: 804 - DNA, 15 bp, Homo sapiens
cgcagaactctggcg

SEQ ID NO: 805 - DNA, 15 bp, Homo sapiens
tcgcagaactctggc

SEQ ID NO: 806 - DNA, 15 bp, Homo sapiens
ttcgcagaactctgg

SEQ ID NO: 807 - DNA, 15 bp, Homo sapiens
tttcgcagaactctg

SEQ ID NO: 808 - DNA, 15 bp, Homo sapiens
ctttcgcagaactct

SEQ ID NO: 809 - DNA, 15 bp, Homo sapiens
gctttcgcagaactc

SEQ ID NO: 810 - DNA, 15 bp, Homo sapiens
ggctttcgcagaact

SEQ ID NO: 811 - DNA, 15 bp, Homo sapiens
tggctttcgcagaac

SEQ ID NO: 812 - DNA, 15 bp, Homo sapiens
ctggctttcgcagaa

SEQ ID NO: 813 - DNA, 15 bp, Homo sapiens
cctggctttcgcaga

SEQ ID NO: 814 - DNA, 15 bp, Homo sapiens
ccctggctttcgcag

SEQ ID NO: 815 - DNA, 15 bp, Homo sapiens
accctggctttcgca

SEQ ID NO: 816 - DNA, 15 bp, Homo sapiens
aaccctggctttcgc

SEQ ID NO: 817 - DNA, 15 bp, Homo sapiens
caaccctggctttcg

SEQ ID NO: 818 - DNA, 15 bp, Homo sapiens
gcaaccctggctttc

SEQ ID NO: 819 - DNA, 15 bp, Homo sapiens
cgcaaccctggcttt

SEQ ID NO: 820 - DNA, 15 bp, Homo sapiens
tcgcaaccctggctt

SEQ ID NO: 821 - DNA, 15 bp, Homo sapiens
atcgcaaccctggct

SEQ ID NO: 822 - DNA, 15 bp, Homo sapiens
aatcgcaaccctggc

SEQ ID NO: 823 - DNA, 15 bp, Homo sapiens
aaatcgcaaccctgg

SEQ ID NO: 824 - DNA, 15 bp, Homo sapiens
caaatcgcaaccctg

SEQ ID NO: 825 - DNA, 15 bp, Homo sapiens
acaaatcgcaaccct

SEQ ID NO: 826 - DNA, 15 bp, Homo sapiens
aacaaatcgcaaccc

SEQ ID NO: 827 - DNA, 15 bp, Homo sapiens
caacaaatcgcaacc

SEQ ID NO: 828 - DNA, 15 bp, Homo sapiens
acaacaaatcgcaac

SEQ ID NO: 829 - DNA, 15 bp, Homo sapiens
gacaacaaatcgcaa

SEQ ID NO: 830 - DNA, 15 bp, Homo sapiens
tgacaacaaatcgca

SEQ ID NO: 831 - DNA, 15 bp, Homo sapiens
ctgacaacaaatcgc

SEQ ID NO: 832 - DNA, 15 bp, Homo sapiens
actgacaacaaatcg

SEQ ID NO: 833 - DNA, 15 bp, Homo sapiens
aactgacaacaaatc

SEQ ID NO: 834 - DNA, 15 bp, Homo sapiens
aaactgacaacaaat

SEQ ID NO: 835 - DNA, 15 bp, Homo sapiens
taaactgacaacaaa

SEQ ID NO: 836 - DNA, 15 bp, Homo sapiens
ataaactgacaacaa

SEQ ID NO: 837 - DNA, 15 bp, Homo sapiens
aataaactgacaaca

SEQ ID NO: 838 - DNA, 15 bp, Homo sapiens
gaataaactgacaac

SEQ ID NO: 839 - DNA, 15 bp, Homo sapiens
ggaataaactgacaa

SEQ ID NO: 840 - DNA, 15 bp, Homo sapiens
gggaataaactgaca

SEQ ID NO: 841 - DNA, 15 bp, Homo sapiens
ggggaataaactgac

SEQ ID NO: 842 - DNA, 15 bp, Homo sapiens
cggggaataaactga

SEQ ID NO: 843 - DNA, 15 bp, Homo sapiens
gcggggaataaactg

SEQ ID NO: 844 - DNA, 15 bp, Homo sapiens
ggcggggaataaact

SEQ ID NO: 845 - DNA, 15 bp, Homo sapiens
aggcggggaataaac

SEQ ID NO: 846 - DNA, 15 bp, Homo sapiens
gaggcggggaataaa

SEQ ID NO: 847 - DNA, 15 bp, Homo sapiens
agaggcggggaataa

SEQ ID NO: 848 - DNA, 15 bp, Homo sapiens
tagaggcggggaata

SEQ ID NO: 849 - DNA, 15 bp, Homo sapiens
atagaggcggggaat

SEQ ID NO: 850 - DNA, 15 bp, Homo sapiens
catagaggcggggaa

SEQ ID NO: 851 - DNA, 15 bp, Homo sapiens
tcatagaggcgggga

SEQ ID NO: 852 - DNA, 15 bp, Homo sapiens
ctcatagaggcgggg

SEQ ID NO: 853 - DNA, 15 bp, Homo sapiens
tctcatagaggcggg

SEQ ID NO: 854 - DNA, 15 bp, Homo sapiens
ctctcatagaggcgg

SEQ ID NO: 855 - DNA, 15 bp, Homo sapiens
actctcatagaggcg

SEQ ID NO: 856 - DNA, 15 bp, Homo sapiens
cactctcatagaggc

SEQ ID NO: 857 - DNA, 15 bp, Homo sapiens
acactctcatagagg

SEQ ID NO: 858 - DNA, 15 bp, Homo sapiens
cacactctcatagag

SEQ ID NO: 859 - DNA, 15 bp, Homo sapiens
tcacactctcataga

SEQ ID NO: 860 - DNA, 15 bp, Homo sapiens
ctcacactctcatag

SEQ ID NO: 861 - DNA, 15 bp, Homo sapiens
gctcacactctcata

SEQ ID NO: 862 - DNA, 15 bp, Homo sapiens
tgctcacactctcat

SEQ ID NO: 863 - DNA, 15 bp, Homo sapiens
gtgctcacactctca

SEQ ID NO: 864 - DNA, 15 bp, Homo sapiens
agtgctcacactctc

SEQ ID NO: 865 - DNA, 15 bp, Homo sapiens
cagtgctcacactct

SEQ ID NO: 866 - DNA, 15 bp, Homo sapiens
ccagtgctcacactc

SEQ ID NO: 867 - DNA, 15 bp, Homo sapiens
cccagtgctcacact

SEQ ID NO: 868 - DNA, 15 bp, Homo sapiens
gcccagtgctcacac

SEQ ID NO: 869 - DNA, 15 bp, Homo sapiens
tgcccagtgctcaca

SEQ ID NO: 870 - DNA, 15 bp, Homo sapiens
ctgcccagtgctcac

SEQ ID NO: 871 - DNA, 15 bp, Homo sapiens
cctgcccagtgctca

SEQ ID NO: 872 - DNA, 15 bp, Homo sapiens
gcctgcccagtgctc

SEQ ID NO: 873 - DNA, 15 bp, Homo sapiens
agcctgcccagtgct

SEQ ID NO: 874 - DNA, 15 bp, Homo sapiens
gagcctgcccagtgc

SEQ ID NO: 875 - DNA, 15 bp, Homo sapiens
cgagcctgcccagtg

SEQ ID NO: 876 - DNA, 15 bp, Homo sapiens
ccgagcctgcccagt

SEQ ID NO: 877 - DNA, 15 bp, Homo sapiens
tccgagcctgcccag

SEQ ID NO: 878 - DNA, 15 bp, Homo sapiens
atccgagcctgccca

SEQ ID NO: 879 - DNA, 15 bp, Homo sapiens
catccgagcctgccc

SEQ ID NO: 880 - DNA, 15 bp, Homo sapiens
tcatccgagcctgcc

SEQ ID NO: 881 - DNA, 15 bp, Homo sapiens
ttcatccgagcctgc

SEQ ID NO: 882 - DNA, 15 bp, Homo sapiens
tttcatccgagcctg

SEQ ID NO: 883 - DNA, 15 bp, Homo sapiens
atttcatccgagcct

SEQ ID NO: 884 - DNA, 15 bp, Homo sapiens
tatttcatccgagcc

SEQ ID NO: 885 - DNA, 15 bp, Homo sapiens
ttatttcatccgagc

SEQ ID NO: 886 - DNA, 15 bp, Homo sapiens
attatttcatccgag

SEQ ID NO: 887 - DNA, 15 bp, Homo sapiens
cattatttcatccga

SEQ ID NO: 888 - DNA, 15 bp, Homo sapiens
gcattatttcatccg

SEQ ID NO: 889 - DNA, 15 bp, Homo sapiens
tgcattatttcatcc

SEQ ID NO: 890 - DNA, 15 bp, Homo sapiens
atgcattatttcatc

SEQ ID NO: 891 - DNA, 15 bp, Homo sapiens
aatgcattatttcat

SEQ ID NO: 892 - DNA, 15 bp, Homo sapiens
caatgcattatttca

SEQ ID NO: 893 - DNA, 15 bp, Homo sapiens
tcaatgcattatttc

SEQ ID NO: 894 - DNA, 15 bp, Homo sapiens
ctcaatgcattattt

SEQ ID NO: 895 - DNA, 15 bp, Homo sapiens
actcaatgcattatt

SEQ ID NO: 896 - DNA, 15 bp, Homo sapiens
tactcaatgcattat

SEQ ID NO: 897 - DNA, 15 bp, Homo sapiens
ctactcaatgcatta

SEQ ID NO: 898 - DNA, 15 bp, Homo sapiens
cctactcaatgcatt

SEQ ID NO: 899 - DNA, 15 bp, Homo sapiens
gcctactcaatgcat

SEQ ID NO: 900 - DNA, 15 bp, Homo sapiens
ggcctactcaatgca

SEQ ID NO: 901 - DNA, 15 bp, Homo sapiens
aggcctactcaatgc

SEQ ID NO: 902 - DNA, 15 bp, Homo sapiens
gaggcctactcaatg

SEQ ID NO: 903 - DNA, 15 bp, Homo sapiens
agaggcctactcaat

SEQ ID NO: 904 - DNA, 15 bp, Homo sapiens
cagaggcctactcaa

SEQ ID NO: 905 - DNA, 15 bp, Homo sapiens
tcagaggcctactca

SEQ ID NO: 906 - DNA, 15 bp, Homo sapiens
ttcagaggcctactc

SEQ ID NO: 907 - DNA, 15 bp, Homo sapiens
tttcagaggcctact

SEQ ID NO: 908 - DNA, 15 bp, Homo sapiens
gtttcagaggcctac

SEQ ID NO: 909 - DNA, 15 bp, Homo sapiens
ggtttcagaggccta

SEQ ID NO: 910 - DNA, 15 bp, Homo sapiens
tggtttcagaggcct

SEQ ID NO: 911 - DNA, 15 bp, Homo sapiens
ttggtttcagaggcc

SEQ ID NO: 912 - DNA, 15 bp, Homo sapiens
cttggtttcagaggc

SEQ ID NO: 913 - DNA, 15 bp, Homo sapiens
ccttggtttcagagg

SEQ ID NO: 914 - DNA, 15 bp, Homo sapiens
gccttggtttcagag

SEQ ID NO: 915 - DNA, 15 bp, Homo sapiens
ggccttggtttcaga

SEQ ID NO: 916 - DNA, 15 bp, Homo sapiens
gggccttggtttcag

SEQ ID NO: 917 - DNA, 15 bp, Homo sapiens
ggggccttggtttca

SEQ ID NO: 918 - DNA, 15 bp, Homo sapiens
aggggccttggtttc

SEQ ID NO: 919 - DNA, 15 bp, Homo sapiens
gaggggccttggttt

SEQ ID NO: 920 - DNA, 15 bp, Homo sapiens
tgaggggccttggtt

SEQ ID NO: 921 - DNA, 15 bp, Homo sapiens
ctgaggggccttggt

SEQ ID NO: 922 - DNA, 15 bp, Homo sapiens
gctgaggggccttgg

SEQ ID NO: 923 - DNA, 15 bp, Homo sapiens
agctgaggggccttg

SEQ ID NO: 924 - DNA, 15 bp, Homo sapiens
cagctgaggggcctt

SEQ ID NO: 925 - DNA, 15 bp, Homo sapiens
ccagctgaggggcct

SEQ ID NO: 926 - DNA, 15 bp, Homo sapiens
cccagctgaggggcc

SEQ ID NO: 927 - DNA, 15 bp, Homo sapiens
ccccagctgaggggc

SEQ ID NO: 928 - DNA, 15 bp, Homo sapiens
gccccagctgagggg

SEQ ID NO: 929 - DNA, 15 bp, Homo sapiens
tgccccagctgaggg

SEQ ID NO: 930 - DNA, 15 bp, Homo sapiens
ttgccccagctgagg

SEQ ID NO: 931 - DNA, 15 bp, Homo sapiens
gttgccccagctgag

SEQ ID NO: 932 - DNA, 15 bp, Homo sapiens
cgttgccccagctga

SEQ ID NO: 933 - DNA, 15 bp, Homo sapiens
acgttgccccagctg

SEQ ID NO: 934 - DNA, 15 bp, Homo sapiens
gacgttgccccagct

SEQ ID NO: 935 - DNA, 15 bp, Homo sapiens
tgacgttgccccagc

SEQ ID NO: 936 - DNA, 15 bp, Homo sapiens
ctgacgttgccccag

SEQ ID NO: 937 - DNA, 15 bp, Homo sapiens
cctgacgttgcccca

SEQ ID NO: 938 - DNA, 15 bp, Homo sapiens
gcctgacgttgcccc

SEQ ID NO: 939 - DNA, 15 bp, Homo sapiens
agcctgacgttgccc

SEQ ID NO: 940 - DNA, 15 bp, Homo sapiens
gagcctgacgttgcc

SEQ ID NO: 941 - DNA, 15 bp, Homo sapiens
ggagcctgacgttgc

SEQ ID NO: 942 - DNA, 15 bp, Homo sapiens
tggagcctgacgttg

SEQ ID NO: 943 - DNA, 15 bp, Homo sapiens
ctggagcctgacgtt

SEQ ID NO: 944 - DNA, 15 bp, Homo sapiens
cctggagcctgacgt

SEQ ID NO: 945 - DNA, 15 bp, Homo sapiens
ccctggagcctgacg

SEQ ID NO: 946 - DNA, 15 bp, Homo sapiens
accctggagcctgac

SEQ ID NO: 947 - DNA, 15 bp, Homo sapiens
caccctggagcctga

SEQ ID NO: 948 - DNA, 15 bp, Homo sapiens
ccaccctggagcctg

SEQ ID NO: 949 - DNA, 15 bp, Homo sapiens
cccaccctggagcct

SEQ ID NO: 950 - DNA, 15 bp, Homo sapiens
gcccaccctggagcc

SEQ ID NO: 951 - DNA, 15 bp, Homo sapiens
tgcccaccctggagc

SEQ ID NO: 952 - DNA, 15 bp, Homo sapiens
ttgcccaccctggag

SEQ ID NO: 953 - DNA, 15 bp, Homo sapiens
gttgcccaccctgga

SEQ ID NO: 954 - DNA, 15 bp, Homo sapiens
agttgcccaccctgg

SEQ ID NO: 955 - DNA, 15 bp, Homo sapiens
aagttgcccaccctg

SEQ ID NO: 956 - DNA, 15 bp, Homo sapiens
aaagttgcccaccct

SEQ ID NO: 957 - DNA, 15 bp, Homo sapiens
caaagttgcccaccc

SEQ ID NO: 958 - DNA, 15 bp, Homo sapiens
gcaaagttgcccacc

SEQ ID NO: 959 - DNA, 15 bp, Homo sapiens
agcaaagttgcccac

SEQ ID NO: 960 - DNA, 15 bp, Homo sapiens
cagcaaagttgccca

SEQ ID NO: 961 - DNA, 15 bp, Homo sapiens
gcagcaaagttgccc

SEQ ID NO: 962 - DNA, 15 bp, Homo sapiens
agcagcaaagttgcc

SEQ ID NO: 963 - DNA, 15 bp, Homo sapiens
aagcagcaaagttgc

SEQ ID NO: 964 - DNA, 15 bp, Homo sapiens
gaagcagcaaagttg

SEQ ID NO: 965 - DNA, 15 bp, Homo sapiens
agaagcagcaaagtt

SEQ ID NO: 966 - DNA, 15 bp, Homo sapiens
cagaagcagcaaagt

SEQ ID NO: 967 - DNA, 15 bp, Homo sapiens
gcagaagcagcaaag

SEQ ID NO: 968 - DNA, 15 bp, Homo sapiens
ggcagaagcagcaaa

SEQ ID NO: 969 - DNA, 15 bp, Homo sapiens
cggcagaagcagcaa

SEQ ID NO: 970 - DNA, 15 bp, Homo sapiens
tcggcagaagcagca

SEQ ID NO: 971 - DNA, 15 bp, Homo sapiens
ttcggcagaagcagc

SEQ ID NO: 972 - DNA, 15 bp, Homo sapiens
cttcggcagaagcag

SEQ ID NO: 973 - DNA, 15 bp, Homo sapiens
tcttcggcagaagca

SEQ ID NO: 974 - DNA, 15 bp, Homo sapiens
atcttcggcagaagc

SEQ ID NO: 975 - DNA, 15 bp, Homo sapiens
tatcttcggcagaag

SEQ ID NO: 976 - DNA, 15 bp, Homo sapiens
ctatcttcggcagaa

SEQ ID NO: 977 - DNA, 15 bp, Homo sapiens
actatcttcggcaga

SEQ ID NO: 978 - DNA, 15 bp, Homo sapiens
cactatcttcggcag

SEQ ID NO: 979 - DNA, 15 bp, Homo sapiens
tcactatcttcggca

SEQ ID NO: 980 - DNA, 15 bp, Homo sapiens
atcactatcttcggc

SEQ ID NO: 981 - DNA, 15 bp, Homo sapiens
tatcactatcttcgg

SEQ ID NO: 982 - DNA, 15 bp, Homo sapiens
atatcactatcttcg

SEQ ID NO: 983 - DNA, 15 bp, Homo sapiens
aatatcactatcttc

SEQ ID NO: 984 - DNA, 15 bp, Homo sapiens
caatatcactatctt

SEQ ID NO: 985 - DNA, 15 bp, Homo sapiens
tcaatatcactatct

SEQ ID NO: 986 - DNA, 15 bp, Homo sapiens
ctcaatatcactatc

SEQ ID NO: 987 - DNA, 15 bp, Homo sapiens
tctcaatatcactat

SEQ ID NO: 988 - DNA, 15 bp, Homo sapiens
ttctcaatatcacta

SEQ ID NO: 989 - DNA, 15 bp, Homo sapiens
tttctcaatatcact

SEQ ID NO: 990 - DNA, 15 bp, Homo sapiens
ttttctcaatatcac

SEQ ID NO: 991 - DNA, 15 bp, Homo sapiens
attttctcaatatca

SEQ ID NO: 992 - DNA, 15 bp, Homo sapiens
cattttctcaatatc

SEQ ID NO: 993 - DNA, 15 bp, Homo sapiens
acattttctcaatat

SEQ ID NO: 994 - DNA, 15 bp, Homo sapiens
cacattttctcaata

SEQ ID NO: 995 - DNA, 15 bp, Homo sapiens
ccacattttctcaat

SEQ ID NO: 996 - DNA, 15 bp, Homo sapiens
cccacattttctcaa

SEQ ID NO: 997 - DNA, 15 bp, Homo sapiens
acccacattttctca

SEQ ID NO: 998 - DNA, 15 bp, Homo sapiens
cacccacattttctc

SEQ ID NO: 999 - DNA, 15 bp, Homo sapiens
gcacccacattttct

SEQ ID NO: 1000 - DNA, 15 bp, Homo sapiens
tgcacccacattttc

SEQ ID NO: 1001 - DNA, 15 bp, Homo sapiens
ttgcacccacatttt

SEQ ID NO: 1002 - DNA, 15 bp, Homo sapiens
attgcacccacattt

SEQ ID NO: 1003 - DNA, 15 bp, Homo sapiens
cattgcacccacatt

SEQ ID NO: 1004 - DNA, 15 bp, Homo sapiens
tcattgcacccacat

SEQ ID NO: 1005 - DNA, 15 bp, Homo sapiens
ttcattgcacccaca

SEQ ID NO: 1006 - DNA, 15 bp, Homo sapiens
tttcattgcacccac

SEQ ID NO: 1007 - DNA, 15 bp, Homo sapiens
gtttcattgcaccca

SEQ ID NO: 1008 - DNA, 15 bp, Homo sapiens
cgtttcattgcaccc

SEQ ID NO: 1009 - DNA, 15 bp, Homo sapiens
gcgtttcattgcacc

SEQ ID NO: 1010 - DNA, 15 bp, Homo sapiens
agcgtttcattgcac

SEQ ID NO: 1011 - DNA, 15 bp, Homo sapiens
aagcgtttcattgca

SEQ ID NO: 1012 - DNA, 15 bp, Homo sapiens
taagcgtttcattgc

SEQ ID NO: 1013 - DNA, 15 bp, Homo sapiens
ataagcgtttcattg

SEQ ID NO: 1014 - DNA, 15 bp, Homo sapiens
aataagcgtttcatt

SEQ ID NO: 1015 - DNA, 15 bp, Homo sapiens
caataagcgtttcat

SEQ ID NO: 1016 - DNA, 15 bp, Homo sapiens
gcaataagcgtttca

SEQ ID NO: 1017 - DNA, 15 bp, Homo sapiens
tgcaataagcgtttc

SEQ ID NO: 1018 - DNA, 15 bp, Homo sapiens
ctgcaataagcgttt

SEQ ID NO: 1019 - DNA, 15 bp, Homo sapiens
gctgcaataagcgtt

SEQ ID NO: 1020 - DNA, 15 bp, Homo sapiens
cgctgcaataagcgt

SEQ ID NO: 1021 - DNA, 15 bp, Homo sapiens
gcgctgcaataagcg

SEQ ID NO: 1022 - DNA, 15 bp, Homo sapiens
tgcgctgcaataagc

SEQ ID NO: 1023 - DNA, 15 bp, Homo sapiens
gtgcgctgcaataag

SEQ ID NO: 1024 - DNA, 15 bp, Homo sapiens
agtgcgctgcaataa

SEQ ID NO: 1025 - DNA, 15 bp, Homo sapiens
gagtgcgctgcaata

SEQ ID NO: 1026 - DNA, 15 bp, Homo sapiens
cgagtgcgctgcaat

SEQ ID NO: 1027 - DNA, 15 bp, Homo sapiens
ccgagtgcgctgcaa

SEQ ID NO: 1028 - DNA, 15 bp, Homo sapiens
accgagtgcgctgca

SEQ ID NO: 1029 - DNA, 15 bp, Homo sapiens
caccgagtgcgctgc

SEQ ID NO: 1030 - DNA, 15 bp, Homo sapiens
gcaccgagtgcgctg

SEQ ID NO: 1031 - DNA, 15 bp, Homo sapiens
tgcaccgagtgcgct

SEQ ID NO: 1032 - DNA, 15 bp, Homo sapiens
atgcaccgagtgcgc

SEQ ID NO: 1033 - DNA, 15 bp, Homo sapiens
gatgcaccgagtgcg

SEQ ID NO: 1034 - DNA, 15 bp, Homo sapiens
agatgcaccgagtgc

SEQ ID NO: 1035 - DNA, 15 bp, Homo sapiens
cagatgcaccgagtg

SEQ ID NO: 1036 - DNA, 15 bp, Homo sapiens
acagatgcaccgagt

SEQ ID NO: 1037 - DNA, 15 bp, Homo sapiens
cacagatgcaccgag

SEQ ID NO: 1038 - DNA, 15 bp, Homo sapiens
ccacagatgcaccga

SEQ ID NO: 1039 - DNA, 15 bp, Homo sapiens
tccacagatgcaccg

SEQ ID NO: 1040 - DNA, 15 bp, Homo sapiens
gtccacagatgcacc

SEQ ID NO: 1041 - DNA, 15 bp, Homo sapiens
tgtccacagatgcac

SEQ ID NO: 1042 - DNA, 15 bp, Homo sapiens
ctgtccacagatgca

SEQ ID NO: 1043 - DNA, 15 bp, Homo sapiens
tctgtccacagatgc

SEQ ID NO: 1044 - DNA, 15 bp, Homo sapiens
ctctgtccacagatg

SEQ ID NO: 1045 - DNA, 15 bp, Homo sapiens
cctctgtccacagat

SEQ ID NO: 1046 - DNA, 15 bp, Homo sapiens
ccctctgtccacaga

SEQ ID NO: 1047 - DNA, 15 bp, Homo sapiens
accctctgtccacag

SEQ ID NO: 1048 - DNA, 15 bp, Homo sapiens
gaccctctgtccaca

SEQ ID NO: 1049 - DNA, 15 bp, Homo sapiens
tgaccctctgtccac

SEQ ID NO: 1050 - DNA, 15 bp, Homo sapiens
ttgaccctctgtcca

SEQ ID NO: 1051 - DNA, 15 bp, Homo sapiens
attgaccctctgtcc

SEQ ID NO: 1052 - DNA, 15 bp, Homo sapiens
gattgaccctctgtc

SEQ ID NO: 1053 - DNA, 15 bp, Homo sapiens
cgattgaccctctgt

SEQ ID NO: 1054 - DNA, 15 bp, Homo sapiens
gcgattgaccctctg

SEQ ID NO: 1055 - DNA, 15 bp, Homo sapiens
ggcgattgaccctct

SEQ ID NO: 1056 - DNA, 15 bp, Homo sapiens
gggcgattgaccctc

SEQ ID NO: 1057 - DNA, 15 bp, Homo sapiens
ggggcgattgaccct

SEQ ID NO: 1058 - DNA, 15 bp, Homo sapiens
aggggcgattgaccc

SEQ ID NO: 1059 - DNA, 15 bp, Homo sapiens
gaggggcgattgacc

SEQ ID NO: 1060 - DNA, 15 bp, Homo sapiens
tgaggggcgattgac

SEQ ID NO: 1061 - DNA, 15 bp, Homo sapiens
ctgaggggcgattga

SEQ ID NO: 1062 - DNA, 15 bp, Homo sapiens
tctgaggggcgattg

SEQ ID NO: 1063 - DNA, 15 bp, Homo sapiens
ctctgaggggcgatt

SEQ ID NO: 1064 - DNA, 15 bp, Homo sapiens
gctctgaggggcgat

SEQ ID NO: 1065 - DNA, 15 bp, Homo sapiens
tgctctgaggggcga

SEQ ID NO: 1066 - DNA, 15 bp, Homo sapiens
ctgctctgaggggcg

SEQ ID NO: 1067 - DNA, 15 bp, Homo sapiens
gctgctctgaggggc

SEQ ID NO: 1068 - DNA, 15 bp, Homo sapiens
cgctgctctgagggg

SEQ ID NO: 1069 - DNA, 15 bp, Homo sapiens
gcgctgctctgaggg

SEQ ID NO: 1070 - DNA, 15 bp, Homo sapiens
tgcgctgctctgagg

SEQ ID NO: 1071 - DNA, 15 bp, Homo sapiens
ttgcgctgctctgag

SEQ ID NO: 1072 - DNA, 15 bp, Homo sapiens
tttgcgctgctctga

SEQ ID NO: 1073 - DNA, 15 bp, Homo sapiens
gtttgcgctgctctg

SEQ ID NO: 1074 - DNA, 15 bp, Homo sapiens
tgtttgcgctgctct

SEQ ID NO: 1075 - DNA, 15 bp, Homo sapiens
ctgtttgcgctgctc

SEQ ID NO: 1076 - DNA, 15 bp, Homo sapiens
cctgtttgcgctgct

SEQ ID NO: 1077 - DNA, 15 bp, Homo sapiens
gcctgtttgcgctgc

SEQ ID NO: 1078 - DNA, 15 bp, Homo sapiens
cgcctgtttgcgctg

SEQ ID NO: 1079 - DNA, 15 bp, Homo sapiens
acgcctgtttgcgct

SEQ ID NO: 1080 - DNA, 15 bp, Homo sapiens
gacgcctgtttgcgc

SEQ ID NO: 1081 - DNA, 15 bp, Homo sapiens
ggacgcctgtttgcg

SEQ ID NO: 1082 - DNA, 15 bp, Homo sapiens
gggacgcctgtttgc

SEQ ID NO: 1083 - DNA, 15 bp, Homo sapiens
tgggacgcctgtttg

SEQ ID NO: 1084 - DNA, 15 bp, Homo sapiens
ttgggacgcctgttt

SEQ ID NO: 1085 - DNA, 15 bp, Homo sapiens
cttgggacgcctgtt

SEQ ID NO: 1086 - DNA, 15 bp, Homo sapiens
gcttgggacgcctgt

SEQ ID NO: 1087 - DNA, 15 bp, Homo sapiens
ggcttgggacgcctg

SEQ ID NO: 1088 - DNA, 15 bp, Homo sapiens
aggcttgggacgcct

SEQ ID NO: 1089 - DNA, 15 bp, Homo sapiens
taggcttgggacgcc

SEQ ID NO: 1090 - DNA, 15 bp, Homo sapiens
ctaggcttgggacgc

SEQ ID NO: 1091 - DNA, 15 bp, Homo sapiens
cctaggcttgggacg

SEQ ID NO: 1092 - DNA, 15 bp, Homo sapiens
gcctaggcttgggac

SEQ ID NO: 1093 - DNA, 15 bp, Homo sapiens
ggcctaggcttggga

SEQ ID NO: 1094 - DNA, 15 bp, Homo sapiens
aggcctaggcttggg

SEQ ID NO: 1095 - DNA, 15 bp, Homo sapiens
aaggcctaggcttgg

SEQ ID NO: 1096 - DNA, 15 bp, Homo sapiens
gaaggcctaggcttg

SEQ ID NO: 1097 - DNA, 15 bp, Homo sapiens
tgaaggcctaggctt

SEQ ID NO: 1098 - DNA, 15 bp, Homo sapiens
gtgaaggcctaggct

SEQ ID NO: 1099 - DNA, 15 bp, Homo sapiens
agtgaaggcctaggc

SEQ ID NO: 1100 - DNA, 15 bp, Homo sapiens
aagtgaaggcctagg

SEQ ID NO: 1101 - DNA, 15 bp, Homo sapiens
caagtgaaggcctag

SEQ ID NO: 1102 - DNA, 15 bp, Homo sapiens
gcaagtgaaggccta

SEQ ID NO: 1103 - DNA, 15 bp, Homo sapiens
ggcaagtgaaggcct

SEQ ID NO: 1104 - DNA, 15 bp, Homo sapiens
gggcaagtgaaggcc

SEQ ID NO: 1105 - DNA, 15 bp, Homo sapiens
ggggcaagtgaaggc

SEQ ID NO: 1106 - DNA, 15 bp, Homo sapiens
tggggcaagtgaagg

SEQ ID NO: 1107 - DNA, 15 bp, Homo sapiens
ctggggcaagtgaag

SEQ ID NO: 1108 - DNA, 15 bp, Homo sapiens
gctggggcaagtgaa

SEQ ID NO: 1109 - DNA, 15 bp, Homo sapiens
tgctggggcaagtga

SEQ ID NO: 1110 - DNA, 15 bp, Homo sapiens
atgctggggcaagtg

SEQ ID NO: 1111 - DNA, 15 bp, Homo sapiens
gatgctggggcaagt

SEQ ID NO: 1112 - DNA, 15 bp, Homo sapiens
ggatgctggggcaag

SEQ ID NO: 1113 - DNA, 15 bp, Homo sapiens
cggatgctggggcaa

SEQ ID NO: 1114 - DNA, 15 bp, Homo sapiens
gcggatgctggggca

SEQ ID NO: 1115 - DNA, 15 bp, Homo sapiens
tgcggatgctggggc

SEQ ID NO: 1116 - DNA, 15 bp, Homo sapiens
ttgcggatgctgggg

SEQ ID NO: 1117 - DNA, 15 bp, Homo sapiens
cttgcggatgctggg

SEQ ID NO: 1118 - DNA, 15 bp, Homo sapiens
ccttgcggatgctgg

SEQ ID NO: 1119 - DNA, 15 bp, Homo sapiens
cccttgcggatgctg

SEQ ID NO: 1120 - DNA, 15 bp, Homo sapiens
acccttgcggatgct

SEQ ID NO: 1121 - DNA, 15 bp, Homo sapiens
gacccttgcggatgc

SEQ ID NO: 1122 - DNA, 15 bp, Homo sapiens
ggacccttgcggatg

SEQ ID NO: 1123 - DNA, 15 bp, Homo sapiens
tggacccttgcggat

SEQ ID NO: 1124 - DNA, 15 bp, Homo sapiens
atggacccttgcgga

SEQ ID NO: 1125 - DNA, 15 bp, Homo sapiens
aatggacccttgcgg

SEQ ID NO: 1126 - DNA, 15 bp, Homo sapiens
taatggacccttgcg

SEQ ID NO: 1127 - DNA, 15 bp, Homo sapiens
ttaatggacccttgc

SEQ ID NO: 1128 - DNA, 15 bp, Homo sapiens
attaatggacccttg

SEQ ID NO: 1129 - DNA, 15 bp, Homo sapiens
gattaatggaccctt

SEQ ID NO: 1130 - DNA, 15 bp, Homo sapiens
ggattaatggaccct

SEQ ID NO: 1131 - DNA, 15 bp, Homo sapiens
aggattaatggaccc

SEQ ID NO: 1132 - DNA, 15 bp, Homo sapiens
aaggattaatggacc

SEQ ID NO: 1133 - DNA, 15 bp, Homo sapiens
taaggattaatggac

SEQ ID NO: 1134 - DNA, 15 bp, Homo sapiens
ttaaggattaatgga

SEQ ID NO: 1135 - DNA, 15 bp, Homo sapiens
gttaaggattaatgg

SEQ ID NO: 1136 - DNA, 15 bp, Homo sapiens
tgttaaggattaatg

SEQ ID NO: 1137 - DNA, 15 bp, Homo sapiens
atgttaaggattaat

SEQ ID NO: 1138 - DNA, 15 bp, Homo sapiens
aatgttaaggattaa

SEQ ID NO: 1139 - DNA, 15 bp, Homo sapiens
gaatgttaaggatta

SEQ ID NO: 1140 - DNA, 15 bp, Homo sapiens
tgaatgttaaggatt

SEQ ID NO: 1141 - DNA, 15 bp, Homo sapiens
ttgaatgttaaggat

SEQ ID NO: 1142 - DNA, 15 bp, Homo sapiens
tttgaatgttaagga

SEQ ID NO: 1143 - DNA, 15 bp, Homo sapiens
atttgaatgttaagg

SEQ ID NO: 1144 - DNA, 15 bp, Homo sapiens
aatttgaatgttaag

SEQ ID NO: 1145 - DNA, 15 bp, Homo sapiens
gaatttgaatgttaa

SEQ ID NO: 1146 - DNA, 15 bp, Homo sapiens
ggaatttgaatgtta

SEQ ID NO: 1147 - DNA, 15 bp, Homo sapiens
cggaatttgaatgtt

SEQ ID NO: 1148 - DNA, 15 bp, Homo sapiens
gcggaatttgaatgt

SEQ ID NO: 1149 - DNA, 15 bp, Homo sapiens
ggcggaatttgaatg

SEQ ID NO: 1150 - DNA, 15 bp, Homo sapiens
gggcggaatttgaat

SEQ ID NO: 1151 - DNA, 15 bp, Homo sapiens
tgggcggaatttgaa

SEQ ID NO: 1152 - DNA, 15 bp, Homo sapiens
gtgggcggaatttga

SEQ ID NO: 1153 - DNA, 15 bp, Homo sapiens
agtgggcggaatttg

SEQ ID NO: 1154 - DNA, 15 bp, Homo sapiens
tagtgggcggaattt

SEQ ID NO: 1155 - DNA, 15 bp, Homo sapiens
ttagtgggcggaatt

SEQ ID NO: 1156 - DNA, 15 bp, Homo sapiens
tttagtgggcggaat

SEQ ID NO: 1157 - DNA, 15 bp, Homo sapiens
gtttagtgggcggaa

SEQ ID NO: 1158 - DNA, 15 bp, Homo sapiens
ggtttagtgggcgga

SEQ ID NO: 1159 - DNA, 15 bp, Homo sapiens
tggtttagtgggcgg

SEQ ID NO: 1160 - DNA, 15 bp, Homo sapiens
ctggtttagtgggcg

SEQ ID NO: 1161 - DNA, 15 bp, Homo sapiens
actggtttagtgggc

SEQ ID NO: 1162 - DNA, 15 bp, Homo sapiens
gactggtttagtggg

SEQ ID NO: 1163 - DNA, 15 bp, Homo sapiens
ggactggtttagtgg

SEQ ID NO: 1164 - DNA, 15 bp, Homo sapiens
gggactggtttagtg

SEQ ID NO: 1165 - DNA, 15 bp, Homo sapiens
agggactggtttagt

SEQ ID NO: 1166 - DNA, 15 bp, Homo sapiens
gagggactggtttag

SEQ ID NO: 1167 - DNA, 15 bp, Homo sapiens
ggagggactggttta

SEQ ID NO: 1168 - DNA, 15 bp, Homo sapiens
cggagggactggttt

SEQ ID NO: 1169 - DNA, 15 bp, Homo sapiens
gcggagggactggtt

SEQ ID NO: 1170 - DNA, 15 bp, Homo sapiens
cgcggagggactggt

SEQ ID NO: 1171 - DNA, 15 bp, Homo sapiens
gcgcggagggactgg

SEQ ID NO: 1172 - DNA, 15 bp, Homo sapiens
ggcgcggagggactg

SEQ ID NO: 1173 - DNA, 15 bp, Homo sapiens
gggcgcggagggact

SEQ ID NO: 1174 - DNA, 15 bp, Homo sapiens
tgggcgcggagggac

SEQ ID NO: 1175 - DNA, 15 bp, Homo sapiens
ttgggcgcggaggga

SEQ ID NO: 1176 - DNA, 15 bp, Homo sapiens
cttgggcgcggaggg

SEQ ID NO: 1177 - DNA, 15 bp, Homo sapiens
gcttgggcgcggagg

SEQ ID NO: 1178 - DNA, 15 bp, Homo sapiens
ggcttgggcgcggag

SEQ ID NO: 1179 - DNA, 15 bp, Homo sapiens
cggcttgggcgcgga

SEQ ID NO: 1180 - DNA, 15 bp, Homo sapiens
gcggcttgggcgcgg

SEQ ID NO: 1181 - DNA, 15 bp, Homo sapiens
ggcggcttgggcgcg

SEQ ID NO: 1182 - DNA, 15 bp, Homo sapiens
aggcggcttgggcgc

SEQ ID NO: 1183 - DNA, 15 bp, Homo sapiens
gaggcggcttgggcg

SEQ ID NO: 1184 - DNA, 15 bp, Homo sapiens
agaggcggcttgggc

SEQ ID NO: 1185 - DNA, 15 bp, Homo sapiens
aagaggcggcttggg

SEQ ID NO: 1186 - DNA, 15 bp, Homo sapiens
aaagaggcggcttgg

SEQ ID NO: 1187 - DNA, 15 bp, Homo sapiens
aaaagaggcggcttg

SEQ ID NO: 1188 - DNA, 15 bp, Homo sapiens
gaaaagaggcggctt

SEQ ID NO: 1189 - DNA, 15 bp, Homo sapiens
ggaaaagaggcggct

SEQ ID NO: 1190 - DNA, 15 bp, Homo sapiens
gggaaaagaggcggc

SEQ ID NO: 1191 - DNA, 15 bp, Homo sapiens
ggggaaaagaggcgg

SEQ ID NO: 1192 - DNA, 15 bp, Homo sapiens
tggggaaaagaggcg

SEQ ID NO: 1193 - DNA, 15 bp, Homo sapiens
ttggggaaaagaggc

SEQ ID NO: 1194 - DNA, 15 bp, Homo sapiens
tttggggaaaagagg

SEQ ID NO: 1195 - DNA, 15 bp, Homo sapiens
gtttggggaaaagag

SEQ ID NO: 1196 - DNA, 15 bp, Homo sapiens
cgtttggggaaaaga

SEQ ID NO: 1197 - DNA, 15 bp, Homo sapiens
tcgtttggggaaaag

SEQ ID NO: 1198 - DNA, 15 bp, Homo sapiens
gtcgtttggggaaaa

SEQ ID NO: 1199 - DNA, 15 bp, Homo sapiens
cgtcgtttggggaaa

SEQ ID NO: 1200 - DNA, 15 bp, Homo sapiens
ccgtcgtttggggaa

SEQ ID NO: 1201 - DNA, 15 bp, Homo sapiens
gccgtcgtttgggga

SEQ ID NO: 1202 - DNA, 15 bp, Homo sapiens
ggccgtcgtttgggg

SEQ ID NO: 1203 - DNA, 15 bp, Homo sapiens
cggccgtcgtttggg

SEQ ID NO: 1204 - DNA, 15 bp, Homo sapiens
tcggccgtcgtttgg

SEQ ID NO: 1205 - DNA, 15 bp, Homo sapiens
ttcggccgtcgtttg

SEQ ID NO: 1206 - DNA, 15 bp, Homo sapiens
tttcggccgtcgttt

SEQ ID NO: 1207 - DNA, 15 bp, Homo sapiens
ctttcggccgtcgtt

SEQ ID NO: 1208 - DNA, 15 bp, Homo sapiens
gctttcggccgtcgt

SEQ ID NO: 1209 - DNA, 15 bp, Homo sapiens
tgctttcggccgtcg

SEQ ID NO: 1210 - DNA, 15 bp, Homo sapiens
ctgctttcggccgtc

SEQ ID NO: 1211 - DNA, 15 bp, Homo sapiens
gctgctttcggccgt

SEQ ID NO: 1212 - DNA, 15 bp, Homo sapiens
ggctgctttcggccg

SEQ ID NO: 1213 - DNA, 15 bp, Homo sapiens
tggctgctttcggcc

SEQ ID NO: 1214 - DNA, 15 bp, Homo sapiens
ttggctgctttcggc

SEQ ID NO: 1215 - DNA, 15 bp, Homo sapiens
attggctgctttcgg

SEQ ID NO: 1216 - DNA, 15 bp, Homo sapiens
gattggctgctttcg

SEQ ID NO: 1217 - DNA, 15 bp, Homo sapiens
tgattggctgctttc

SEQ ID NO: 1218 - DNA, 15 bp, Homo sapiens
ttgattggctgcttt

SEQ ID NO: 1219 - DNA, 15 bp, Homo sapiens
gttgattggctgctt

SEQ ID NO: 1220 - DNA, 15 bp, Homo sapiens
tgttgattggctgct

SEQ ID NO: 1221 - DNA, 15 bp, Homo sapiens
ctgttgattggctgc

SEQ ID NO: 1222 - DNA, 15 bp, Homo sapiens
gctgttgattggctg

SEQ ID NO: 1223 - DNA, 15 bp, Homo sapiens
agctgttgattggct

SEQ ID NO: 1224 - DNA, 15 bp, Homo sapiens
cagctgttgattggc

SEQ ID NO: 1225 - DNA, 15 bp, Homo sapiens
ccagctgttgattgg

SEQ ID NO: 1226 - DNA, 15 bp, Homo sapiens
tccagctgttgattg

SEQ ID NO: 1227 - DNA, 15 bp, Homo sapiens
ctccagctgttgatt

SEQ ID NO: 1228 - DNA, 15 bp, Homo sapiens
cctccagctgttgat

SEQ ID NO: 1229 - DNA, 15 bp, Homo sapiens
ccctccagctgttga

SEQ ID NO: 1230 - DNA, 15 bp, Homo sapiens
cccctccagctgttg

SEQ ID NO: 1231 - DNA, 15 bp, Homo sapiens
acccctccagctgtt

SEQ ID NO: 1232 - DNA, 15 bp, Homo sapiens
gacccctccagctgt

SEQ ID NO: 1233 - DNA, 15 bp, Homo sapiens
ggacccctccagctg

SEQ ID NO: 1234 - DNA, 15 bp, Homo sapiens
cggacccctccagct

SEQ ID NO: 1235 - DNA, 15 bp, Homo sapiens
gcggacccctccagc

SEQ ID NO: 1236 - DNA, 15 bp, Homo sapiens
ggcggacccctccag

SEQ ID NO: 1237 - DNA, 15 bp, Homo sapiens
gggcggacccctcca

SEQ ID NO: 1238 - DNA, 15 bp, Homo sapiens
ggggcggacccctcc

SEQ ID NO: 1239 - DNA, 15 bp, Homo sapiens
gggggcggacccctc

SEQ ID NO: 1240 - DNA, 15 bp, Homo sapiens
agggggcggacccct

SEQ ID NO: 1241 - DNA, 15 bp, Homo sapiens
aagggggcggacccc

SEQ ID NO: 1242 - DNA, 15 bp, Homo sapiens
aaagggggcggaccc

SEQ ID NO: 1243 - DNA, 15 bp, Homo sapiens
aaaagggggcggacc

SEQ ID NO: 1244 - DNA, 15 bp, Homo sapiens
gaaaagggggcggac

SEQ ID NO: 1245 - DNA, 15 bp, Homo sapiens
ggaaaagggggcgga

SEQ ID NO: 1246 - DNA, 15 bp, Homo sapiens
gggaaaagggggcgg

SEQ ID NO: 1247 - DNA, 15 bp, Homo sapiens
agggaaaagggggcg

SEQ ID NO: 1248 - DNA, 15 bp, Homo sapiens
cagggaaaagggggc

SEQ ID NO: 1249 - DNA, 15 bp, Homo sapiens
ccagggaaaaggggg

SEQ ID NO: 1250 - DNA, 15 bp, Homo sapiens
gccagggaaaagggg

SEQ ID NO: 1251 - DNA, 15 bp, Homo sapiens
ggccagggaaaaggg

SEQ ID NO: 1252 - DNA, 15 bp, Homo sapiens
cggccagggaaaagg

SEQ ID NO: 1253 - DNA, 15 bp, Homo sapiens
tcggccagggaaaag

SEQ ID NO: 1254 - DNA, 15 bp, Homo sapiens
ttcggccagggaaaa

SEQ ID NO: 1255 - DNA, 15 bp, Homo sapiens
tttcggccagggaaa

SEQ ID NO: 1256 - DNA, 15 bp, Homo sapiens
atttcggccagggaa

SEQ ID NO: 1257 - DNA, 15 bp, Homo sapiens
catttcggccaggga

SEQ ID NO: 1258 - DNA, 15 bp, Homo sapiens
ccatttcggccaggg

SEQ ID NO: 1259 - DNA, 15 bp, Homo sapiens
tccatttcggccagg

SEQ ID NO: 1260 - DNA, 15 bp, Homo sapiens
gtccatttcggccag

SEQ ID NO: 1261 - DNA, 15 bp, Homo sapiens
tgtccatttcggcca

SEQ ID NO: 1262 - DNA, 15 bp, Homo sapiens
ctgtccatttcggcc

SEQ ID NO: 1263 - DNA, 15 bp, Homo sapiens
cctgtccatttcggc

SEQ ID NO: 1264 - DNA, 15 bp, Homo sapiens
tcctgtccatttcgg

SEQ ID NO: 1265 - DNA, 15 bp, Homo sapiens
ttcctgtccatttcg

SEQ ID NO: 1266 - DNA, 15 bp, Homo sapiens
tttcctgtccatttc

SEQ ID NO: 1267 - DNA, 15 bp, Homo sapiens
atttcctgtccattt

SEQ ID NO: 1268 - DNA, 15 bp, Homo sapiens
gatttcctgtccatt

SEQ ID NO: 1269 - DNA, 15 bp, Homo sapiens
agatttcctgtccat

SEQ ID NO: 1270 - DNA, 15 bp, Homo sapiens
gagatttcctgtcca

SEQ ID NO: 1271 - DNA, 15 bp, Homo sapiens
cgagatttcctgtcc

SEQ ID NO: 1272 - DNA, 15 bp, Homo sapiens
gcgagatttcctgtc

SEQ ID NO: 1273 - DNA, 15 bp, Homo sapiens
ggcgagatttcctgt

SEQ ID NO: 1274 - DNA, 15 bp, Homo sapiens
tggcgagatttcctg

SEQ ID NO: 1275 - DNA, 15 bp, Homo sapiens
ttggcgagatttcct

SEQ ID NO: 1276 - DNA, 15 bp, Homo sapiens
attggcgagatttcc

SEQ ID NO: 1277 - DNA, 15 bp, Homo sapiens
aattggcgagatttc

SEQ ID NO: 1278 - DNA, 15 bp, Homo sapiens
caattggcgagattt

SEQ ID NO: 1279 - DNA, 15 bp, Homo sapiens
tcaattggcgagatt

SEQ ID NO: 1280 - DNA, 15 bp, Homo sapiens
gtcaattggcgagat

SEQ ID NO: 1281 - DNA, 15 bp, Homo sapiens
cgtcaattggcgaga

SEQ ID NO: 1282 - DNA, 15 bp, Homo sapiens
ccgtcaattggcgag

SEQ ID NO: 1283 - DNA, 15 bp, Homo sapiens
gccgtcaattggcga

SEQ ID NO: 1284 - DNA, 15 bp, Homo sapiens
tgccgtcaattggcg

SEQ ID NO: 1285 - DNA, 15 bp, Homo sapiens
atgccgtcaattggc

SEQ ID NO: 1286 - DNA, 15 bp, Homo sapiens
gatgccgtcaattgg

SEQ ID NO: 1287 - DNA, 15 bp, Homo sapiens
cgatgccgtcaattg

SEQ ID NO: 1288 - DNA, 15 bp, Homo sapiens
gcgatgccgtcaatt

SEQ ID NO: 1289 - DNA, 15 bp, Homo sapiens
ggcgatgccgtcaat

SEQ ID NO: 1290 - DNA, 15 bp, Homo sapiens
cggcgatgccgtcaa

SEQ ID NO: 1291 - DNA, 15 bp, Homo sapiens
gcggcgatgccgtca

SEQ ID NO: 1292 - DNA, 15 bp, Homo sapiens
agcggcgatgccgtc

SEQ ID NO: 1293 - DNA, 15 bp, Homo sapiens
cagcggcgatgccgt

SEQ ID NO: 1294 - DNA, 15 bp, Homo sapiens
tcagcggcgatgccg

SEQ ID NO: 1295 - DNA, 15 bp, Homo sapiens
ctcagcggcgatgcc

SEQ ID NO: 1296 - DNA, 15 bp, Homo sapiens
tctcagcggcgatgc

SEQ ID NO: 1297 - DNA, 15 bp, Homo sapiens
gtctcagcggcgatg

SEQ ID NO: 1298 - DNA, 15 bp, Homo sapiens
ggtctcagcggcgat

SEQ ID NO: 1299 - DNA, 15 bp, Homo sapiens
aggtctcagcggcga

SEQ ID NO: 1300 - DNA, 15 bp, Homo sapiens
gaggtctcagcggcg

SEQ ID NO: 1301 - DNA, 15 bp, Homo sapiens
ggaggtctcagcggc

SEQ ID NO: 1302 - DNA, 15 bp, Homo sapiens
gggaggtctcagcgg

SEQ ID NO: 1303 - DNA, 15 bp, Homo sapiens
ggggaggtctcagcg

SEQ ID NO: 1304 - DNA, 15 bp, Homo sapiens
gggggaggtctcagc

SEQ ID NO: 1305 - DNA, 15 bp, Homo sapiens
ggggggaggtctcag

SEQ ID NO: 1306 - DNA, 15 bp, Homo sapiens
aggggggaggtctca

SEQ ID NO: 1307 - DNA, 15 bp, Homo sapiens
gaggggggaggtctc

SEQ ID NO: 1308 - DNA, 15 bp, Homo sapiens
ggaggggggaggtct

SEQ ID NO: 1309 - DNA, 15 bp, Homo sapiens
gggaggggggaggtc

SEQ ID NO: 1310 - DNA, 15 bp, Homo sapiens
ggggaggggggaggt

SEQ ID NO: 1311 - DNA, 15 bp, Homo sapiens
gggggaggggggagg

SEQ ID NO: 1312 - DNA, 15 bp, Homo sapiens
cgggggaggggggag

SEQ ID NO: 1313 - DNA, 15 bp, Homo sapiens
acgggggagggggga

SEQ ID NO: 1314 - DNA, 15 bp, Homo sapiens
gacgggggagggggg

SEQ ID NO: 1315 - DNA, 15 bp, Homo sapiens
ggacgggggaggggg

SEQ ID NO: 1316 - DNA, 15 bp, Homo sapiens
aggacgggggagggg

SEQ ID NO: 1317 - DNA, 15 bp, Homo sapiens
gaggacgggggaggg

SEQ ID NO: 1318 - DNA, 15 bp, Homo sapiens
ggaggacgggggagg

SEQ ID NO: 1319 - DNA, 15 bp, Homo sapiens
gggaggacgggggag

SEQ ID NO: 1320 - DNA, 15 bp, Homo sapiens
ggggaggacggggga

SEQ ID NO: 1321 - DNA, 15 bp, Homo sapiens
cggggaggacggggg

SEQ ID NO: 1322 - DNA, 15 bp, Homo sapiens
acggggaggacgggg

SEQ ID NO: 1323 - DNA, 15 bp, Homo sapiens
gacggggaggacggg

SEQ ID NO: 1324 - DNA, 15 bp, Homo sapiens
ggacggggaggacgg

SEQ ID NO: 1325 - DNA, 15 bp, Homo sapiens
gggacggggaggacg

SEQ ID NO: 1326 - DNA, 15 bp, Homo sapiens
tgggacggggaggac

SEQ ID NO: 1327 - DNA, 15 bp, Homo sapiens
ctgggacggggagga

SEQ ID NO: 1328 - DNA, 15 bp, Homo sapiens
gctgggacggggagg

SEQ ID NO: 1329 - DNA, 15 bp, Homo sapiens
ggctgggacggggag

SEQ ID NO: 1330 - DNA, 15 bp, Homo sapiens
gggctgggacgggga

SEQ ID NO: 1331 - DNA, 15 bp, Homo sapiens
cgggctgggacgggg

SEQ ID NO: 1332 - DNA, 15 bp, Homo sapiens
ccgggctgggacggg

SEQ ID NO: 1333 - DNA, 15 bp, Homo sapiens
gccgggctgggacgg

SEQ ID NO: 1334 - DNA, 15 bp, Homo sapiens
ggccgggctgggacg

SEQ ID NO: 1335 - DNA, 15 bp, Homo sapiens
tggccgggctgggac

SEQ ID NO: 1336 - DNA, 15 bp, Homo sapiens
atggccgggctggga

SEQ ID NO: 1337 - DNA, 15 bp, Homo sapiens
gatggccgggctggg

SEQ ID NO: 1338 - DNA, 15 bp, Homo sapiens
tgatggccgggctgg

SEQ ID NO: 1339 - DNA, 15 bp, Homo sapiens
gtgatggccgggctg

SEQ ID NO: 1340 - DNA, 15 bp, Homo sapiens
tgtgatggccgggct

SEQ ID NO: 1341 - DNA, 15 bp, Homo sapiens
ctgtgatggccgggc

SEQ ID NO: 1342 - DNA, 15 bp, Homo sapiens
gctgtgatggccggg

SEQ ID NO: 1343 - DNA, 15 bp, Homo sapiens
ggctgtgatggccgg

SEQ ID NO: 1344 - DNA, 15 bp, Homo sapiens
tggctgtgatggccg

SEQ ID NO: 1345 - DNA, 15 bp, Homo sapiens
ttggctgtgatggcc

SEQ ID NO: 1346 - DNA, 15 bp, Homo sapiens
attggctgtgatggc

SEQ ID NO: 1347 - DNA, 15 bp, Homo sapiens
cattggctgtgatgg

SEQ ID NO: 1348 - DNA, 15 bp, Homo sapiens
tcattggctgtgatg

SEQ ID NO: 1349 - DNA, 15 bp, Homo sapiens
gtcattggctgtgat

SEQ ID NO: 1350 - DNA, 15 bp, Homo sapiens
cgtcattggctgtga

SEQ ID NO: 1351 - DNA, 15 bp, Homo sapiens
ccgtcattggctgtg

SEQ ID NO: 1352 - DNA, 15 bp, Homo sapiens
cccgtcattggctgt

SEQ ID NO: 1353 - DNA, 15 bp, Homo sapiens
gcccgtcattggctg

SEQ ID NO: 1354 - DNA, 15 bp, Homo sapiens
cgcccgtcattggct

SEQ ID NO: 1355 - DNA, 15 bp, Homo sapiens
ccgcccgtcattggc

SEQ ID NO: 1356 - DNA, 15 bp, Homo sapiens
cccgcccgtcattgg

SEQ ID NO: 1357 - DNA, 15 bp, Homo sapiens
gcccgcccgtcattg

SEQ ID NO: 1358 - DNA, 15 bp, Homo sapiens
agcccgcccgtcatt

SEQ ID NO: 1359 - DNA, 15 bp, Homo sapiens
gagcccgcccgtcat

SEQ ID NO: 1360 - DNA, 15 bp, Homo sapiens
cgagcccgcccgtca

SEQ ID NO: 1361 - DNA, 15 bp, Homo sapiens
gcgagcccgcccgtc

SEQ ID NO: 1362 - DNA, 15 bp, Homo sapiens
tgcgagcccgcccgt

SEQ ID NO: 1363 - DNA, 15 bp, Homo sapiens
ctgcgagcccgcccg

SEQ ID NO: 1364 - DNA, 15 bp, Homo sapiens
gctgcgagcccgccc

SEQ ID NO: 1365 - DNA, 15 bp, Homo sapiens
cgctgcgagcccgcc

SEQ ID NO: 1366 - DNA, 15 bp, Homo sapiens
ccgctgcgagcccgc

SEQ ID NO: 1367 - DNA, 15 bp, Homo sapiens
gccgctgcgagcccg

SEQ ID NO: 1368 - DNA, 15 bp, Homo sapiens
cgccgctgcgagccc

SEQ ID NO: 1369 - DNA, 15 bp, Homo sapiens
gcgccgctgcgagcc

SEQ ID NO: 1370 - DNA, 15 bp, Homo sapiens
ggcgccgctgcgagc

SEQ ID NO: 1371 - DNA, 15 bp, Homo sapiens
cggcgccgctgcgag

SEQ ID NO: 1372 - DNA, 15 bp, Homo sapiens
tcggcgccgctgcga

SEQ ID NO: 1373 - DNA, 15 bp, Homo sapiens
ctcggcgccgctgcg

SEQ ID NO: 1374 - DNA, 15 bp, Homo sapiens
cctcggcgccgctgc

SEQ ID NO: 1375 - DNA, 15 bp, Homo sapiens
ccctcggcgccgctg

SEQ ID NO: 1376 - DNA, 15 bp, Homo sapiens
gccctcggcgccgct

SEQ ID NO: 1377 - DNA, 15 bp, Homo sapiens
cgccctcggcgccgc

SEQ ID NO: 1378 - DNA, 15 bp, Homo sapiens
ccgccctcggcgccg

SEQ ID NO: 1379 - DNA, 15 bp, Homo sapiens
cccgccctcggcgcc

SEQ ID NO: 1380 - DNA, 15 bp, Homo sapiens
ccccgccctcggcgc

SEQ ID NO: 1381 - DNA, 15 bp, Homo sapiens
gccccgccctcggcg

SEQ ID NO: 1382 - DNA, 15 bp, Homo sapiens
cgccccgccctcggc

SEQ ID NO: 1383 - DNA, 15 bp, Homo sapiens
gcgccccgccctcgg

SEQ ID NO: 1384 - DNA, 15 bp, Homo sapiens
cgcgccccgccctcg

SEQ ID NO: 1385 - DNA, 15 bp, Homo sapiens
ccgcgccccgccctc

SEQ ID NO: 1386 - DNA, 15 bp, Homo sapiens
cccgcgccccgccct

SEQ ID NO: 1387 - DNA, 15 bp, Homo sapiens
gcccgcgccccgccc

SEQ ID NO: 1388 - DNA, 15 bp, Homo sapiens
cgcccgcgccccgcc

SEQ ID NO: 1389 - DNA, 15 bp, Homo sapiens
gcgcccgcgccccgc

SEQ ID NO: 1390 - DNA, 15 bp, Homo sapiens
cgcgcccgcgccccg

SEQ ID NO: 1391 - DNA, 15 bp, Homo sapiens
gcgcgcccgcgcccc

SEQ ID NO: 1392 - DNA, 15 bp, Homo sapiens
tgcgcgcccgcgccc

SEQ ID NO: 1393 - DNA, 15 bp, Homo sapiens
ctgcgcgcccgcgcc

SEQ ID NO: 1394 - DNA, 15 bp, Homo sapiens
cctgcgcgcccgcgc

SEQ ID NO: 1395 - DNA, 15 bp, Homo sapiens
acctgcgcgcccgcg

SEQ ID NO: 1396 - DNA, 15 bp, Homo sapiens
cacctgcgcgcccgc

SEQ ID NO: 1397 - DNA, 15 bp, Homo sapiens
gcacctgcgcgcccg

SEQ ID NO: 1398 - DNA, 15 bp, Homo sapiens
tgcacctgcgcgccc

SEQ ID NO: 1399 - DNA, 15 bp, Homo sapiens
ctgcacctgcgcgcc

SEQ ID NO: 1400 - DNA, 15 bp, Homo sapiens
gctgcacctgcgcgc

SEQ ID NO: 1401 - DNA, 15 bp, Homo sapiens
tgctgcacctgcgcg

SEQ ID NO: 1402 - DNA, 15 bp, Homo sapiens
ctgctgcacctgcgc

SEQ ID NO: 1403 - DNA, 15 bp, Homo sapiens
gctgctgcacctgcg

SEQ ID NO: 1404 - DNA, 15 bp, Homo sapiens
cgctgctgcacctgc

SEQ ID NO: 1405 - DNA, 15 bp, Homo sapiens
gcgctgctgcacctg

SEQ ID NO: 1406 - DNA, 15 bp, Homo sapiens
cgcgctgctgcacct

SEQ ID NO: 1407 - DNA, 15 bp, Homo sapiens
gcgcgctgctgcacc

SEQ ID NO: 1408 - DNA, 15 bp, Homo sapiens
cgcgcgctgctgcac

SEQ ID NO: 1409 - DNA, 15 bp, Homo sapiens
ccgcgcgctgctgca

SEQ ID NO: 1410 - DNA, 15 bp, Homo sapiens
cccgcgcgctgctgc

SEQ ID NO: 1411 - DNA, 15 bp, Homo sapiens
gcccgcgcgctgctg

SEQ ID NO: 1412 - DNA, 15 bp, Homo sapiens
ggcccgcgcgctgct

SEQ ID NO: 1413 - DNA, 15 bp, Homo sapiens
cggcccgcgcgctgc

SEQ ID NO: 1414 - DNA, 15 bp, Homo sapiens
ccggcccgcgcgctg

SEQ ID NO: 1415 - DNA, 15 bp, Homo sapiens
gccggcccgcgcgct

SEQ ID NO: 1416 - DNA, 15 bp, Homo sapiens
ggccggcccgcgcgc

SEQ ID NO: 1417 - DNA, 15 bp, Homo sapiens
tggccggcccgcgcg

SEQ ID NO: 1418 - DNA, 15 bp, Homo sapiens
ttggccggcccgcgc

SEQ ID NO: 1419 - DNA, 15 bp, Homo sapiens
cttggccggcccgcg

SEQ ID NO: 1420 - DNA, 15 bp, Homo sapiens
tcttggccggcccgc

SEQ ID NO: 1421 - DNA, 15 bp, Homo sapiens
ctcttggccggcccg

SEQ ID NO: 1422 - DNA, 15 bp, Homo sapiens
cctcttggccggccc

SEQ ID NO: 1423 - DNA, 15 bp, Homo sapiens
ccctcttggccggcc

SEQ ID NO: 1424 - DNA, 15 bp, Homo sapiens
gccctcttggccggc

SEQ ID NO: 1425 - DNA, 15 bp, Homo sapiens
cgccctcttggccgg

SEQ ID NO: 1426 - DNA, 15 bp, Homo sapiens
ccgccctcttggccg

SEQ ID NO: 1427 - DNA, 15 bp, Homo sapiens
cccgccctcttggcc

SEQ ID NO: 1428 - DNA, 15 bp, Homo sapiens
ccccgccctcttggc

SEQ ID NO: 1429 - DNA, 15 bp, Homo sapiens
gccccgccctcttgg

SEQ ID NO: 1430 - DNA, 15 bp, Homo sapiens
cgccccgccctcttg

SEQ ID NO: 1431 - DNA, 15 bp, Homo sapiens
gcgccccgccctctt

SEQ ID NO: 1432 - DNA, 15 bp, Homo sapiens
cgcgccccgccctct

SEQ ID NO: 1433 - DNA, 15 bp, Homo sapiens
tcgcgccccgccctc

SEQ ID NO: 1434 - DNA, 15 bp, Homo sapiens
gtcgcgccccgccct

SEQ ID NO: 1435 - DNA, 15 bp, Homo sapiens
cgtcgcgccccgccc

SEQ ID NO: 1436 - DNA, 15 bp, Homo sapiens
acgtcgcgccccgcc

SEQ ID NO: 1437 - DNA, 15 bp, Homo sapiens
gacgtcgcgccccgc

SEQ ID NO: 1438 - DNA, 15 bp, Homo sapiens
cgacgtcgcgccccg

SEQ ID NO: 1439 - DNA, 15 bp, Homo sapiens
ccgacgtcgcgcccc

SEQ ID NO: 1440 - DNA, 15 bp, Homo sapiens
gccgacgtcgcgccc

SEQ ID NO: 1441 - DNA, 15 bp, Homo sapiens
ggccgacgtcgcgcc

SEQ ID NO: 1442 - DNA, 15 bp, Homo sapiens
cggccgacgtcgcgc

SEQ ID NO: 1443 - DNA, 15 bp, Homo sapiens
acggccgacgtcgcg

SEQ ID NO: 1444 - DNA, 15 bp, Homo sapiens
cacggccgacgtcgc

SEQ ID NO: 1445 - DNA, 15 bp, Homo sapiens
gcacggccgacgtcg

SEQ ID NO: 1446 - DNA, 15 bp, Homo sapiens
cgcacggccgacgtc

SEQ ID NO: 1447 - DNA, 15 bp, Homo sapiens
ccgcacggccgacgt

SEQ ID NO: 1448 - DNA, 15 bp, Homo sapiens
cccgcacggccgacg

SEQ ID NO: 1449 - DNA, 15 bp, Homo sapiens
ccccgcacggccgac

SEQ ID NO: 1450 - DNA, 15 bp, Homo sapiens
accccgcacggccga

SEQ ID NO: 1451 - DNA, 15 bp, Homo sapiens
gaccccgcacggccg

SEQ ID NO: 1452 - DNA, 15 bp, Homo sapiens
ggaccccgcacggcc

SEQ ID NO: 1453 - DNA, 15 bp, Homo sapiens
gggaccccgcacggc

SEQ ID NO: 1454 - DNA, 15 bp, Homo sapiens
cgggaccccgcacgg

SEQ ID NO: 1455 - DNA, 15 bp, Homo sapiens
ccgggaccccgcacg

SEQ ID NO: 1456 - DNA, 15 bp, Homo sapiens
gccgggaccccgcac

SEQ ID NO: 1457 - DNA, 15 bp, Homo sapiens
cgccgggaccccgca

SEQ ID NO: 1458 - DNA, 15 bp, Homo sapiens
acgccgggaccccgc

SEQ ID NO: 1459 - DNA, 15 bp, Homo sapiens
gacgccgggaccccg

SEQ ID NO: 1460 - DNA, 15 bp, Homo sapiens
cgacgccgggacccc

SEQ ID NO: 1461 - DNA, 15 bp, Homo sapiens
ccgacgccgggaccc

SEQ ID NO: 1462 - DNA, 15 bp, Homo sapiens
gccgacgccgggacc

SEQ ID NO: 1463 - DNA, 15 bp, Homo sapiens
cgccgacgccgggac

SEQ ID NO: 1464 - DNA, 15 bp, Homo sapiens
ccgccgacgccggga

SEQ ID NO: 1465 - DNA, 15 bp, Homo sapiens
gccgccgacgccggg

SEQ ID NO: 1466 - DNA, 15 bp, Homo sapiens
cgccgccgacgccgg

SEQ ID NO: 1467 - DNA, 15 bp, Homo sapiens
gcgccgccgacgccg

SEQ ID NO: 1468 - DNA, 15 bp, Homo sapiens
cgcgccgccgacgcc

SEQ ID NO: 1469 - DNA, 15 bp, Homo sapiens
gcgcgccgccgacgc

SEQ ID NO: 1470 - DNA, 15 bp, Homo sapiens
cgcgcgccgccgacg

SEQ ID NO: 1471 - DNA, 15 bp, Homo sapiens
gcgcgcgccgccgac

SEQ ID NO: 1472 - DNA, 15 bp, Homo sapiens
cgcgcgcgccgccga

SEQ ID NO: 1473 - DNA, 15 bp, Homo sapiens
gcgcgcgcgccgccg

SEQ ID NO: 1474 - DNA, 15 bp, Homo sapiens
agcgcgcgcgccgcc

SEQ ID NO: 1475 - DNA, 15 bp, Homo sapiens
gagcgcgcgcgccgc

SEQ ID NO: 1476 - DNA, 15 bp, Homo sapiens
ggagcgcgcgcgccg

SEQ ID NO: 1477 - DNA, 15 bp, Homo sapiens
gggagcgcgcgcgcc

SEQ ID NO: 1478 - DNA, 15 bp, Homo sapiens
agggagcgcgcgcgc

SEQ ID NO: 1479 - DNA, 15 bp, Homo sapiens
gagggagcgcgcgcg

SEQ ID NO: 1480 - DNA, 15 bp, Homo sapiens
ggagggagcgcgcgc

SEQ ID NO: 1481 - DNA, 15 bp, Homo sapiens
aggagggagcgcgcg

SEQ ID NO: 1482 - DNA, 15 bp, Homo sapiens
gaggagggagcgcgc

SEQ ID NO: 1483 - DNA, 15 bp, Homo sapiens
agaggagggagcgcg

SEQ ID NO: 1484 - DNA, 15 bp, Homo sapiens
gagaggagggagcgc

SEQ ID NO: 1485 - DNA, 15 bp, Homo sapiens
cgagaggagggagcg

SEQ ID NO: 1486 - DNA, 15 bp, Homo sapiens
ccgagaggagggagc

SEQ ID NO: 1487 - DNA, 15 bp, Homo sapiens
tccgagaggagggag

SEQ ID NO: 1488 - DNA, 15 bp, Homo sapiens
ctccgagaggaggga

SEQ ID NO: 1489 - DNA, 15 bp, Homo sapiens
tctccgagaggaggg

SEQ ID NO: 1490 - DNA, 15 bp, Homo sapiens
ctctccgagaggagg

SEQ ID NO: 1491 - DNA, 15 bp, Homo sapiens
tctctccgagaggag

SEQ ID NO: 1492 - DNA, 15 bp, Homo sapiens
ctctctccgagagga

SEQ ID NO: 1493 - DNA, 15 bp, Homo sapiens
cctctctccgagagg

SEQ ID NO: 1494 - DNA, 15 bp, Homo sapiens
ccctctctccgagag

SEQ ID NO: 1495 - DNA, 15 bp, Homo sapiens
gccctctctccgaga

SEQ ID NO: 1496 - DNA, 15 bp, Homo sapiens
agccctctctccgag

SEQ ID NO: 1497 - DNA, 15 bp, Homo sapiens
cagccctctctccga

SEQ ID NO: 1498 - DNA, 15 bp, Homo sapiens
acagccctctctccg

SEQ ID NO: 1499 - DNA, 15 bp, Homo sapiens
cacagccctctctcc

SEQ ID NO: 1500 - DNA, 15 bp, Homo sapiens
ccacagccctctctc

SEQ ID NO: 1501 - DNA, 15 bp, Homo sapiens
accacagccctctct

SEQ ID NO: 1502 - DNA, 15 bp, Homo sapiens
taccacagccctctc

SEQ ID NO: 1503 - DNA, 15 bp, Homo sapiens
ttaccacagccctct

SEQ ID NO: 1504 - DNA, 15 bp, Homo sapiens
tttaccacagccctc

SEQ ID NO: 1505 - DNA, 15 bp, Homo sapiens
ttttaccacagccct

SEQ ID NO: 1506 - DNA, 15 bp, Homo sapiens
cttttaccacagccc

SEQ ID NO: 1507 - DNA, 15 bp, Homo sapiens
gcttttaccacagcc

SEQ ID NO: 1508 - DNA, 15 bp, Homo sapiens
ggcttttaccacagc

SEQ ID NO: 1509 - DNA, 15 bp, Homo sapiens
cggcttttaccacag

SEQ ID NO: 1510 - DNA, 15 bp, Homo sapiens
acggcttttaccaca

SEQ ID NO: 1511 - DNA, 15 bp, Homo sapiens
gacggcttttaccac

SEQ ID NO: 1512 - DNA, 15 bp, Homo sapiens
ggacggcttttacca

SEQ ID NO: 1513 - DNA, 15 bp, Homo sapiens
cggacggcttttacc

SEQ ID NO: 1514 - DNA, 15 bp, Homo sapiens
ccggacggcttttac

SEQ ID NO: 1515 - DNA, 15 bp, Homo sapiens
tccggacggctttta

SEQ ID NO: 1516 - DNA, 15 bp, Homo sapiens
ttccggacggctttt

SEQ ID NO: 1517 - DNA, 15 bp, Homo sapiens
tttccggacggcttt

SEQ ID NO: 1518 - DNA, 15 bp, Homo sapiens
ttttccggacggctt

SEQ ID NO: 1519 - DNA, 15 bp, Homo sapiens
attttccggacggct

SEQ ID NO: 1520 - DNA, 15 bp, Homo sapiens
cattttccggacggc

SEQ ID NO: 1521 - DNA, 15 bp, Homo sapiens
ccattttccggacgg

SEQ ID NO: 1522 - DNA, 15 bp, Homo sapiens
gccattttccggacg

SEQ ID NO: 1523 - DNA, 15 bp, Homo sapiens
ggccattttccggac

SEQ ID NO: 1524 - DNA, 15 bp, Homo sapiens
cggccattttccgga

SEQ ID NO: 1525 - DNA, 15 bp, Homo sapiens
gcggccattttccgg

SEQ ID NO: 1526 - DNA, 15 bp, Homo sapiens
ggcggccattttccg

SEQ ID NO: 1527 - DNA, 15 bp, Homo sapiens
cggcggccattttcc

SEQ ID NO: 1528 - DNA, 15 bp, Homo sapiens
gcggcggccattttc

SEQ ID NO: 1529 - DNA, 15 bp, Homo sapiens
ggcggcggccatttt

SEQ ID NO: 1530 - DNA, 15 bp, Homo sapiens
cggcggcggccattt

SEQ ID NO: 1531 - DNA, 15 bp, Homo sapiens
gcggcggcggccatt

SEQ ID NO: 1532 - DNA, 15 bp, Homo sapiens
ggcggcggcggccat

SEQ ID NO: 1533 - DNA, 15 bp, Homo sapiens
cggcggcggcggcca

SEQ ID NO: 1534 - DNA, 15 bp, Homo sapiens
gcggcggcggcggcc

SEQ ID NO: 1535 - DNA, 15 bp, Homo sapiens
ggcggcggcggcggc

SEQ ID NO: 1536 - DNA, 15 bp, Homo sapiens
cggcggcggcggcgg

SEQ ID NO: 1537 - DNA, 15 bp, Homo sapiens
gcggcggcggcggcg

SEQ ID NO: 1538 - DNA, 15 bp, Homo sapiens
cgcggcggcggcggc

SEQ ID NO: 1539 - DNA, 15 bp, Homo sapiens
gcgcggcggcggcgg

SEQ ID NO: 1540 - DNA, 15 bp, Homo sapiens
ggcgcggcggcggcg

SEQ ID NO: 1541 - DNA, 15 bp, Homo sapiens
cggcgcggcggcggc

SEQ ID NO: 1542 - DNA, 15 bp, Homo sapiens
tcggcgcggcggcgg

SEQ ID NO: 1543 - DNA, 15 bp, Homo sapiens
ctcggcgcggcggcg

SEQ ID NO: 1544 - DNA, 15 bp, Homo sapiens
gctcggcgcggcggc

SEQ ID NO: 1545 - DNA, 15 bp, Homo sapiens
cgctcggcgcggcgg

SEQ ID NO: 1546 - DNA, 15 bp, Homo sapiens
ccgctcggcgcggcg

SEQ ID NO: 1547 - DNA, 15 bp, Homo sapiens
tccgctcggcgcggc

SEQ ID NO: 1548 - DNA, 15 bp, Homo sapiens
ctccgctcggcgcgg

SEQ ID NO: 1549 - DNA, 15 bp, Homo sapiens
cctccgctcggcgcg

SEQ ID NO: 1550 - DNA, 15 bp, Homo sapiens
tcctccgctcggcgc

SEQ ID NO: 1551 - DNA, 15 bp, Homo sapiens
ctcctccgctcggcg

SEQ ID NO: 1552 - DNA, 15 bp, Homo sapiens
cctcctccgctcggc

SEQ ID NO: 1553 - DNA, 15 bp, Homo sapiens
tcctcctccgctcgg

SEQ ID NO: 1554 - DNA, 15 bp, Homo sapiens
ctcctcctccgctcg

SEQ ID NO: 1555 - DNA, 15 bp, Homo sapiens
cctcctcctccgctc

SEQ ID NO: 1556 - DNA, 15 bp, Homo sapiens
tcctcctcctccgct

SEQ ID NO: 1557 - DNA, 15 bp, Homo sapiens
ctcctcctcctccgc

SEQ ID NO: 1558 - DNA, 15 bp, Homo sapiens
cctcctcctcctccg

SEQ ID NO: 1559 - DNA, 15 bp, Homo sapiens
tcctcctcctcctcc

SEQ ID NO: 1560 - DNA, 15 bp, Homo sapiens
ctcctcctcctcctc

SEQ ID NO: 1561 - DNA, 15 bp, Homo sapiens
cctcctcctcctcct

SEQ ID NO: 1562 - DNA, 15 bp, Homo sapiens
gcctcctcctcctcc

SEQ ID NO: 1563 - DNA, 15 bp, Homo sapiens
cgcctcctcctcctc

SEQ ID NO: 1564 - DNA, 15 bp, Homo sapiens
tcgcctcctcctcct

SEQ ID NO: 1565 - DNA, 15 bp, Homo sapiens
ctcgcctcctcctcc

SEQ ID NO: 1566 - DNA, 15 bp, Homo sapiens
cctcgcctcctcctc

SEQ ID NO: 1567 - DNA, 15 bp, Homo sapiens
tcctcgcctcctcct

SEQ ID NO: 1568 - DNA, 15 bp, Homo sapiens
ctcctcgcctcctcc

SEQ ID NO: 1569 - DNA, 15 bp, Homo sapiens
cctcctcgcctcctc

SEQ ID NO: 1570 - DNA, 15 bp, Homo sapiens
tcctcctcgcctcct

SEQ ID NO: 1571 - DNA, 15 bp, Homo sapiens
ctcctcctcgcctcc

SEQ ID NO: 1572 - DNA, 15 bp, Homo sapiens
tctcctcctcgcctc

SEQ ID NO: 1573 - DNA, 15 bp, Homo sapiens
ctctcctcctcgcct

SEQ ID NO: 1574 - DNA, 15 bp, Homo sapiens
tctctcctcctcgcc

SEQ ID NO: 1575 - DNA, 15 bp, Homo sapiens
gtctctcctcctcgc

SEQ ID NO: 1576 - DNA, 15 bp, Homo sapiens
agtctctcctcctcg

SEQ ID NO: 1577 - DNA, 15 bp, Homo sapiens
cagtctctcctcctc

SEQ ID NO: 1578 - DNA, 15 bp, Homo sapiens
acagtctctcctcct

SEQ ID NO: 1579 - DNA, 15 bp, Homo sapiens
cacagtctctcctcc

SEQ ID NO: 1580 - DNA, 15 bp, Homo sapiens
tcacagtctctcctc

SEQ ID NO: 1581 - DNA, 15 bp, Homo sapiens
ctcacagtctctcct

SEQ ID NO: 1582 - DNA, 15 bp, Homo sapiens
actcacagtctctcc

SEQ ID NO: 1583 - DNA, 15 bp, Homo sapiens
cactcacagtctctc

SEQ ID NO: 1584 - DNA, 15 bp, Homo sapiens
ccactcacagtctct

SEQ ID NO: 1585 - DNA, 15 bp, Homo sapiens
cccactcacagtctc

SEQ ID NO: 1586 - DNA, 15 bp, Homo sapiens
tcccactcacagtct

SEQ ID NO: 1587 - DNA, 15 bp, Homo sapiens
gtcccactcacagtc

SEQ ID NO: 1588 - DNA, 15 bp, Homo sapiens
ggtcccactcacagt

SEQ ID NO: 1589 - DNA, 15 bp, Homo sapiens
cggtcccactcacag

SEQ ID NO: 1590 - DNA, 15 bp, Homo sapiens
gcggtcccactcaca

SEQ ID NO: 1591 - DNA, 15 bp, Homo sapiens
ggcggtcccactcac

SEQ ID NO: 1592 - DNA, 15 bp, Homo sapiens
cggcggtcccactca

SEQ ID NO: 1593 - DNA, 15 bp, Homo sapiens
acggcggtcccactc

SEQ ID NO: 1594 - DNA, 15 bp, Homo sapiens
cacggcggtcccact

SEQ ID NO: 1595 - DNA, 15 bp, Homo sapiens
ccacggcggtcccac

SEQ ID NO: 1596 - DNA, 15 bp, Homo sapiens
gccacggcggtccca

SEQ ID NO: 1597 - DNA, 15 bp, Homo sapiens
ggccacggcggtccc

SEQ ID NO: 1598 - DNA, 15 bp, Homo sapiens
cggccacggcggtcc

SEQ ID NO: 1599 - DNA, 15 bp, Homo sapiens
gcggccacggcggtc

SEQ ID NO: 1600 - DNA, 15 bp, Homo sapiens
cgcggccacggcggt

SEQ ID NO: 1601 - DNA, 15 bp, Homo sapiens
ccgcggccacggcgg

SEQ ID NO: 1602 - DNA, 15 bp, Homo sapiens
cccgcggccacggcg

SEQ ID NO: 1603 - DNA, 15 bp, Homo sapiens
gcccgcggccacggc

SEQ ID NO: 1604 - DNA, 15 bp, Homo sapiens
cgcccgcggccacgg

SEQ ID NO: 1605 - DNA, 15 bp, Homo sapiens
ccgcccgcggccacg

SEQ ID NO: 1606 - DNA, 15 bp, Homo sapiens
cccgcccgcggccac

SEQ ID NO: 1607 - DNA, 15 bp, Homo sapiens
ccccgcccgcggcca

SEQ ID NO: 1608 - DNA, 15 bp, Homo sapiens
tccccgcccgcggcc

SEQ ID NO: 1609 - DNA, 15 bp, Homo sapiens
gtccccgcccgcggc

SEQ ID NO: 1610 - DNA, 15 bp, Homo sapiens
ggtccccgcccgcgg

SEQ ID NO: 1611 - DNA, 15 bp, Homo sapiens
gggtccccgcccgcg

SEQ ID NO: 1612 - DNA, 15 bp, Homo sapiens
agggtccccgcccgc

SEQ ID NO: 1613 - DNA, 15 bp, Homo sapiens
aagggtccccgcccg

SEQ ID NO: 1614 - DNA, 15 bp, Homo sapiens
caagggtccccgccc

SEQ ID NO: 1615 - DNA, 15 bp, Homo sapiens
gcaagggtccccgcc

SEQ ID NO: 1616 - DNA, 15 bp, Homo sapiens
ggcaagggtccccgc

SEQ ID NO: 1617 - DNA, 15 bp, Homo sapiens
cggcaagggtccccg

SEQ ID NO: 1618 - DNA, 15 bp, Homo sapiens
ccggcaagggtcccc

SEQ ID NO: 1619 - DNA, 15 bp, Homo sapiens
cccggcaagggtccc

SEQ ID NO: 1620 - DNA, 15 bp, Homo sapiens
ccccggcaagggtcc

SEQ ID NO: 1621 - DNA, 15 bp, Homo sapiens
cccccggcaagggtc

SEQ ID NO: 1622 - DNA, 15 bp, Homo sapiens
ccccccggcaagggt

SEQ ID NO: 1623 - DNA, 15 bp, Homo sapiens
gccccccggcaaggg

SEQ ID NO: 1624 - DNA, 15 bp, Homo sapiens
cgccccccggcaagg

SEQ ID NO: 1625 - DNA, 15 bp, Homo sapiens
ccgccccccggcaag

SEQ ID NO: 1626 - DNA, 15 bp, Homo sapiens
cccgccccccggcaa

SEQ ID NO: 1627 - DNA, 15 bp, Homo sapiens
ccccgccccccggca

SEQ ID NO: 1628 - DNA, 15 bp, Homo sapiens
cccccgccccccggc

SEQ ID NO: 1629 - DNA, 15 bp, Homo sapiens
acccccgccccccgg

SEQ ID NO: 1630 - DNA, 15 bp, Homo sapiens
gacccccgccccccg

SEQ ID NO: 1631 - DNA, 15 bp, Homo sapiens
tgacccccgcccccc

SEQ ID NO: 1632 - DNA, 15 bp, Homo sapiens
ctgacccccgccccc

SEQ ID NO: 1633 - DNA, 15 bp, Homo sapiens
cctgacccccgcccc

SEQ ID NO: 1634 - DNA, 15 bp, Homo sapiens
ccctgacccccgccc

SEQ ID NO: 1635 - DNA, 15 bp, Homo sapiens
cccctgacccccgcc

SEQ ID NO: 1636 - DNA, 15 bp, Homo sapiens
gcccctgacccccgc

SEQ ID NO: 1637 - DNA, 15 bp, Homo sapiens
cgcccctgacccccg

SEQ ID NO: 1638 - DNA, 15 bp, Homo sapiens
ccgcccctgaccccc

SEQ ID NO: 1639 - DNA, 15 bp, Homo sapiens
cccgcccctgacccc

SEQ ID NO: 1640 - DNA, 15 bp, Homo sapiens
tcccgcccctgaccc

SEQ ID NO: 1641 - DNA, 15 bp, Homo sapiens
gtcccgcccctgacc

SEQ ID NO: 1642 - DNA, 15 bp, Homo sapiens
cgtcccgcccctgac

SEQ ID NO: 1643 - DNA, 15 bp, Homo sapiens
acgtcccgcccctga

SEQ ID NO: 1644 - DNA, 15 bp, Homo sapiens
cacgtcccgcccctg

SEQ ID NO: 1645 - DNA, 15 bp, Homo sapiens
ccacgtcccgcccct

SEQ ID NO: 1646 - DNA, 15 bp, Homo sapiens
gccacgtcccgcccc

SEQ ID NO: 1647 - DNA, 15 bp, Homo sapiens
cgccacgtcccgccc

SEQ ID NO: 1648 - DNA, 15 bp, Homo sapiens
gcgccacgtcccgcc

SEQ ID NO: 1649 - DNA, 15 bp, Homo sapiens
cgcgccacgtcccgc

SEQ ID NO: 1650 - DNA, 15 bp, Homo sapiens
ccgcgccacgtcccg

SEQ ID NO: 1651 - DNA, 15 bp, Homo sapiens
cccgcgccacgtccc

SEQ ID NO: 1652 - DNA, 15 bp, Homo sapiens
tcccgcgccacgtcc

SEQ ID NO: 1653 - DNA, 15 bp, Homo sapiens
ctcccgcgccacgtc

SEQ ID NO: 1654 - DNA, 15 bp, Homo sapiens
cctcccgcgccacgt

SEQ ID NO: 1655 - DNA, 15 bp, Homo sapiens
ccctcccgcgccacg

SEQ ID NO: 1656 - DNA, 15 bp, Homo sapiens
cccctcccgcgccac

SEQ ID NO: 1657 - DNA, 15 bp, Homo sapiens
gcccctcccgcgcca

SEQ ID NO: 1658 - DNA, 15 bp, Homo sapiens
ggcccctcccgcgcc

SEQ ID NO: 1659 - DNA, 15 bp, Homo sapiens
gggcccctcccgcgc

SEQ ID NO: 1660 - DNA, 15 bp, Homo sapiens
cgggcccctcccgcg

SEQ ID NO: 1661 - DNA, 15 bp, Homo sapiens
gcgggcccctcccgc

SEQ ID NO: 1662 - DNA, 15 bp, Homo sapiens
cgcgggcccctcccg

SEQ ID NO: 1663 - DNA, 15 bp, Homo sapiens
ccgcgggcccctccc

SEQ ID NO: 1664 - DNA, 15 bp, Homo sapiens
cccgcgggcccctcc

SEQ ID NO: 1665 - DNA, 15 bp, Homo sapiens
ccccgcgggcccctc

SEQ ID NO: 1666 - DNA, 15 bp, Homo sapiens
accccgcgggcccct

SEQ ID NO: 1667 - DNA, 15 bp, Homo sapiens
gaccccgcgggcccc

SEQ ID NO: 1668 - DNA, 15 bp, Homo sapiens
cgaccccgcgggccc

SEQ ID NO: 1669 - DNA, 15 bp, Homo sapiens
ccgaccccgcgggcc

SEQ ID NO: 1670 - DNA, 15 bp, Homo sapiens
tccgaccccgcgggc

SEQ ID NO: 1671 - DNA, 15 bp, Homo sapiens
gtccgaccccgcggg

SEQ ID NO: 1672 - DNA, 15 bp, Homo sapiens
cgtccgaccccgcgg

SEQ ID NO: 1673 - DNA, 15 bp, Homo sapiens
tcgtccgaccccgcg

SEQ ID NO: 1674 - DNA, 15 bp, Homo sapiens
gtcgtccgaccccgc

SEQ ID NO: 1675 - DNA, 15 bp, Homo sapiens
tgtcgtccgaccccg

SEQ ID NO: 1676 - DNA, 15 bp, Homo sapiens
gtgtcgtccgacccc

SEQ ID NO: 1677 - DNA, 15 bp, Homo sapiens
cgtgtcgtccgaccc

SEQ ID NO: 1678 - DNA, 15 bp, Homo sapiens
ccgtgtcgtccgacc

SEQ ID NO: 1679 - DNA, 15 bp, Homo sapiens
gccgtgtcgtccgac

SEQ ID NO: 1680 - DNA, 15 bp, Homo sapiens
agccgtgtcgtccga

SEQ ID NO: 1681 - DNA, 15 bp, Homo sapiens
cagccgtgtcgtccg

SEQ ID NO: 1682 - DNA, 15 bp, Homo sapiens
ccagccgtgtcgtcc

SEQ ID NO: 1683 - DNA, 15 bp, Homo sapiens
gccagccgtgtcgtc

SEQ ID NO: 1684 - DNA, 15 bp, Homo sapiens
cgccagccgtgtcgt

SEQ ID NO: 1685 - DNA, 15 bp, Homo sapiens
ccgccagccgtgtcg

SEQ ID NO: 1686 - DNA, 15 bp, Homo sapiens
tccgccagccgtgtc

SEQ ID NO: 1687 - DNA, 15 bp, Homo sapiens
atccgccagccgtgt

SEQ ID NO: 1688 - DNA, 15 bp, Homo sapiens
catccgccagccgtg

SEQ ID NO: 1689 - DNA, 15 bp, Homo sapiens
ccatccgccagccgt

SEQ ID NO: 1690 - DNA, 15 bp, Homo sapiens
gccatccgccagccg

SEQ ID NO: 1691 - DNA, 15 bp, Homo sapiens
cgccatccgccagcc

SEQ ID NO: 1692 - DNA, 15 bp, Homo sapiens
acgccatccgccagc

SEQ ID NO: 1693 - DNA, 15 bp, Homo sapiens
gacgccatccgccag

SEQ ID NO: 1694 - DNA, 15 bp, Homo sapiens
ggacgccatccgcca

SEQ ID NO: 1695 - DNA, 15 bp, Homo sapiens
gggacgccatccgcc

SEQ ID NO: 1696 - DNA, 15 bp, Homo sapiens
agggacgccatccgc

SEQ ID NO: 1697 - DNA, 15 bp, Homo sapiens
gagggacgccatccg

SEQ ID NO: 1698 - DNA, 15 bp, Homo sapiens
ggagggacgccatcc

SEQ ID NO: 1699 - DNA, 15 bp, Homo sapiens
aggagggacgccatc

SEQ ID NO: 1700 - DNA, 15 bp, Homo sapiens
gaggagggacgccat

SEQ ID NO: 1701 - DNA, 15 bp, Homo sapiens
agaggagggacgcca

SEQ ID NO: 1702 - DNA, 15 bp, Homo sapiens
gagaggagggacgcc

SEQ ID NO: 1703 - DNA, 15 bp, Homo sapiens
agagaggagggacgc

SEQ ID NO: 1704 - DNA, 15 bp, Homo sapiens
tagagaggagggacg

SEQ ID NO: 1705 - DNA, 15 bp, Homo sapiens
gtagagaggagggac

SEQ ID NO: 1706 - DNA, 15 bp, Homo sapiens
ggtagagaggaggga

SEQ ID NO: 1707 - DNA, 15 bp, Homo sapiens
gggtagagaggaggg

SEQ ID NO: 1708 - DNA, 15 bp, Homo sapiens
agggtagagaggagg

SEQ ID NO: 1709 - DNA, 15 bp, Homo sapiens
gagggtagagaggag

SEQ ID NO: 1710 - DNA, 15 bp, Homo sapiens
ggagggtagagagga

SEQ ID NO: 1711 - DNA, 15 bp, Homo sapiens
gggagggtagagagg

SEQ ID NO: 1712 - DNA, 15 bp, Homo sapiens
ggggagggtagagag

SEQ ID NO: 1713 - DNA, 15 bp, Homo sapiens
gggggagggtagaga

SEQ ID NO: 1714 - DNA, 15 bp, Homo sapiens
agggggagggtagag

SEQ ID NO: 1715 - DNA, 15 bp, Homo sapiens
gagggggagggtaga

SEQ ID NO: 1716 - DNA, 15 bp, Homo sapiens
ggagggggagggtag

SEQ ID NO: 1717 - DNA, 15 bp, Homo sapiens
gggagggggagggta

SEQ ID NO: 1718 - DNA, 15 bp, Homo sapiens
cgggagggggagggt

SEQ ID NO: 1719 - DNA, 15 bp, Homo sapiens
gcgggagggggaggg

SEQ ID NO: 1720 - DNA, 15 bp, Homo sapiens
ggcgggagggggagg

SEQ ID NO: 1721 - DNA, 15 bp, Homo sapiens
cggcgggagggggag

SEQ ID NO: 1722 - DNA, 15 bp, Homo sapiens
gcggcgggaggggga

SEQ ID NO: 1723 - DNA, 15 bp, Homo sapiens
ggcggcgggaggggg

SEQ ID NO: 1724 - DNA, 15 bp, Homo sapiens
cggcggcgggagggg

SEQ ID NO: 1725 - DNA, 15 bp, Homo sapiens
gcggcggcgggaggg

SEQ ID NO: 1726 - DNA, 15 bp, Homo sapiens
ggcggcggcgggagg

SEQ ID NO: 1727 - DNA, 15 bp, Homo sapiens
cggcggcggcgggag

SEQ ID NO: 1728 - DNA, 15 bp, Homo sapiens
ccggcggcggcggga

SEQ ID NO: 1729 - DNA, 15 bp, Homo sapiens
accggcggcggcggg

SEQ ID NO: 1730 - DNA, 15 bp, Homo sapiens
caccggcggcggcgg

SEQ ID NO: 1731 - DNA, 15 bp, Homo sapiens
ccaccggcggcggcg

SEQ ID NO: 1732 - DNA, 15 bp, Homo sapiens
gccaccggcggcggc

SEQ ID NO: 1733 - DNA, 15 bp, Homo sapiens
cgccaccggcggcgg

SEQ ID NO: 1734 - DNA, 15 bp, Homo sapiens
tcgccaccggcggcg

SEQ ID NO: 1735 - DNA, 15 bp, Homo sapiens
gtcgccaccggcggc

SEQ ID NO: 1736 - DNA, 15 bp, Homo sapiens
agtcgccaccggcgg

SEQ ID NO: 1737 - DNA, 15 bp, Homo sapiens
gagtcgccaccggcg

SEQ ID NO: 1738 - DNA, 15 bp, Homo sapiens
agagtcgccaccggc

SEQ ID NO: 1739 - DNA, 15 bp, Homo sapiens
gagagtcgccaccgg

SEQ ID NO: 1740 - DNA, 15 bp, Homo sapiens
ggagagtcgccaccg

SEQ ID NO: 1741 - DNA, 15 bp, Homo sapiens
gggagagtcgccacc

SEQ ID NO: 1742 - DNA, 15 bp, Homo sapiens
ggggagagtcgccac

SEQ ID NO: 1743 - DNA, 15 bp, Homo sapiens
aggggagagtcgcca

SEQ ID NO: 1744 - DNA, 15 bp, Homo sapiens
gaggggagagtcgcc

SEQ ID NO: 1745 - DNA, 15 bp, Homo sapiens
cgaggggagagtcgc

SEQ ID NO: 1746 - DNA, 15 bp, Homo sapiens
ccgaggggagagtcg

SEQ ID NO: 1747 - DNA, 15 bp, Homo sapiens
gccgaggggagagtc

SEQ ID NO: 1748 - DNA, 15 bp, Homo sapiens
ggccgaggggagagt

SEQ ID NO: 1749 - DNA, 15 bp, Homo sapiens
gggccgaggggagag

SEQ ID NO: 1750 - DNA, 15 bp, Homo sapiens
cgggccgaggggaga

SEQ ID NO: 1751 - DNA, 15 bp, Homo sapiens
acgggccgaggggag

SEQ ID NO: 1752 - DNA, 15 bp, Homo sapiens
gacgggccgagggga

SEQ ID NO: 1753 - DNA, 15 bp, Homo sapiens
tgacgggccgagggg

SEQ ID NO: 1754 - DNA, 15 bp, Homo sapiens
gtgacgggccgaggg

SEQ ID NO: 1755 - DNA, 15 bp, Homo sapiens
ggtgacgggccgagg

SEQ ID NO: 1756 - DNA, 15 bp, Homo sapiens
gggtgacgggccgag

SEQ ID NO: 1757 - DNA, 15 bp, Homo sapiens
cgggtgacgggccga

SEQ ID NO: 1758 - DNA, 15 bp, Homo sapiens
acgggtgacgggccg

SEQ ID NO: 1759 - DNA, 15 bp, Homo sapiens
cacgggtgacgggcc

SEQ ID NO: 1760 - DNA, 15 bp, Homo sapiens
gcacgggtgacgggc

SEQ ID NO: 1761 - DNA, 15 bp, Homo sapiens
agcacgggtgacggg

SEQ ID NO: 1762 - DNA, 15 bp, Homo sapiens
gagcacgggtgacgg

SEQ ID NO: 1763 - DNA, 15 bp, Homo sapiens
cgagcacgggtgacg

SEQ ID NO: 1764 - DNA, 15 bp, Homo sapiens
gcgagcacgggtgac

SEQ ID NO: 1765 - DNA, 15 bp, Homo sapiens
cgcgagcacgggtga

SEQ ID NO: 1766 - DNA, 15 bp, Homo sapiens
ccgcgagcacgggtg

SEQ ID NO: 1767 - DNA, 15 bp, Homo sapiens
cccgcgagcacgggt

SEQ ID NO: 1768 - DNA, 15 bp, Homo sapiens
acccgcgagcacggg

SEQ ID NO: 1769 - DNA, 15 bp, Homo sapiens
cacccgcgagcacgg

SEQ ID NO: 1770 - DNA, 15 bp, Homo sapiens
tcacccgcgagcacg

SEQ ID NO: 1771 - DNA, 15 bp, Homo sapiens
gtcacccgcgagcac

SEQ ID NO: 1772 - DNA, 15 bp, Homo sapiens
ggtcacccgcgagca

SEQ ID NO: 1773 - DNA, 15 bp, Homo sapiens
cggtcacccgcgagc

SEQ ID NO: 1774 - DNA, 15 bp, Homo sapiens
acggtcacccgcgag

SEQ ID NO: 1775 - DNA, 15 bp, Homo sapiens
gacggtcacccgcga

SEQ ID NO: 1776 - DNA, 15 bp, Homo sapiens
ggacggtcacccgcg

SEQ ID NO: 1777 - DNA, 15 bp, Homo sapiens
aggacggtcacccgc

SEQ ID NO: 1778 - DNA, 15 bp, Homo sapiens
gaggacggtcacccg

SEQ ID NO: 1779 - DNA, 15 bp, Homo sapiens
cgaggacggtcaccc

SEQ ID NO: 1780 - DNA, 15 bp, Homo sapiens
ccgaggacggtcacc

SEQ ID NO: 1781 - DNA, 15 bp, Homo sapiens
gccgaggacggtcac

SEQ ID NO: 1782 - DNA, 15 bp, Homo sapiens
cgccgaggacggtca

SEQ ID NO: 1783 - DNA, 15 bp, Homo sapiens
gcgccgaggacggtc

SEQ ID NO: 1784 - DNA, 15 bp, Homo sapiens
cgcgccgaggacggt

SEQ ID NO: 1785 - DNA, 15 bp, Homo sapiens
ccgcgccgaggacgg

SEQ ID NO: 1786 - DNA, 15 bp, Homo sapiens
gccgcgccgaggacg

SEQ ID NO: 1787 - DNA, 15 bp, Homo sapiens
ggccgcgccgaggac

SEQ ID NO: 1788 - DNA, 15 bp, Homo sapiens
aggccgcgccgagga

SEQ ID NO: 1789 - DNA, 15 bp, Homo sapiens
gaggccgcgccgagg

SEQ ID NO: 1790 - DNA, 15 bp, Homo sapiens
ggaggccgcgccgag

SEQ ID NO: 1791 - DNA, 15 bp, Homo sapiens
gggaggccgcgccga

SEQ ID NO: 1792 - DNA, 15 bp, Homo sapiens
agggaggccgcgccg

SEQ ID NO: 1793 - DNA, 15 bp, Homo sapiens
cagggaggccgcgcc

SEQ ID NO: 1794 - DNA, 15 bp, Homo sapiens
ccagggaggccgcgc

SEQ ID NO: 1795 - DNA, 15 bp, Homo sapiens
tccagggaggccgcg

SEQ ID NO: 1796 - DNA, 15 bp, Homo sapiens
ctccagggaggccgc

SEQ ID NO: 1797 - DNA, 15 bp, Homo sapiens
gctccagggaggccg

SEQ ID NO: 1798 - DNA, 15 bp, Homo sapiens
ggctccagggaggcc

SEQ ID NO: 1799 - DNA, 15 bp, Homo sapiens
cggctccagggaggc

SEQ ID NO: 1800 - DNA, 15 bp, Homo sapiens
gcggctccagggagg

SEQ ID NO: 1801 - DNA, 15 bp, Homo sapiens
ggcggctccagggag

SEQ ID NO: 1802 - DNA, 15 bp, Homo sapiens
aggcggctccaggga

SEQ ID NO: 1803 - DNA, 15 bp, Homo sapiens
aaggcggctccaggg

SEQ ID NO: 1804 - DNA, 15 bp, Homo sapiens
gaaggcggctccagg

SEQ ID NO: 1805 - DNA, 15 bp, Homo sapiens
cgaaggcggctccag

SEQ ID NO: 1806 - DNA, 15 bp, Homo sapiens
gcgaaggcggctcca

SEQ ID NO: 1807 - DNA, 15 bp, Homo sapiens
ggcgaaggcggctcc

SEQ ID NO: 1808 - DNA, 15 bp, Homo sapiens
aggcgaaggcggctc

SEQ ID NO: 1809 - DNA, 15 bp, Homo sapiens
caggcgaaggcggct

SEQ ID NO: 1810 - DNA, 15 bp, Homo sapiens
tcaggcgaaggcggc

SEQ ID NO: 1811 - DNA, 15 bp, Homo sapiens
gtcaggcgaaggcgg

SEQ ID NO: 1812 - DNA, 15 bp, Homo sapiens
cgtcaggcgaaggcg

SEQ ID NO: 1813 - DNA, 15 bp, Homo sapiens
gcgtcaggcgaaggc

SEQ ID NO: 1814 - DNA, 15 bp, Homo sapiens
ggcgtcaggcgaagg

SEQ ID NO: 1815 - DNA, 15 bp, Homo sapiens
gggcgtcaggcgaag

SEQ ID NO: 1816 - DNA, 15 bp, Homo sapiens
ggggcgtcaggcgaa

SEQ ID NO: 1817 - DNA, 15 bp, Homo sapiens
aggggcgtcaggcga

SEQ ID NO: 1818 - DNA, 15 bp, Homo sapiens
gaggggcgtcaggcg

SEQ ID NO: 1819 - DNA, 15 bp, Homo sapiens
agaggggcgtcaggc

SEQ ID NO: 1820 - DNA, 15 bp, Homo sapiens
aagaggggcgtcagg

SEQ ID NO: 1821 - DNA, 15 bp, Homo sapiens
gaagaggggcgtcag

SEQ ID NO: 1822 - DNA, 15 bp, Homo sapiens
ggaagaggggcgtca

SEQ ID NO: 1823 - DNA, 15 bp, Homo sapiens
aggaagaggggcgtc

SEQ ID NO: 1824 - DNA, 15 bp, Homo sapiens
gaggaagaggggcgt

SEQ ID NO: 1825 - DNA, 15 bp, Homo sapiens
ggaggaagaggggcg

SEQ ID NO: 1826 - DNA, 15 bp, Homo sapiens
gggaggaagaggggc

SEQ ID NO: 1827 - DNA, 15 bp, Homo sapiens
cgggaggaagagggg

SEQ ID NO: 1828 - DNA, 15 bp, Homo sapiens
gcgggaggaagaggg

SEQ ID NO: 1829 - DNA, 15 bp, Homo sapiens
ggcgggaggaagagg

SEQ ID NO: 1830 - DNA, 15 bp, Homo sapiens
gggcgggaggaagag

SEQ ID NO: 1831 - DNA, 15 bp, Homo sapiens
agggcgggaggaaga

SEQ ID NO: 1832 - DNA, 15 bp, Homo sapiens
gagggcgggaggaag

SEQ ID NO: 1833 - DNA, 15 bp, Homo sapiens
cgagggcgggaggaa

SEQ ID NO: 1834 - DNA, 15 bp, Homo sapiens
tcgagggcgggagga

SEQ ID NO: 1835 - DNA, 15 bp, Homo sapiens
gtcgagggcgggagg

SEQ ID NO: 1836 - DNA, 15 bp, Homo sapiens
cgtcgagggcgggag

SEQ ID NO: 1837 - DNA, 15 bp, Homo sapiens
gcgtcgagggcggga

SEQ ID NO: 1838 - DNA, 15 bp, Homo sapiens
cgcgtcgagggcggg

SEQ ID NO: 1839 - DNA, 15 bp, Homo sapiens
gcgcgtcgagggcgg

SEQ ID NO: 1840 - DNA, 15 bp, Homo sapiens
tgcgcgtcgagggcg

SEQ ID NO: 1841 - DNA, 15 bp, Homo sapiens
atgcgcgtcgagggc

SEQ ID NO: 1842 - DNA, 15 bp, Homo sapiens
gatgcgcgtcgaggg

SEQ ID NO: 1843 - DNA, 15 bp, Homo sapiens
ggatgcgcgtcgagg

SEQ ID NO: 1844 - DNA, 15 bp, Homo sapiens
gggatgcgcgtcgag

SEQ ID NO: 1845 - DNA, 15 bp, Homo sapiens
cgggatgcgcgtcga

SEQ ID NO: 1846 - DNA, 15 bp, Homo sapiens
ccgggatgcgcgtcg

SEQ ID NO: 1847 - DNA, 15 bp, Homo sapiens
gccgggatgcgcgtc

SEQ ID NO: 1848 - DNA, 15 bp, Homo sapiens
ggccgggatgcgcgt

SEQ ID NO: 1849 - DNA, 15 bp, Homo sapiens
gggccgggatgcgcg

SEQ ID NO: 1850 - DNA, 15 bp, Homo sapiens
ggggccgggatgcgc

SEQ ID NO: 1851 - DNA, 15 bp, Homo sapiens
gggggccgggatgcg

SEQ ID NO: 1852 - DNA, 15 bp, Homo sapiens
cgggggccgggatgc

SEQ ID NO: 1853 - DNA, 15 bp, Homo sapiens
ccgggggccgggatg

SEQ ID NO: 1854 - DNA, 15 bp, Homo sapiens
gccgggggccgggat

SEQ ID NO: 1855 - DNA, 15 bp, Homo sapiens
ggccgggggccggga

SEQ ID NO: 1856 - DNA, 15 bp, Homo sapiens
gggccgggggccggg

SEQ ID NO: 1857 - DNA, 15 bp, Homo sapiens
ggggccgggggccgg

SEQ ID NO: 1858 - DNA, 15 bp, Homo sapiens
cggggccgggggccg

SEQ ID NO: 1859 - DNA, 15 bp, Homo sapiens
gcggggccgggggcc

SEQ ID NO: 1860 - DNA, 15 bp, Homo sapiens
cgcggggccgggggc

SEQ ID NO: 1861 - DNA, 15 bp, Homo sapiens
ccgcggggccggggg

SEQ ID NO: 1862 - DNA, 15 bp, Homo sapiens
cccgcggggccgggg

SEQ ID NO: 1863 - DNA, 15 bp, Homo sapiens
gcccgcggggccggg

SEQ ID NO: 1864 - DNA, 15 bp, Homo sapiens
cgcccgcggggccgg

SEQ ID NO: 1865 - DNA, 15 bp, Homo sapiens
gcgcccgcggggccg

SEQ ID NO: 1866 - DNA, 15 bp, Homo sapiens
ggcgcccgcggggcc

SEQ ID NO: 1867 - DNA, 15 bp, Homo sapiens
gggcgcccgcggggc

SEQ ID NO: 1868 - DNA, 15 bp, Homo sapiens
ggggcgcccgcgggg

SEQ ID NO: 1869 - DNA, 15 bp, Homo sapiens
aggggcgcccgcggg

SEQ ID NO: 1870 - DNA, 15 bp, Homo sapiens
caggggcgcccgcgg

SEQ ID NO: 1871 - DNA, 15 bp, Homo sapiens
acaggggcgcccgcg

SEQ ID NO: 1872 - DNA, 15 bp, Homo sapiens
gacaggggcgcccgc

SEQ ID NO: 1873 - DNA, 15 bp, Homo sapiens
cgacaggggcgcccg

SEQ ID NO: 1874 - DNA, 15 bp, Homo sapiens
gcgacaggggcgccc

SEQ ID NO: 1875 - DNA, 15 bp, Homo sapiens
ggcgacaggggcgcc

SEQ ID NO: 1876 - DNA, 15 bp, Homo sapiens
cggcgacaggggcgc

SEQ ID NO: 1877 - DNA, 15 bp, Homo sapiens
ccggcgacaggggcg

SEQ ID NO: 1878 - DNA, 15 bp, Homo sapiens
cccggcgacaggggc

SEQ ID NO: 1879 - DNA, 15 bp, Homo sapiens
ccccggcgacagggg

SEQ ID NO: 1880 - DNA, 15 bp, Homo sapiens
accccggcgacaggg

SEQ ID NO: 1881 - DNA, 15 bp, Homo sapiens
aaccccggcgacagg

SEQ ID NO: 1882 - DNA, 15 bp, Homo sapiens
gaaccccggcgacag

SEQ ID NO: 1883 - DNA, 15 bp, Homo sapiens
cgaaccccggcgaca

SEQ ID NO: 1884 - DNA, 15 bp, Homo sapiens
gcgaaccccggcgac

SEQ ID NO: 1885 - DNA, 15 bp, Homo sapiens
ggcgaaccccggcga

SEQ ID NO: 1886 - DNA, 15 bp, Homo sapiens
aggcgaaccccggcg

SEQ ID NO: 1887 - DNA, 15 bp, Homo sapiens
caggcgaaccccggc

SEQ ID NO: 1888 - DNA, 15 bp, Homo sapiens
acaggcgaaccccgg

SEQ ID NO: 1889 - DNA, 15 bp, Homo sapiens
gacaggcgaaccccg

SEQ ID NO: 1890 - DNA, 15 bp, Homo sapiens
cgacaggcgaacccc

SEQ ID NO: 1891 - DNA, 15 bp, Homo sapiens
ccgacaggcgaaccc

SEQ ID NO: 1892 - DNA, 15 bp, Homo sapiens
cccgacaggcgaacc

SEQ ID NO: 1893 - DNA, 15 bp, Homo sapiens
ccccgacaggcgaac

SEQ ID NO: 1894 - DNA, 15 bp, Homo sapiens
gccccgacaggcgaa

SEQ ID NO: 1895 - DNA, 15 bp, Homo sapiens
agccccgacaggcga

SEQ ID NO: 1896 - DNA, 15 bp, Homo sapiens
cagccccgacaggcg

SEQ ID NO: 1897 - DNA, 15 bp, Homo sapiens
gcagccccgacaggc

SEQ ID NO: 1898 - DNA, 15 bp, Homo sapiens
cgcagccccgacagg

SEQ ID NO: 1899 - DNA, 15 bp, Homo sapiens
gcgcagccccgacag

SEQ ID NO: 1900 - DNA, 15 bp, Homo sapiens
cgcgcagccccgaca

SEQ ID NO: 1901 - DNA, 15 bp, Homo sapiens
gcgcgcagccccgac

SEQ ID NO: 1902 - DNA, 15 bp, Homo sapiens
cgcgcgcagccccga

SEQ ID NO: 1903 - DNA, 15 bp, Homo sapiens
gcgcgcgcagccccg

SEQ ID NO: 1904 - DNA, 15 bp, Homo sapiens
agcgcgcgcagcccc

SEQ ID NO: 1905 - DNA, 15 bp, Homo sapiens
gagcgcgcgcagccc

SEQ ID NO: 1906 - DNA, 15 bp, Homo sapiens
ggagcgcgcgcagcc

SEQ ID NO: 1907 - DNA, 15 bp, Homo sapiens
aggagcgcgcgcagc

SEQ ID NO: 1908 - DNA, 15 bp, Homo sapiens
caggagcgcgcgcag

SEQ ID NO: 1909 - DNA, 15 bp, Homo sapiens
gcaggagcgcgcgca

SEQ ID NO: 1910 - DNA, 15 bp, Homo sapiens
ggcaggagcgcgcgc

SEQ ID NO: 1911 - DNA, 15 bp, Homo sapiens
gggcaggagcgcgcg

SEQ ID NO: 1912 - DNA, 15 bp, Homo sapiens
agggcaggagcgcgc

SEQ ID NO: 1913 - DNA, 15 bp, Homo sapiens
aagggcaggagcgcg

SEQ ID NO: 1914 - DNA, 15 bp, Homo sapiens
gaagggcaggagcgc

SEQ ID NO: 1915 - DNA, 15 bp, Homo sapiens
agaagggcaggagcg

SEQ ID NO: 1916 - DNA, 15 bp, Homo sapiens
gagaagggcaggagc

SEQ ID NO: 1917 - DNA, 15 bp, Homo sapiens
cgagaagggcaggag

SEQ ID NO: 1918 - DNA, 15 bp, Homo sapiens
ccgagaagggcagga

SEQ ID NO: 1919 - DNA, 15 bp, Homo sapiens
cccgagaagggcagg

SEQ ID NO: 1920 - DNA, 15 bp, Homo sapiens
ccccgagaagggcag

SEQ ID NO: 1921 - DNA, 15 bp, Homo sapiens
gccccgagaagggca

SEQ ID NO: 1922 - DNA, 15 bp, Homo sapiens
agccccgagaagggc

SEQ ID NO: 1923 - DNA, 15 bp, Homo sapiens
aagccccgagaaggg

SEQ ID NO: 1924 - DNA, 15 bp, Homo sapiens
aaagccccgagaagg

SEQ ID NO: 1925 - DNA, 15 bp, Homo sapiens
caaagccccgagaag

SEQ ID NO: 1926 - DNA, 15 bp, Homo sapiens
ccaaagccccgagaa

SEQ ID NO: 1927 - DNA, 15 bp, Homo sapiens
cccaaagccccgaga

SEQ ID NO: 1928 - DNA, 15 bp, Homo sapiens
gcccaaagccccgag

SEQ ID NO: 1929 - DNA, 15 bp, Homo sapiens
ggcccaaagccccga

SEQ ID NO: 1930 - DNA, 15 bp, Homo sapiens
cggcccaaagccccg

SEQ ID NO: 1931 - DNA, 15 bp, Homo sapiens
gcggcccaaagcccc

SEQ ID NO: 1932 - DNA, 15 bp, Homo sapiens
cgcggcccaaagccc

SEQ ID NO: 1933 - DNA, 15 bp, Homo sapiens
ccgcggcccaaagcc

SEQ ID NO: 1934 - DNA, 15 bp, Homo sapiens
gccgcggcccaaagc

SEQ ID NO: 1935 - DNA, 15 bp, Homo sapiens
cgccgcggcccaaag

SEQ ID NO: 1936 - DNA, 15 bp, Homo sapiens
gcgccgcggcccaaa

SEQ ID NO: 1937 - DNA, 15 bp, Homo sapiens
ggcgccgcggcccaa

SEQ ID NO: 1938 - DNA, 15 bp, Homo sapiens
cggcgccgcggccca

SEQ ID NO: 1939 - DNA, 15 bp, Homo sapiens
acggcgccgcggccc

SEQ ID NO: 1940 - DNA, 15 bp, Homo sapiens
gacggcgccgcggcc

SEQ ID NO: 1941 - DNA, 15 bp, Homo sapiens
cgacggcgccgcggc

SEQ ID NO: 1942 - DNA, 15 bp, Homo sapiens
gcgacggcgccgcgg

SEQ ID NO: 1943 - DNA, 15 bp, Homo sapiens
cgcgacggcgccgcg

SEQ ID NO: 1944 - DNA, 15 bp, Homo sapiens
gcgcgacggcgccgc

SEQ ID NO: 1945 - DNA, 15 bp, Homo sapiens
cgcgcgacggcgccg

SEQ ID NO: 1946 - DNA, 15 bp, Homo sapiens
gcgcgcgacggcgcc

SEQ ID NO: 1947 - DNA, 15 bp, Homo sapiens
ggcgcgcgacggcgc

SEQ ID NO: 1948 - DNA, 15 bp, Homo sapiens
gggcgcgcgacggcg

SEQ ID NO: 1949 - DNA, 15 bp, Homo sapiens
cgggcgcgcgacggc

SEQ ID NO: 1950 - DNA, 15 bp, Homo sapiens
gcgggcgcgcgacgg

SEQ ID NO: 1951 - DNA, 15 bp, Homo sapiens
cgcgggcgcgcgacg

SEQ ID NO: 1952 - DNA, 15 bp, Homo sapiens
ccgcgggcgcgcgac

SEQ ID NO: 1953 - DNA, 15 bp, Homo sapiens
gccgcgggcgcgcga

SEQ ID NO: 1954 - DNA, 15 bp, Homo sapiens
ggccgcgggcgcgcg

SEQ ID NO: 1955 - DNA, 15 bp, Homo sapiens
gggccgcgggcgcgc

SEQ ID NO: 1956 - DNA, 15 bp, Homo sapiens
ggggccgcgggcgcg

SEQ ID NO: 1957 - DNA, 15 bp, Homo sapiens
cggggccgcgggcgc

SEQ ID NO: 1958 - DNA, 15 bp, Homo sapiens
ccggggccgcgggcg

SEQ ID NO: 1959 - DNA, 15 bp, Homo sapiens
gccggggccgcgggc

SEQ ID NO: 1960 - DNA, 15 bp, Homo sapiens
ggccggggccgcggg

SEQ ID NO: 1961 - DNA, 15 bp, Homo sapiens
aggccggggccgcgg

SEQ ID NO: 1962 - DNA, 15 bp, Homo sapiens
gaggccggggccgcg

SEQ ID NO: 1963 - DNA, 15 bp, Homo sapiens
agaggccggggccgc

SEQ ID NO: 1964 - DNA, 15 bp, Homo sapiens
gagaggccggggccg

SEQ ID NO: 1965 - DNA, 15 bp, Homo sapiens
ggagaggccggggcc

SEQ ID NO: 1966 - DNA, 15 bp, Homo sapiens
gggagaggccggggc

SEQ ID NO: 1967 - DNA, 15 bp, Homo sapiens
agggagaggccgggg

SEQ ID NO: 1968 - DNA, 15 bp, Homo sapiens
ccagggagaggccgg

SEQ ID NO: 1969 - DNA, 15 bp, Homo sapiens
tccagggagaggccg

SEQ ID NO: 1970 - DNA, 15 bp, Homo sapiens
atccagggagaggcc

SEQ ID NO: 1971 - DNA, 15 bp, Homo sapiens
gatccagggagaggc

SEQ ID NO: 1972 - DNA, 15 bp, Homo sapiens
cgatccagggagagg

SEQ ID NO: 1973 - DNA, 15 bp, Homo sapiens
gcgatccagggagag

SEQ ID NO: 1974 - DNA, 15 bp, Homo sapiens
cgcgatccagggaga

SEQ ID NO: 1975 - DNA, 15 bp, Homo sapiens
gcgcgatccagggag

SEQ ID NO: 1976 - DNA, 15 bp, Homo sapiens
agcgcgatccaggga

SEQ ID NO: 1977 - DNA, 15 bp, Homo sapiens
gagcgcgatccaggg

SEQ ID NO: 1978 - DNA, 15 bp, Homo sapiens
agagcgcgatccagg

SEQ ID NO: 1979 - DNA, 15 bp, Homo sapiens
gagagcgcgatccag

SEQ ID NO: 1980 - DNA, 15 bp, Homo sapiens
ggagagcgcgatcca

SEQ ID NO: 1981 - DNA, 15 bp, Homo sapiens
gggagagcgcgatcc

SEQ ID NO: 1982 - DNA, 15 bp, Homo sapiens
ggggagagcgcgatc

SEQ ID NO: 1983 - DNA, 15 bp, Homo sapiens
gggggagagcgcgat

SEQ ID NO: 1984 - DNA, 15 bp, Homo sapiens
agggggagagcgcga

SEQ ID NO: 1985 - DNA, 15 bp, Homo sapiens
gagggggagagcgcg

SEQ ID NO: 1986 - DNA, 15 bp, Homo sapiens
ggagggggagagcgc

SEQ ID NO: 1987 - DNA, 15 bp, Homo sapiens
gggagggggagagcg

SEQ ID NO: 1988 - DNA, 15 bp, Homo sapiens
agggagggggagagc

SEQ ID NO: 1989 - DNA, 15 bp, Homo sapiens
gagggagggggagag

SEQ ID NO: 1990 - DNA, 15 bp, Homo sapiens
ggagggagggggaga

SEQ ID NO: 1991 - DNA, 15 bp, Homo sapiens
gggagggagggggag

SEQ ID NO: 1992 - DNA, 15 bp, Homo sapiens
agggagggaggggga

SEQ ID NO: 1993 - DNA, 15 bp, Homo sapiens
gagggagggaggggg

SEQ ID NO: 1994 - DNA, 15 bp, Homo sapiens
cgagggagggagggg

SEQ ID NO: 1995 - DNA, 15 bp, Homo sapiens
gcgagggagggaggg

SEQ ID NO: 1996 - DNA, 15 bp, Homo sapiens
cgcgagggagggagg

SEQ ID NO: 1997 - DNA, 15 bp, Homo sapiens
gcgcgagggagggag

SEQ ID NO: 1998 - DNA, 15 bp, Homo sapiens
cgcgcgagggaggga

SEQ ID NO: 1999 - DNA, 15 bp, Homo sapiens
gcgcgcgagggaggg

SEQ ID NO: 2000 - DNA, 15 bp, Homo sapiens
ggcgcgcgagggagg

SEQ ID NO: 2001 - DNA, 15 bp, Homo sapiens
gggcgcgcgagggag

SEQ ID NO: 2002 - DNA, 15 bp, Homo sapiens
ggggcgcgcgaggga

SEQ ID NO: 2003 - DNA, 15 bp, Homo sapiens
gggggcgcgcgaggg

SEQ ID NO: 2004 - DNA, 15 bp, Homo sapiens
agggggcgcgcgagg

SEQ ID NO: 2005 - DNA, 15 bp, Homo sapiens
gagggggcgcgcgag

SEQ ID NO: 2006 - DNA, 15 bp, Homo sapiens
agagggggcgcgcga

SEQ ID NO: 2007 - DNA, 15 bp, Homo sapiens
gagagggggcgcgcg

SEQ ID NO: 2008 - DNA, 15 bp, Homo sapiens
ggagagggggcgcgc

SEQ ID NO: 2009 - DNA, 15 bp, Homo sapiens
gggagagggggcgcg

SEQ ID NO: 2010 - DNA, 15 bp, Homo sapiens
cgggagagggggcgc

SEQ ID NO: 2011 - DNA, 15 bp, Homo sapiens
acgggagagggggcg

SEQ ID NO: 2012 - DNA, 15 bp, Homo sapiens
aacgggagagggggc

SEQ ID NO: 2013 - DNA, 15 bp, Homo sapiens
taacgggagaggggg

SEQ ID NO: 2014 - DNA, 15 bp, Homo sapiens
gtaacgggagagggg

SEQ ID NO: 2015 - DNA, 15 bp, Homo sapiens
agtaacgggagaggg

SEQ ID NO: 2016 - DNA, 15 bp, Homo sapiens
gagtaacgggagagg

SEQ ID NO: 2017 - DNA, 15 bp, Homo sapiens
cgagtaacgggagag

SEQ ID NO: 2018 - DNA, 15 bp, Homo sapiens
ccgagtaacgggaga

SEQ ID NO: 2019 - DNA, 15 bp, Homo sapiens
gccgagtaacgggag

SEQ ID NO: 2020 - DNA, 15 bp, Homo sapiens
ggccgagtaacggga

SEQ ID NO: 2021 - DNA, 15 bp, Homo sapiens
gggccgagtaacggg

SEQ ID NO: 2022 - DNA, 15 bp, Homo sapiens
ggggccgagtaacgg

SEQ ID NO: 2023 - DNA, 15 bp, Homo sapiens
gggggccgagtaacg

SEQ ID NO: 2024 - DNA, 15 bp, Homo sapiens
ggggggccgagtaac

SEQ ID NO: 2025 - DNA, 15 bp, Homo sapiens
gggggggccgagtaa

SEQ ID NO: 2026 - DNA, 15 bp, Homo sapiens
tgggggggccgagta

SEQ ID NO: 2027 - DNA, 15 bp, Homo sapiens
gtgggggggccgagt

SEQ ID NO: 2028 - DNA, 15 bp, Homo sapiens
ggtgggggggccgag

SEQ ID NO: 2029 - DNA, 15 bp, Homo sapiens
cggtgggggggccga

SEQ ID NO: 2030 - DNA, 15 bp, Homo sapiens
ccggtgggggggccg

SEQ ID NO: 2031 - DNA, 15 bp, Homo sapiens
gccggtgggggggcc

SEQ ID NO: 2032 - DNA, 15 bp, Homo sapiens
cgccggtgggggggc

SEQ ID NO: 2033 - DNA, 15 bp, Homo sapiens
gcgccggtggggggg

SEQ ID NO: 2034 - DNA, 15 bp, Homo sapiens
cgcgccggtgggggg

SEQ ID NO: 2035 - DNA, 15 bp, Homo sapiens
gcgcgccggtggggg

SEQ ID NO: 2036 - DNA, 15 bp, Homo sapiens
cgcgcgccggtgggg

SEQ ID NO: 2037 - DNA, 15 bp, Homo sapiens
acgcgcgccggtggg

SEQ ID NO: 2038 - DNA, 15 bp, Homo sapiens
cacgcgcgccggtgg

SEQ ID NO: 2039 - DNA, 15 bp, Homo sapiens
gcacgcgcgccggtg

SEQ ID NO: 2040 - DNA, 15 bp, Homo sapiens
cgcacgcgcgccggt

SEQ ID NO: 2041 - DNA, 15 bp, Homo sapiens
gcgcacgcgcgccgg

SEQ ID NO: 2042 - DNA, 15 bp, Homo sapiens
tgcgcacgcgcgccg

SEQ ID NO: 2043 - DNA, 15 bp, Homo sapiens
gtgcgcacgcgcgcc

SEQ ID NO: 2044 - DNA, 15 bp, Homo sapiens
agtgcgcacgcgcgc

SEQ ID NO: 2045 - DNA, 15 bp, Homo sapiens
aagtgcgcacgcgcg

SEQ ID NO: 2046 - DNA, 15 bp, Homo sapiens
gaagtgcgcacgcgc

SEQ ID NO: 2047 - DNA, 15 bp, Homo sapiens
cgaagtgcgcacgcg

SEQ ID NO: 2048 - DNA, 15 bp, Homo sapiens
gcgaagtgcgcacgc

SEQ ID NO: 2049 - DNA, 15 bp, Homo sapiens
ggcgaagtgcgcacg

SEQ ID NO: 2050 - DNA, 15 bp, Homo sapiens
aggcgaagtgcgcac

SEQ ID NO: 2051 - DNA, 15 bp, Homo sapiens
gaggcgaagtgcgca

SEQ ID NO: 2052 - DNA, 15 bp, Homo sapiens
ggaggcgaagtgcgc

SEQ ID NO: 2053 - DNA, 15 bp, Homo sapiens
gggaggcgaagtgcg

SEQ ID NO: 2054 - DNA, 15 bp, Homo sapiens
cgggaggcgaagtgc

SEQ ID NO: 2055 - DNA, 15 bp, Homo sapiens
acgggaggcgaagtg

SEQ ID NO: 2056 - DNA, 15 bp, Homo sapiens
gacgggaggcgaagt

SEQ ID NO: 2057 - DNA, 15 bp, Homo sapiens
cgacgggaggcgaag

SEQ ID NO: 2058 - DNA, 15 bp, Homo sapiens
ccgacgggaggcgaa

SEQ ID NO: 2059 - DNA, 15 bp, Homo sapiens
cccgacgggaggcga

SEQ ID NO: 2060 - DNA, 15 bp, Homo sapiens
tcccgacgggaggcg

SEQ ID NO: 2061 - DNA, 15 bp, Homo sapiens
ctcccgacgggaggc

SEQ ID NO: 2062 - DNA, 15 bp, Homo sapiens
tctcccgacgggagg

SEQ ID NO: 2063 - DNA, 15 bp, Homo sapiens
ctctcccgacgggag

SEQ ID NO: 2064 - DNA, 15 bp, Homo sapiens
actctcccgacggga

SEQ ID NO: 2065 - DNA, 15 bp, Homo sapiens
cactctcccgacggg

SEQ ID NO: 2066 - DNA, 15 bp, Homo sapiens
gcactctcccgacgg

SEQ ID NO: 2067 - DNA, 15 bp, Homo sapiens
cgcactctcccgacg

SEQ ID NO: 2068 - DNA, 15 bp, Homo sapiens
gcgcactctcccgac

SEQ ID NO: 2069 - DNA, 15 bp, Homo sapiens
ggcgcactctcccga

SEQ ID NO: 2070 - DNA, 15 bp, Homo sapiens
tggcgcactctcccg

SEQ ID NO: 2071 - DNA, 15 bp, Homo sapiens
gtggcgcactctccc

SEQ ID NO: 2072 - DNA, 15 bp, Homo sapiens
tgtggcgcactctcc

SEQ ID NO: 2073 - DNA, 15 bp, Homo sapiens
ttgtggcgcactctc

SEQ ID NO: 2074 - DNA, 15 bp, Homo sapiens
cttgtggcgcactct

SEQ ID NO: 2075 - DNA, 15 bp, Homo sapiens
ccttgtggcgcactc

SEQ ID NO: 2076 - DNA, 15 bp, Homo sapiens
cccttgtggcgcact

SEQ ID NO: 2077 - DNA, 15 bp, Homo sapiens
gcccttgtggcgcac

SEQ ID NO: 2078 - DNA, 15 bp, Homo sapiens
agcccttgtggcgca

SEQ ID NO: 2079 - DNA, 15 bp, Homo sapiens
gagcccttgtggcgc

SEQ ID NO: 2080 - DNA, 15 bp, Homo sapiens
ggagcccttgtggcg

SEQ ID NO: 2081 - DNA, 15 bp, Homo sapiens
aggagcccttgtggc

SEQ ID NO: 2082 - DNA, 15 bp, Homo sapiens
caggagcccttgtgg

SEQ ID NO: 2083 - DNA, 15 bp, Homo sapiens
tcaggagcccttgtg

SEQ ID NO: 2084 - DNA, 15 bp, Homo sapiens
ctcaggagcccttgt

SEQ ID NO: 2085 - DNA, 15 bp, Homo sapiens
gctcaggagcccttg

SEQ ID NO: 2086 - DNA, 15 bp, Homo sapiens
agctcaggagccctt

SEQ ID NO: 2087 - DNA, 15 bp, Homo sapiens
gagctcaggagccct

SEQ ID NO: 2088 - DNA, 15 bp, Homo sapiens
agagctcaggagccc

SEQ ID NO: 2089 - DNA, 15 bp, Homo sapiens
gagagctcaggagcc

SEQ ID NO: 2090 - DNA, 15 bp, Homo sapiens
tgagagctcaggagc

SEQ ID NO: 2091 - DNA, 15 bp, Homo sapiens
gtgagagctcaggag

SEQ ID NO: 2092 - DNA, 15 bp, Homo sapiens
ggtgagagctcagga

SEQ ID NO: 2093 - DNA, 15 bp, Homo sapiens
gggtgagagctcagg

SEQ ID NO: 2094 - DNA, 15 bp, Homo sapiens
ggggtgagagctcag

SEQ ID NO: 2095 - DNA, 15 bp, Homo sapiens
gggggtgagagctca

SEQ ID NO: 2096 - DNA, 15 bp, Homo sapiens
tgggggtgagagctc

SEQ ID NO: 2097 - DNA, 15 bp, Homo sapiens
atgggggtgagagct

SEQ ID NO: 2098 - DNA, 15 bp, Homo sapiens
gatgggggtgagagc

SEQ ID NO: 2099 - DNA, 15 bp, Homo sapiens
agatgggggtgagag

SEQ ID NO: 2100 - DNA, 15 bp, Homo sapiens
gagatgggggtgaga

SEQ ID NO: 2101 - DNA, 15 bp, Homo sapiens
agagatgggggtgag

SEQ ID NO: 2102 - DNA, 15 bp, Homo sapiens
cagagatgggggtga

SEQ ID NO: 2103 - DNA, 15 bp, Homo sapiens
ccagagatgggggtg

SEQ ID NO: 2104 - DNA, 15 bp, Homo sapiens
cccagagatgggggt

SEQ ID NO: 2105 - DNA, 15 bp, Homo sapiens
gcccagagatggggg

SEQ ID NO: 2106 - DNA, 15 bp, Homo sapiens
agcccagagatgggg

SEQ ID NO: 2107 - DNA, 15 bp, Homo sapiens
aagcccagagatggg

SEQ ID NO: 2108 - DNA, 15 bp, Homo sapiens
aaagcccagagatgg

SEQ ID NO: 2109 - DNA, 15 bp, Homo sapiens
caaagcccagagatg

SEQ ID NO: 2110 - DNA, 15 bp, Homo sapiens
gcaaagcccagagat

SEQ ID NO: 2111 - DNA, 15 bp, Homo sapiens
ggcaaagcccagaga

SEQ ID NO: 2112 - DNA, 15 bp, Homo sapiens
aggcaaagcccagag

SEQ ID NO: 2113 - DNA, 15 bp, Homo sapiens
gaggcaaagcccaga

SEQ ID NO: 2114 - DNA, 15 bp, Homo sapiens
ggaggcaaagcccag

SEQ ID NO: 2115 - DNA, 15 bp, Homo sapiens
gggaggcaaagccca

SEQ ID NO: 2116 - DNA, 15 bp, Homo sapiens
ggggaggcaaagccc

SEQ ID NO: 2117 - DNA, 15 bp, Homo sapiens
gggggaggcaaagcc

SEQ ID NO: 2118 - DNA, 15 bp, Homo sapiens
agggggaggcaaagc

SEQ ID NO: 2119 - DNA, 15 bp, Homo sapiens
gagggggaggcaaag

SEQ ID NO: 2120 - DNA, 15 bp, Homo sapiens
ggagggggaggcaaa

SEQ ID NO: 2121 - DNA, 15 bp, Homo sapiens
aggagggggaggcaa

SEQ ID NO: 2122 - DNA, 15 bp, Homo sapiens
aaggagggggaggca

SEQ ID NO: 2123 - DNA, 15 bp, Homo sapiens
gaaggagggggaggc

SEQ ID NO: 2124 - DNA, 15 bp, Homo sapiens
agaaggagggggagg

SEQ ID NO: 2125 - DNA, 15 bp, Homo sapiens
gagaaggagggggag

SEQ ID NO: 2126 - DNA, 15 bp, Homo sapiens
cgagaaggaggggga

SEQ ID NO: 2127 - DNA, 15 bp, Homo sapiens
gcgagaaggaggggg

SEQ ID NO: 2128 - DNA, 15 bp, Homo sapiens
ggcgagaaggagggg

SEQ ID NO: 2129 - DNA, 15 bp, Homo sapiens
gggcgagaaggaggg

SEQ ID NO: 2130 - DNA, 15 bp, Homo sapiens
tgggcgagaaggagg

SEQ ID NO: 2131 - DNA, 15 bp, Homo sapiens
atgggcgagaaggag

SEQ ID NO: 2132 - DNA, 15 bp, Homo sapiens
aatgggcgagaagga

SEQ ID NO: 2133 - DNA, 15 bp, Homo sapiens
gaatgggcgagaagg

SEQ ID NO: 2134 - DNA, 15 bp, Homo sapiens
ggaatgggcgagaag

SEQ ID NO: 2135 - DNA, 15 bp, Homo sapiens
tggaatgggcgagaa

SEQ ID NO: 2136 - DNA, 15 bp, Homo sapiens
atggaatgggcgaga

SEQ ID NO: 2137 - DNA, 15 bp, Homo sapiens
catggaatgggcgag

SEQ ID NO: 2138 - DNA, 15 bp, Homo sapiens
tcatggaatgggcga

SEQ ID NO: 2139 - DNA, 15 bp, Homo sapiens
ttcatggaatgggcg

SEQ ID NO: 2140 - DNA, 15 bp, Homo sapiens
attcatggaatgggc

SEQ ID NO: 2141 - DNA, 15 bp, Homo sapiens
aattcatggaatggg

SEQ ID NO: 2142 - DNA, 15 bp, Homo sapiens
aaattcatggaatgg

SEQ ID NO: 2143 - DNA, 15 bp, Homo sapiens
gaaattcatggaatg

SEQ ID NO: 2144 - DNA, 15 bp, Homo sapiens
agaaattcatggaat

SEQ ID NO: 2145 - DNA, 15 bp, Homo sapiens
cagaaattcatggaa

SEQ ID NO: 2146 - DNA, 15 bp, Homo sapiens
gcagaaattcatgga

SEQ ID NO: 2147 - DNA, 15 bp, Homo sapiens
ggcagaaattcatgg

SEQ ID NO: 2148 - DNA, 15 bp, Homo sapiens
gggcagaaattcatg

SEQ ID NO: 2149 - DNA, 15 bp, Homo sapiens
ggggcagaaattcat

SEQ ID NO: 2150 - DNA, 15 bp, Homo sapiens
gggggcagaaattca

SEQ ID NO: 2151 - DNA, 15 bp, Homo sapiens
ggggggcagaaattc

SEQ ID NO: 2152 - DNA, 15 bp, Homo sapiens
cggggggcagaaatt

SEQ ID NO: 2153 - DNA, 15 bp, Homo sapiens
gcggggggcagaaat

SEQ ID NO: 2154 - DNA, 15 bp, Homo sapiens
agcggggggcagaaa

SEQ ID NO: 2155 - DNA, 15 bp, Homo sapiens
tagcggggggcagaa

SEQ ID NO: 2156 - DNA, 15 bp, Homo sapiens
gtagcggggggcaga

SEQ ID NO: 2157 - DNA, 15 bp, Homo sapiens
ggtagcggggggcag

SEQ ID NO: 2158 - DNA, 15 bp, Homo sapiens
gggtagcggggggca

SEQ ID NO: 2159 - DNA, 15 bp, Homo sapiens
ggggtagcggggggc

SEQ ID NO: 2160 - DNA, 15 bp, Homo sapiens
gggggtagcgggggg

SEQ ID NO: 2161 - DNA, 15 bp, Homo sapiens
ggggggtagcggggg

SEQ ID NO: 2162 - DNA, 15 bp, Homo sapiens
gggggggtagcgggg

SEQ ID NO: 2163 - DNA, 15 bp, Homo sapiens
cgggggggtagcggg

SEQ ID NO: 2164 - DNA, 15 bp, Homo sapiens
gcgggggggtagcgg

SEQ ID NO: 2165 - DNA, 15 bp, Homo sapiens
cgcgggggggtagcg

SEQ ID NO: 2166 - DNA, 15 bp, Homo sapiens
tcgcgggggggtagc

SEQ ID NO: 2167 - DNA, 15 bp, Homo sapiens
ctcgcgggggggtag

SEQ ID NO: 2168 - DNA, 15 bp, Homo sapiens
gctcgcgggggggta

SEQ ID NO: 2169 - DNA, 15 bp, Homo sapiens
cgctcgcgggggggt

SEQ ID NO: 2170 - DNA, 15 bp, Homo sapiens
tcgctcgcggggggg

SEQ ID NO: 2171 - DNA, 15 bp, Homo sapiens
ctcgctcgcgggggg

SEQ ID NO: 2172 - DNA, 15 bp, Homo sapiens
actcgctcgcggggg

SEQ ID NO: 2173 - DNA, 15 bp, Homo sapiens
tactcgctcgcgggg

SEQ ID NO: 2174 - DNA, 15 bp, Homo sapiens
ctactcgctcgcggg

SEQ ID NO: 2175 - DNA, 15 bp, Homo sapiens
cctactcgctcgcgg

SEQ ID NO: 2176 - DNA, 15 bp, Homo sapiens
acctactcgctcgcg

SEQ ID NO: 2177 - DNA, 15 bp, Homo sapiens
gacctactcgctcgc

SEQ ID NO: 2178 - DNA, 15 bp, Homo sapiens
ggacctactcgctcg

SEQ ID NO: 2179 - DNA, 15 bp, Homo sapiens
tggacctactcgctc

SEQ ID NO: 2180 - DNA, 15 bp, Homo sapiens
gtggacctactcgct

SEQ ID NO: 2181 - DNA, 15 bp, Homo sapiens
ggtggacctactcgc

SEQ ID NO: 2182 - DNA, 15 bp, Homo sapiens
cggtggacctactcg

SEQ ID NO: 2183 - DNA, 15 bp, Homo sapiens
ccggtggacctactc

SEQ ID NO: 2184 - DNA, 15 bp, Homo sapiens
gccggtggacctact

SEQ ID NO: 2185 - DNA, 15 bp, Homo sapiens
agccggtggacctac

SEQ ID NO: 2186 - DNA, 15 bp, Homo sapiens
gagccggtggaccta

SEQ ID NO: 2187 - DNA, 15 bp, Homo sapiens
ggagccggtggacct

SEQ ID NO: 2188 - DNA, 15 bp, Homo sapiens
aggagccggtggacc

SEQ ID NO: 2189 - DNA, 15 bp, Homo sapiens
aaggagccggtggac

SEQ ID NO: 2190 - DNA, 15 bp, Homo sapiens
aaaggagccggtgga

SEQ ID NO: 2191 - DNA, 15 bp, Homo sapiens
gaaaggagccggtgg

SEQ ID NO: 2192 - DNA, 15 bp, Homo sapiens
ggaaaggagccggtg

SEQ ID NO: 2193 - DNA, 15 bp, Homo sapiens
gggaaaggagccggt

SEQ ID NO: 2194 - DNA, 15 bp, Homo sapiens
ggggaaaggagccgg

SEQ ID NO: 2195 - DNA, 15 bp, Homo sapiens
tggggaaaggagccg

SEQ ID NO: 2196 - DNA, 15 bp, Homo sapiens
atggggaaaggagcc

SEQ ID NO: 2197 - DNA, 15 bp, Homo sapiens
gatggggaaaggagc

SEQ ID NO: 2198 - DNA, 15 bp, Homo sapiens
agatggggaaaggag

SEQ ID NO: 2199 - DNA, 15 bp, Homo sapiens
tagatggggaaagga

SEQ ID NO: 2200 - DNA, 15 bp, Homo sapiens
ctagatggggaaagg

SEQ ID NO: 2201 - DNA, 15 bp, Homo sapiens
gctagatggggaaag

SEQ ID NO: 2202 - DNA, 15 bp, Homo sapiens
tgctagatggggaaa

SEQ ID NO: 2203 - DNA, 15 bp, Homo sapiens
ctgctagatggggaa

SEQ ID NO: 2204 - DNA, 15 bp, Homo sapiens
cctgctagatgggga

SEQ ID NO: 2205 - DNA, 15 bp, Homo sapiens
tcctgctagatgggg

SEQ ID NO: 2206 - DNA, 15 bp, Homo sapiens
ttcctgctagatggg

SEQ ID NO: 2207 - DNA, 15 bp, Homo sapiens
gttcctgctagatgg

SEQ ID NO: 2208 - DNA, 15 bp, Homo sapiens
tgttcctgctagatg

SEQ ID NO: 2209 - DNA, 15 bp, Homo sapiens
ttgttcctgctagat

SEQ ID NO: 2210 - DNA, 15 bp, Homo sapiens
cttgttcctgctaga

SEQ ID NO: 2211 - DNA, 15 bp, Homo sapiens
acttgttcctgctag

SEQ ID NO: 2212 - DNA, 15 bp, Homo sapiens
tacttgttcctgcta

SEQ ID NO: 2213 - DNA, 15 bp, Homo sapiens
ctacttgttcctgct

SEQ ID NO: 2214 - DNA, 15 bp, Homo sapiens
cctacttgttcctgc

SEQ ID NO: 2215 - DNA, 15 bp, Homo sapiens
acctacttgttcctg

SEQ ID NO: 2216 - DNA, 15 bp, Homo sapiens
cacctacttgttcct

SEQ ID NO: 2217 - DNA, 15 bp, Homo sapiens
ccacctacttgttcc

SEQ ID NO: 2218 - DNA, 15 bp, Homo sapiens
cccacctacttgttc

SEQ ID NO: 2219 - DNA, 15 bp, Homo sapiens
ccccacctacttgtt

SEQ ID NO: 2220 - DNA, 15 bp, Homo sapiens
tccccacctacttgt

SEQ ID NO: 2221 - DNA, 15 bp, Homo sapiens
atccccacctacttg

SEQ ID NO: 2222 - DNA, 15 bp, Homo sapiens
aatccccacctactt

SEQ ID NO: 2223 - DNA, 15 bp, Homo sapiens
taatccccacctact

SEQ ID NO: 2224 - DNA, 15 bp, Homo sapiens
ataatccccacctac

SEQ ID NO: 2225 - DNA, 15 bp, Homo sapiens
aataatccccaccta

SEQ ID NO: 2226 - DNA, 15 bp, Homo sapiens
taataatccccacct

SEQ ID NO: 2227 - DNA, 15 bp, Homo sapiens
ataataatccccacc

SEQ ID NO: 2228 - DNA, 15 bp, Homo sapiens
gataataatccccac

SEQ ID NO: 2229 - DNA, 15 bp, Homo sapiens
ggataataatcccca

SEQ ID NO: 2230 - DNA, 15 bp, Homo sapiens
tggataataatcccc

SEQ ID NO: 2231 - DNA, 15 bp, Homo sapiens
gtggataataatccc

SEQ ID NO: 2232 - DNA, 15 bp, Homo sapiens
tgtggataataatcc

SEQ ID NO: 2233 - DNA, 15 bp, Homo sapiens
ttgtggataataatc

SEQ ID NO: 2234 - DNA, 15 bp, Homo sapiens
tttgtggataataat

SEQ ID NO: 2235 - DNA, 15 bp, Homo sapiens
ttttgtggataataa

SEQ ID NO: 2236 - DNA, 15 bp, Homo sapiens
cttttgtggataata

SEQ ID NO: 2237 - DNA, 15 bp, Homo sapiens
ccttttgtggataat

SEQ ID NO: 2238 - DNA, 15 bp, Homo sapiens
cccttttgtggataa

SEQ ID NO: 2239 - DNA, 15 bp, Homo sapiens
tcccttttgtggata

SEQ ID NO: 2240 - DNA, 15 bp, Homo sapiens
gtcccttttgtggat

SEQ ID NO: 2241 - DNA, 15 bp, Homo sapiens
agtcccttttgtgga

SEQ ID NO: 2242 - DNA, 15 bp, Homo sapiens
tagtcccttttgtgg

SEQ ID NO: 2243 - DNA, 15 bp, Homo sapiens
ctagtcccttttgtg

SEQ ID NO: 2244 - DNA, 15 bp, Homo sapiens
tctagtcccttttgt

SEQ ID NO: 2245 - DNA, 15 bp, Homo sapiens
gtctagtcccttttg

SEQ ID NO: 2246 - DNA, 15 bp, Homo sapiens
tgtctagtccctttt

SEQ ID NO: 2247 - DNA, 15 bp, Homo sapiens
atgtctagtcccttt

SEQ ID NO: 2248 - DNA, 15 bp, Homo sapiens
aatgtctagtccctt

SEQ ID NO: 2249 - DNA, 15 bp, Homo sapiens
caatgtctagtccct

SEQ ID NO: 2250 - DNA, 15 bp, Homo sapiens
acaatgtctagtccc

SEQ ID NO: 2251 - DNA, 15 bp, Homo sapiens
cacaatgtctagtcc

SEQ ID NO: 2252 - DNA, 15 bp, Homo sapiens
acacaatgtctagtc

SEQ ID NO: 2253 - DNA, 15 bp, Homo sapiens
aacacaatgtctagt

SEQ ID NO: 2254 - DNA, 15 bp, Homo sapiens
gaacacaatgtctag

SEQ ID NO: 2255 - DNA, 15 bp, Homo sapiens
agaacacaatgtcta

SEQ ID NO: 2256 - DNA, 15 bp, Homo sapiens
cagaacacaatgtct

SEQ ID NO: 2257 - DNA, 15 bp, Homo sapiens
ccagaacacaatgtc

SEQ ID NO: 2258 - DNA, 15 bp, Homo sapiens
cccagaacacaatgt

SEQ ID NO: 2259 - DNA, 15 bp, Homo sapiens
acccagaacacaatg

SEQ ID NO: 2260 - DNA, 15 bp, Homo sapiens
gacccagaacacaat

SEQ ID NO: 2261 - DNA, 15 bp, Homo sapiens
ggacccagaacacaa

SEQ ID NO: 2262 - DNA, 15 bp, Homo sapiens
gggacccagaacaca

SEQ ID NO: 2263 - DNA, 15 bp, Homo sapiens
tgggacccagaacac

SEQ ID NO: 2264 - DNA, 15 bp, Homo sapiens
gtgggacccagaaca

SEQ ID NO: 2265 - DNA, 15 bp, Homo sapiens
tgtgggacccagaac

SEQ ID NO: 2266 - DNA, 15 bp, Homo sapiens
ttgtgggacccagaa

SEQ ID NO: 2267 - DNA, 15 bp, Homo sapiens
gttgtgggacccaga

SEQ ID NO: 2268 - DNA, 15 bp, Homo sapiens
agttgtgggacccag

SEQ ID NO: 2269 - DNA, 15 bp, Homo sapiens
gagttgtgggaccca

SEQ ID NO: 2270 - DNA, 15 bp, Homo sapiens
tgagttgtgggaccc

SEQ ID NO: 2271 - DNA, 15 bp, Homo sapiens
atgagttgtgggacc

SEQ ID NO: 2272 - DNA, 15 bp, Homo sapiens
gatgagttgtgggac

SEQ ID NO: 2273 - DNA, 15 bp, Homo sapiens
tgatgagttgtggga

SEQ ID NO: 2274 - DNA, 15 bp, Homo sapiens
atgatgagttgtggg

SEQ ID NO: 2275 - DNA, 15 bp, Homo sapiens
tatgatgagttgtgg

SEQ ID NO: 2276 - DNA, 15 bp, Homo sapiens
ttatgatgagttgtg

SEQ ID NO: 2277 - DNA, 15 bp, Homo sapiens
tttatgatgagttgt

SEQ ID NO: 2278 - DNA, 15 bp, Homo sapiens
ctttatgatgagttg

SEQ ID NO: 2279 - DNA, 15 bp, Homo sapiens
tctttatgatgagtt

SEQ ID NO: 2280 - DNA, 15 bp, Homo sapiens
ctctttatgatgagt

SEQ ID NO: 2281 - DNA, 15 bp, Homo sapiens
cctctttatgatgag

SEQ ID NO: 2282 - DNA, 15 bp, Homo sapiens
acctctttatgatga

SEQ ID NO: 2283 - DNA, 15 bp, Homo sapiens
cacctctttatgatg

SEQ ID NO: 2284 - DNA, 15 bp, Homo sapiens
ccacctctttatgat

SEQ ID NO: 2285 - DNA, 15 bp, Homo sapiens
accacctctttatga

SEQ ID NO: 2286 - DNA, 15 bp, Homo sapiens
aaccacctctttatg

SEQ ID NO: 2287 - DNA, 15 bp, Homo sapiens
taaccacctctttat

SEQ ID NO: 2288 - DNA, 15 bp, Homo sapiens
ataaccacctcttta

SEQ ID NO: 2289 - DNA, 15 bp, Homo sapiens
tataaccacctcttt

SEQ ID NO: 2290 - DNA, 15 bp, Homo sapiens
ctataaccacctctt

SEQ ID NO: 2291 - DNA, 15 bp, Homo sapiens
actataaccacctct

SEQ ID NO: 2292 - DNA, 15 bp, Homo sapiens
aactataaccacctc

SEQ ID NO: 2293 - DNA, 15 bp, Homo sapiens
gaactataaccacct

SEQ ID NO: 2294 - DNA, 15 bp, Homo sapiens
ggaactataaccacc

SEQ ID NO: 2295 - DNA, 15 bp, Homo sapiens
gggaactataaccac

SEQ ID NO: 2296 - DNA, 15 bp, Homo sapiens
tgggaactataacca

SEQ ID NO: 2297 - DNA, 15 bp, Homo sapiens
atgggaactataacc

SEQ ID NO: 2298 - DNA, 15 bp, Homo sapiens
gatgggaactataac

SEQ ID NO: 2299 - DNA, 15 bp, Homo sapiens
tgatgggaactataa

SEQ ID NO: 2300 - DNA, 15 bp, Homo sapiens
ctgatgggaactata

SEQ ID NO: 2301 - DNA, 15 bp, Homo sapiens
cctgatgggaactat

SEQ ID NO: 2302 - DNA, 15 bp, Homo sapiens
tcctgatgggaacta

SEQ ID NO: 2303 - DNA, 15 bp, Homo sapiens
ctcctgatgggaact

SEQ ID NO: 2304 - DNA, 15 bp, Homo sapiens
gctcctgatgggaac

SEQ ID NO: 2305 - DNA, 15 bp, Homo sapiens
ggctcctgatgggaa

SEQ ID NO: 2306 - DNA, 15 bp, Homo sapiens
cggctcctgatggga

SEQ ID NO: 2307 - DNA, 15 bp, Homo sapiens
acggctcctgatggg

SEQ ID NO: 2308 - DNA, 15 bp, Homo sapiens
cacggctcctgatgg

SEQ ID NO: 2309 - DNA, 15 bp, Homo sapiens
ccacggctcctgatg

SEQ ID NO: 2310 - DNA, 15 bp, Homo sapiens
cccacggctcctgat

SEQ ID NO: 2311 - DNA, 15 bp, Homo sapiens
acccacggctcctga

SEQ ID NO: 2312 - DNA, 15 bp, Homo sapiens
tacccacggctcctg

SEQ ID NO: 2313 - DNA, 15 bp, Homo sapiens
ctacccacggctcct

SEQ ID NO: 2314 - DNA, 15 bp, Homo sapiens
cctacccacggctcc

SEQ ID NO: 2315 - DNA, 15 bp, Homo sapiens
ccctacccacggctc

SEQ ID NO: 2316 - DNA, 15 bp, Homo sapiens
cccctacccacggct

SEQ ID NO: 2317 - DNA, 15 bp, Homo sapiens
tcccctacccacggc

SEQ ID NO: 2318 - DNA, 15 bp, Homo sapiens
gtcccctacccacgg

SEQ ID NO: 2319 - DNA, 15 bp, Homo sapiens
agtcccctacccacg

SEQ ID NO: 2320 - DNA, 15 bp, Homo sapiens
cagtcccctacccac

SEQ ID NO: 2321 - DNA, 15 bp, Homo sapiens
acagtcccctaccca

SEQ ID NO: 2322 - DNA, 15 bp, Homo sapiens
cacagtcccctaccc

SEQ ID NO: 2323 - DNA, 15 bp, Homo sapiens
gcacagtcccctacc

SEQ ID NO: 2324 - DNA, 15 bp, Homo sapiens
cgcacagtcccctac

SEQ ID NO: 2325 - DNA, 15 bp, Homo sapiens
acgcacagtccccta

SEQ ID NO: 2326 - DNA, 15 bp, Homo sapiens
gacgcacagtcccct

SEQ ID NO: 2327 - DNA, 15 bp, Homo sapiens
ggacgcacagtcccc

SEQ ID NO: 2328 - DNA, 15 bp, Homo sapiens
tggacgcacagtccc

SEQ ID NO: 2329 - DNA, 15 bp, Homo sapiens
ctggacgcacagtcc

SEQ ID NO: 2330 - DNA, 15 bp, Homo sapiens
gctggacgcacagtc

SEQ ID NO: 2331 - DNA, 15 bp, Homo sapiens
tgctggacgcacagt

SEQ ID NO: 2332 - DNA, 15 bp, Homo sapiens
ctgctggacgcacag

SEQ ID NO: 2333 - DNA, 15 bp, Homo sapiens
gctgctggacgcaca

SEQ ID NO: 2334 - DNA, 15 bp, Homo sapiens
tgctgctggacgcac

SEQ ID NO: 2335 - DNA, 15 bp, Homo sapiens
gtgctgctggacgca

SEQ ID NO: 2336 - DNA, 15 bp, Homo sapiens
ggtgctgctggacgc

SEQ ID NO: 2337 - DNA, 15 bp, Homo sapiens
gggtgctgctggacg

SEQ ID NO: 2338 - DNA, 15 bp, Homo sapiens
cgggtgctgctggac

SEQ ID NO: 2339 - DNA, 15 bp, Homo sapiens
tcgggtgctgctgga

SEQ ID NO: 2340 - DNA, 15 bp, Homo sapiens
ctcgggtgctgctgg

SEQ ID NO: 2341 - DNA, 15 bp, Homo sapiens
cctcgggtgctgctg

SEQ ID NO: 2342 - DNA, 15 bp, Homo sapiens
gcctcgggtgctgct

SEQ ID NO: 2343 - DNA, 15 bp, Homo sapiens
agcctcgggtgctgc

SEQ ID NO: 2344 - DNA, 15 bp, Homo sapiens
gagcctcgggtgctg

SEQ ID NO: 2345 - DNA, 15 bp, Homo sapiens
agagcctcgggtgct

SEQ ID NO: 2346 - DNA, 15 bp, Homo sapiens
aagagcctcgggtgc

SEQ ID NO: 2347 - DNA, 15 bp, Homo sapiens
gaagagcctcgggtg

SEQ ID NO: 2348 - DNA, 15 bp, Homo sapiens
cgaagagcctcgggt

SEQ ID NO: 2349 - DNA, 15 bp, Homo sapiens
ccgaagagcctcggg

SEQ ID NO: 2350 - DNA, 15 bp, Homo sapiens
gccgaagagcctcgg

SEQ ID NO: 2351 - DNA, 15 bp, Homo sapiens
cgccgaagagcctcg

SEQ ID NO: 2352 - DNA, 15 bp, Homo sapiens
gcgccgaagagcctc

SEQ ID NO: 2353 - DNA, 15 bp, Homo sapiens
ggcgccgaagagcct

SEQ ID NO: 2354 - DNA, 15 bp, Homo sapiens
tggcgccgaagagcc

SEQ ID NO: 2355 - DNA, 15 bp, Homo sapiens
ctggcgccgaagagc

SEQ ID NO: 2356 - DNA, 15 bp, Homo sapiens
tctggcgccgaagag

SEQ ID NO: 2357 - DNA, 15 bp, Homo sapiens
ctctggcgccgaaga

SEQ ID NO: 2358 - DNA, 15 bp, Homo sapiens
cctctggcgccgaag

SEQ ID NO: 2359 - DNA, 15 bp, Homo sapiens
gcctctggcgccgaa

SEQ ID NO: 2360 - DNA, 15 bp, Homo sapiens
agcctctggcgccga

SEQ ID NO: 2361 - DNA, 15 bp, Homo sapiens
gagcctctggcgccg

SEQ ID NO: 2362 - DNA, 15 bp, Homo sapiens
agagcctctggcgcc

SEQ ID NO: 2363 - DNA, 15 bp, Homo sapiens
tagagcctctggcgc

SEQ ID NO: 2364 - DNA, 15 bp, Homo sapiens
ttagagcctctggcg

SEQ ID NO: 2365 - DNA, 15 bp, Homo sapiens
cttagagcctctggc

SEQ ID NO: 2366 - DNA, 15 bp, Homo sapiens
ccttagagcctctgg

SEQ ID NO: 2367 - DNA, 15 bp, Homo sapiens
accttagagcctctg

SEQ ID NO: 2368 - DNA, 15 bp, Homo sapiens
caccttagagcctct

SEQ ID NO: 2369 - DNA, 15 bp, Homo sapiens
gcaccttagagcctc

SEQ ID NO: 2370 - DNA, 15 bp, Homo sapiens
cgcaccttagagcct

SEQ ID NO: 2371 - DNA, 15 bp, Homo sapiens
tcgcaccttagagcc

SEQ ID NO: 2372 - DNA, 15 bp, Homo sapiens
ctcgcaccttagagc

SEQ ID NO: 2373 - DNA, 15 bp, Homo sapiens
gctcgcaccttagag

SEQ ID NO: 2374 - DNA, 15 bp, Homo sapiens
cgctcgcaccttaga

SEQ ID NO: 2375 - DNA, 15 bp, Homo sapiens
acgctcgcaccttag

SEQ ID NO: 2376 - DNA, 15 bp, Homo sapiens
cacgctcgcacctta

SEQ ID NO: 2377 - DNA, 15 bp, Homo sapiens
acacgctcgcacctt

SEQ ID NO: 2378 - DNA, 15 bp, Homo sapiens
gacacgctcgcacct

SEQ ID NO: 2379 - DNA, 15 bp, Homo sapiens
ggacacgctcgcacc

SEQ ID NO: 2380 - DNA, 15 bp, Homo sapiens
gggacacgctcgcac

SEQ ID NO: 2381 - DNA, 15 bp, Homo sapiens
ggggacacgctcgca

SEQ ID NO: 2382 - DNA, 15 bp, Homo sapiens
tggggacacgctcgc

SEQ ID NO: 2383 - DNA, 15 bp, Homo sapiens
ctggggacacgctcg

SEQ ID NO: 2384 - DNA, 15 bp, Homo sapiens
cctggggacacgctc

SEQ ID NO: 2385 - DNA, 15 bp, Homo sapiens
ccctggggacacgct

SEQ ID NO: 2386 - DNA, 15 bp, Homo sapiens
accctggggacacgc

SEQ ID NO: 2387 - DNA, 15 bp, Homo sapiens
caccctggggacacg

SEQ ID NO: 2388 - DNA, 15 bp, Homo sapiens
gcaccctggggacac

SEQ ID NO: 2389 - DNA, 15 bp, Homo sapiens
agcaccctggggaca

SEQ ID NO: 2390 - DNA, 15 bp, Homo sapiens
gagcaccctggggac

SEQ ID NO: 2391 - DNA, 15 bp, Homo sapiens
tgagcaccctgggga

SEQ ID NO: 2392 - DNA, 15 bp, Homo sapiens
ctgagcaccctgggg

SEQ ID NO: 2393 - DNA, 15 bp, Homo sapiens
tctgagcaccctggg

SEQ ID NO: 2394 - DNA, 15 bp, Homo sapiens
ctctgagcaccctgg

SEQ ID NO: 2395 - DNA, 15 bp, Homo sapiens
cctctgagcaccctg

SEQ ID NO: 2396 - DNA, 15 bp, Homo sapiens
acctctgagcaccct

SEQ ID NO: 2397 - DNA, 15 bp, Homo sapiens
aacctctgagcaccc

SEQ ID NO: 2398 - DNA, 15 bp, Homo sapiens
gaacctctgagcacc

SEQ ID NO: 2399 - DNA, 15 bp, Homo sapiens
agaacctctgagcac

SEQ ID NO: 2400 - DNA, 15 bp, Homo sapiens
aagaacctctgagca

SEQ ID NO: 2401 - DNA, 15 bp, Homo sapiens
aaagaacctctgagc

SEQ ID NO: 2402 - DNA, 15 bp, Homo sapiens
caaagaacctctgag

SEQ ID NO: 2403 - DNA, 15 bp, Homo sapiens
ccaaagaacctctga

SEQ ID NO: 2404 - DNA, 15 bp, Homo sapiens
tccaaagaacctctg

SEQ ID NO: 2405 - DNA, 15 bp, Homo sapiens
ctccaaagaacctct

SEQ ID NO: 2406 - DNA, 15 bp, Homo sapiens
actccaaagaacctc

SEQ ID NO: 2407 - DNA, 15 bp, Homo sapiens
cactccaaagaacct

SEQ ID NO: 2408 - DNA, 15 bp, Homo sapiens
gcactccaaagaacc

SEQ ID NO: 2409 - DNA, 15 bp, Homo sapiens
agcactccaaagaac

SEQ ID NO: 2410 - DNA, 15 bp, Homo sapiens
cagcactccaaagaa

SEQ ID NO: 2411 - DNA, 15 bp, Homo sapiens
acagcactccaaaga

SEQ ID NO: 2412 - DNA, 15 bp, Homo sapiens
cacagcactccaaag

SEQ ID NO: 2413 - DNA, 15 bp, Homo sapiens
ccacagcactccaaa

SEQ ID NO: 2414 - DNA, 15 bp, Homo sapiens
gccacagcactccaa

SEQ ID NO: 2415 - DNA, 15 bp, Homo sapiens
ggccacagcactcca

SEQ ID NO: 2416 - DNA, 15 bp, Homo sapiens
aggccacagcactcc

SEQ ID NO: 2417 - DNA, 15 bp, Homo sapiens
gaggccacagcactc

SEQ ID NO: 2418 - DNA, 15 bp, Homo sapiens
cgaggccacagcact

SEQ ID NO: 2419 - DNA, 15 bp, Homo sapiens
ccgaggccacagcac

SEQ ID NO: 2420 - DNA, 15 bp, Homo sapiens
tccgaggccacagca

SEQ ID NO: 2421 - DNA, 15 bp, Homo sapiens
ttccgaggccacagc

SEQ ID NO: 2422 - DNA, 15 bp, Homo sapiens
attccgaggccacag

SEQ ID NO: 2423 - DNA, 15 bp, Homo sapiens
cattccgaggccaca

SEQ ID NO: 2424 - DNA, 15 bp, Homo sapiens
acattccgaggccac

SEQ ID NO: 2425 - DNA, 15 bp, Homo sapiens
cacattccgaggcca

SEQ ID NO: 2426 - DNA, 15 bp, Homo sapiens
tcacattccgaggcc

SEQ ID NO: 2427 - DNA, 15 bp, Homo sapiens
ctcacattccgaggc

SEQ ID NO: 2428 - DNA, 15 bp, Homo sapiens
gctcacattccgagg

SEQ ID NO: 2429 - DNA, 15 bp, Homo sapiens
tgctcacattccgag

SEQ ID NO: 2430 - DNA, 15 bp, Homo sapiens
gtgctcacattccga

SEQ ID NO: 2431 - DNA, 15 bp, Homo sapiens
ggtgctcacattccg

SEQ ID NO: 2432 - DNA, 15 bp, Homo sapiens
gggtgctcacattcc

SEQ ID NO: 2433 - DNA, 15 bp, Homo sapiens
agggtgctcacattc

SEQ ID NO: 2434 - DNA, 15 bp, Homo sapiens
gagggtgctcacatt

SEQ ID NO: 2435 - DNA, 15 bp, Homo sapiens
ggagggtgctcacat

SEQ ID NO: 2436 - DNA, 15 bp, Homo sapiens
gggagggtgctcaca

SEQ ID NO: 2437 - DNA, 15 bp, Homo sapiens
tgggagggtgctcac

SEQ ID NO: 2438 - DNA, 15 bp, Homo sapiens
atgggagggtgctca

SEQ ID NO: 2439 - DNA, 15 bp, Homo sapiens
gatgggagggtgctc

SEQ ID NO: 2440 - DNA, 15 bp, Homo sapiens
ggatgggagggtgct

SEQ ID NO: 2441 - DNA, 15 bp, Homo sapiens
aggatgggagggtgc

SEQ ID NO: 2442 - DNA, 15 bp, Homo sapiens
taggatgggagggtg

SEQ ID NO: 2443 - DNA, 15 bp, Homo sapiens
gtaggatgggagggt

SEQ ID NO: 2444 - DNA, 15 bp, Homo sapiens
ggtaggatgggaggg

SEQ ID NO: 2445 - DNA, 15 bp, Homo sapiens
gggtaggatgggagg

SEQ ID NO: 2446 - DNA, 15 bp, Homo sapiens
agggtaggatgggag

SEQ ID NO: 2447 - DNA, 15 bp, Homo sapiens
gagggtaggatggga

SEQ ID NO: 2448 - DNA, 15 bp, Homo sapiens
ggagggtaggatggg

SEQ ID NO: 2449 - DNA, 15 bp, Homo sapiens
gggagggtaggatgg

SEQ ID NO: 2450 - DNA, 15 bp, Homo sapiens
ggggagggtaggatg

SEQ ID NO: 2451 - DNA, 15 bp, Homo sapiens
aggggagggtaggat

SEQ ID NO: 2452 - DNA, 15 bp, Homo sapiens
aaggggagggtagga

SEQ ID NO: 2453 - DNA, 15 bp, Homo sapiens
gaaggggagggtagg

SEQ ID NO: 2454 - DNA, 15 bp, Homo sapiens
cgaaggggagggtag

SEQ ID NO: 2455 - DNA, 15 bp, Homo sapiens
gcgaaggggagggta

SEQ ID NO: 2456 - DNA, 15 bp, Homo sapiens
ggcgaaggggagggt

SEQ ID NO: 2457 - DNA, 15 bp, Homo sapiens
cggcgaaggggaggg

SEQ ID NO: 2458 - DNA, 15 bp, Homo sapiens
ccggcgaaggggagg

SEQ ID NO: 2459 - DNA, 15 bp, Homo sapiens
gccggcgaaggggag

SEQ ID NO: 2460 - DNA, 15 bp, Homo sapiens
cgccggcgaagggga

SEQ ID NO: 2461 - DNA, 15 bp, Homo sapiens
tcgccggcgaagggg

SEQ ID NO: 2462 - DNA, 15 bp, Homo sapiens
atcgccggcgaaggg

SEQ ID NO: 2463 - DNA, 15 bp, Homo sapiens
gatcgccggcgaagg

SEQ ID NO: 2464 - DNA, 15 bp, Homo sapiens
agatcgccggcgaag

SEQ ID NO: 2465 - DNA, 15 bp, Homo sapiens
aagatcgccggcgaa

SEQ ID NO: 2466 - DNA, 15 bp, Homo sapiens
gaagatcgccggcga

SEQ ID NO: 2467 - DNA, 15 bp, Homo sapiens
ggaagatcgccggcg

SEQ ID NO: 2468 - DNA, 15 bp, Homo sapiens
tggaagatcgccggc

SEQ ID NO: 2469 - DNA, 15 bp, Homo sapiens
ctggaagatcgccgg

SEQ ID NO: 2470 - DNA, 15 bp, Homo sapiens
actggaagatcgccg

SEQ ID NO: 2471 - DNA, 15 bp, Homo sapiens
aactggaagatcgcc

SEQ ID NO: 2472 - DNA, 15 bp, Homo sapiens
taactggaagatcgc

SEQ ID NO: 2473 - DNA, 15 bp, Homo sapiens
gtaactggaagatcg

SEQ ID NO: 2474 - DNA, 15 bp, Homo sapiens
tgtaactggaagatc

SEQ ID NO: 2475 - DNA, 15 bp, Homo sapiens
atgtaactggaagat

SEQ ID NO: 2476 - DNA, 15 bp, Homo sapiens
tatgtaactggaaga

SEQ ID NO: 2477 - DNA, 15 bp, Homo sapiens
ttatgtaactggaag

SEQ ID NO: 2478 - DNA, 15 bp, Homo sapiens
cttatgtaactggaa

SEQ ID NO: 2479 - DNA, 15 bp, Homo sapiens
acttatgtaactgga

SEQ ID NO: 2480 - DNA, 15 bp, Homo sapiens
cacttatgtaactgg

SEQ ID NO: 2481 - DNA, 15 bp, Homo sapiens
ccacttatgtaactg

SEQ ID NO: 2482 - DNA, 15 bp, Homo sapiens
tccacttatgtaact

SEQ ID NO: 2483 - DNA, 15 bp, Homo sapiens
ctccacttatgtaac

SEQ ID NO: 2484 - DNA, 15 bp, Homo sapiens
actccacttatgtaa

SEQ ID NO: 2485 - DNA, 15 bp, Homo sapiens
cactccacttatgta

SEQ ID NO: 2486 - DNA, 15 bp, Homo sapiens
ccactccacttatgt

SEQ ID NO: 2487 - DNA, 15 bp, Homo sapiens
cccactccacttatg

SEQ ID NO: 2488 - DNA, 15 bp, Homo sapiens
tcccactccacttat

SEQ ID NO: 2489 - DNA, 15 bp, Homo sapiens
gtcccactccactta

SEQ ID NO: 2490 - DNA, 15 bp, Homo sapiens
tgtcccactccactt

SEQ ID NO: 2491 - DNA, 15 bp, Homo sapiens
atgtcccactccact

SEQ ID NO: 2492 - DNA, 15 bp, Homo sapiens
tatgtcccactccac

SEQ ID NO: 2493 - DNA, 15 bp, Homo sapiens
ctatgtcccactcca

SEQ ID NO: 2494 - DNA, 15 bp, Homo sapiens
actatgtcccactcc

SEQ ID NO: 2495 - DNA, 15 bp, Homo sapiens
tactatgtcccactc

SEQ ID NO: 2496 - DNA, 15 bp, Homo sapiens
ctactatgtcccact

SEQ ID NO: 2497 - DNA, 15 bp, Homo sapiens
cctactatgtcccac

SEQ ID NO: 2498 - DNA, 15 bp, Homo sapiens
acctactatgtccca

SEQ ID NO: 2499 - DNA, 15 bp, Homo sapiens
tacctactatgtccc

SEQ ID NO: 2500 - DNA, 15 bp, Homo sapiens
ttacctactatgtcc

SEQ ID NO: 2501 - DNA, 15 bp, Homo sapiens
gttacctactatgtc

SEQ ID NO: 2502 - DNA, 15 bp, Homo sapiens
cgttacctactatgt

SEQ ID NO: 2503 - DNA, 15 bp, Homo sapiens
ccgttacctactatg

SEQ ID NO: 2504 - DNA, 15 bp, Homo sapiens
cccgttacctactat

SEQ ID NO: 2505 - DNA, 15 bp, Homo sapiens
gcccgttacctacta

SEQ ID NO: 2506 - DNA, 15 bp, Homo sapiens
agcccgttacctact

SEQ ID NO: 2507 - DNA, 15 bp, Homo sapiens
gagcccgttacctac

SEQ ID NO: 2508 - DNA, 15 bp, Homo sapiens
agagcccgttaccta

SEQ ID NO: 2509 - DNA, 15 bp, Homo sapiens
gagagcccgttacct

SEQ ID NO: 2510 - DNA, 15 bp, Homo sapiens
tgagagcccgttacc

SEQ ID NO: 2511 - DNA, 15 bp, Homo sapiens
atgagagcccgttac

SEQ ID NO: 2512 - DNA, 15 bp, Homo sapiens
gatgagagcccgtta

SEQ ID NO: 2513 - DNA, 15 bp, Homo sapiens
cgatgagagcccgtt

SEQ ID NO: 2514 - DNA, 15 bp, Homo sapiens
gcgatgagagcccgt

SEQ ID NO: 2515 - DNA, 15 bp, Homo sapiens
ggcgatgagagcccg

SEQ ID NO: 2516 - DNA, 15 bp, Homo sapiens
gggcgatgagagccc

SEQ ID NO: 2517 - DNA, 15 bp, Homo sapiens
agggcgatgagagcc

SEQ ID NO: 2518 - DNA, 15 bp, Homo sapiens
cagggcgatgagagc

SEQ ID NO: 2519 - DNA, 15 bp, Homo sapiens
ccagggcgatgagag

SEQ ID NO: 2520 - DNA, 15 bp, Homo sapiens
tccagggcgatgaga

SEQ ID NO: 2521 - DNA, 15 bp, Homo sapiens
ctccagggcgatgag

SEQ ID NO: 2522 - DNA, 15 bp, Homo sapiens
gctccagggcgatga

SEQ ID NO: 2523 - DNA, 15 bp, Homo sapiens
cgctccagggcgatg

SEQ ID NO: 2524 - DNA, 15 bp, Homo sapiens
gcgctccagggcgat

SEQ ID NO: 2525 - DNA, 15 bp, Homo sapiens
agcgctccagggcga

SEQ ID NO: 2526 - DNA, 15 bp, Homo sapiens
gagcgctccagggcg

SEQ ID NO: 2527 - DNA, 15 bp, Homo sapiens
cgagcgctccagggc

SEQ ID NO: 2528 - DNA, 15 bp, Homo sapiens
ccgagcgctccaggg

SEQ ID NO: 2529 - DNA, 15 bp, Homo sapiens
cccgagcgctccagg

SEQ ID NO: 2530 - DNA, 15 bp, Homo sapiens
tcccgagcgctccag

SEQ ID NO: 2531 - DNA, 15 bp, Homo sapiens
atcccgagcgctcca

SEQ ID NO: 2532 - DNA, 15 bp, Homo sapiens
gatcccgagcgctcc

SEQ ID NO: 2533 - DNA, 15 bp, Homo sapiens
tgatcccgagcgctc

SEQ ID NO: 2534 - DNA, 15 bp, Homo sapiens
gtgatcccgagcgct

SEQ ID NO: 2535 - DNA, 15 bp, Homo sapiens
ggtgatcccgagcgc

SEQ ID NO: 2536 - DNA, 15 bp, Homo sapiens
cggtgatcccgagcg

SEQ ID NO: 2537 - DNA, 15 bp, Homo sapiens
ccggtgatcccgagc

SEQ ID NO: 2538 - DNA, 15 bp, Homo sapiens
accggtgatcccgag

SEQ ID NO: 2539 - DNA, 15 bp, Homo sapiens
taccggtgatcccga

SEQ ID NO: 2540 - DNA, 15 bp, Homo sapiens
gtaccggtgatcccg

SEQ ID NO: 2541 - DNA, 15 bp, Homo sapiens
ggtaccggtgatccc

SEQ ID NO: 2542 - DNA, 15 bp, Homo sapiens
tggtaccggtgatcc

SEQ ID NO: 2543 - DNA, 15 bp, Homo sapiens
ctggtaccggtgatc

SEQ ID NO: 2544 - DNA, 15 bp, Homo sapiens
tctggtaccggtgat

SEQ ID NO: 2545 - DNA, 15 bp, Homo sapiens
atctggtaccggtga

SEQ ID NO: 2546 - DNA, 15 bp, Homo sapiens
catctggtaccggtg

SEQ ID NO: 2547 - DNA, 15 bp, Homo sapiens
ccatctggtaccggt

SEQ ID NO: 2548 - DNA, 15 bp, Homo sapiens
cccatctggtaccgg

SEQ ID NO: 2549 - DNA, 15 bp, Homo sapiens
ccccatctggtaccg

SEQ ID NO: 2550 - DNA, 15 bp, Homo sapiens
gccccatctggtacc

SEQ ID NO: 2551 - DNA, 15 bp, Homo sapiens
tgccccatctggtac

SEQ ID NO: 2552 - DNA, 15 bp, Homo sapiens
ttgccccatctggta

SEQ ID NO: 2553 - DNA, 15 bp, Homo sapiens
cttgccccatctggt

SEQ ID NO: 2554 - DNA, 15 bp, Homo sapiens
acttgccccatctgg

SEQ ID NO: 2555 - DNA, 15 bp, Homo sapiens
aacttgccccatctg

SEQ ID NO: 2556 - DNA, 15 bp, Homo sapiens
gaacttgccccatct

SEQ ID NO: 2557 - DNA, 15 bp, Homo sapiens
tgaacttgccccatc

SEQ ID NO: 2558 - DNA, 15 bp, Homo sapiens
atgaacttgccccat

SEQ ID NO: 2559 - DNA, 15 bp, Homo sapiens
gatgaacttgcccca

SEQ ID NO: 2560 - DNA, 15 bp, Homo sapiens
cgatgaacttgcccc

SEQ ID NO: 2561 - DNA, 15 bp, Homo sapiens
gcgatgaacttgccc

SEQ ID NO: 2562 - DNA, 15 bp, Homo sapiens
cgcgatgaacttgcc

SEQ ID NO: 2563 - DNA, 15 bp, Homo sapiens
tcgcgatgaacttgc

SEQ ID NO: 2564 - DNA, 15 bp, Homo sapiens
gtcgcgatgaacttg

SEQ ID NO: 2565 - DNA, 15 bp, Homo sapiens
cgtcgcgatgaactt

SEQ ID NO: 2566 - DNA, 15 bp, Homo sapiens
gcgtcgcgatgaact

SEQ ID NO: 2567 - DNA, 15 bp, Homo sapiens
agcgtcgcgatgaac

SEQ ID NO: 2568 - DNA, 15 bp, Homo sapiens
cagcgtcgcgatgaa

SEQ ID NO: 2569 - DNA, 15 bp, Homo sapiens
acagcgtcgcgatga

SEQ ID NO: 2570 - DNA, 15 bp, Homo sapiens
cacagcgtcgcgatg

SEQ ID NO: 2571 - DNA, 15 bp, Homo sapiens
ccacagcgtcgcgat

SEQ ID NO: 2572 - DNA, 15 bp, Homo sapiens
gccacagcgtcgcga

SEQ ID NO: 2573 - DNA, 15 bp, Homo sapiens
agccacagcgtcgcg

SEQ ID NO: 2574 - DNA, 15 bp, Homo sapiens
gagccacagcgtcgc

SEQ ID NO: 2575 - DNA, 15 bp, Homo sapiens
ggagccacagcgtcg

SEQ ID NO: 2576 - DNA, 15 bp, Homo sapiens
aggagccacagcgtc

SEQ ID NO: 2577 - DNA, 15 bp, Homo sapiens
caggagccacagcgt

SEQ ID NO: 2578 - DNA, 15 bp, Homo sapiens
acaggagccacagcg

SEQ ID NO: 2579 - DNA, 15 bp, Homo sapiens
aacaggagccacagc

SEQ ID NO: 2580 - DNA, 15 bp, Homo sapiens
taacaggagccacag

SEQ ID NO: 2581 - DNA, 15 bp, Homo sapiens
ttaacaggagccaca

SEQ ID NO: 2582 - DNA, 15 bp, Homo sapiens
attaacaggagccac

SEQ ID NO: 2583 - DNA, 15 bp, Homo sapiens
aattaacaggagcca

SEQ ID NO: 2584 - DNA, 15 bp, Homo sapiens
caattaacaggagcc

SEQ ID NO: 2585 - DNA, 15 bp, Homo sapiens
acaattaacaggagc

SEQ ID NO: 2586 - DNA, 15 bp, Homo sapiens
cacaattaacaggag

SEQ ID NO: 2587 - DNA, 15 bp, Homo sapiens
gcacaattaacagga

SEQ ID NO: 2588 - DNA, 15 bp, Homo sapiens
ggcacaattaacagg

SEQ ID NO: 2589 - DNA, 15 bp, Homo sapiens
aggcacaattaacag

SEQ ID NO: 2590 - DNA, 15 bp, Homo sapiens
caggcacaattaaca

SEQ ID NO: 2591 - DNA, 15 bp, Homo sapiens
tcaggcacaattaac

SEQ ID NO: 2592 - DNA, 15 bp, Homo sapiens
ttcaggcacaattaa

SEQ ID NO: 2593 - DNA, 15 bp, Homo sapiens
tttcaggcacaatta

SEQ ID NO: 2594 - DNA, 15 bp, Homo sapiens
ctttcaggcacaatt

SEQ ID NO: 2595 - DNA, 15 bp, Homo sapiens
cctttcaggcacaat

SEQ ID NO: 2596 - DNA, 15 bp, Homo sapiens
acctttcaggcacaa

SEQ ID NO: 2597 - DNA, 15 bp, Homo sapiens
aacctttcaggcaca

SEQ ID NO: 2598 - DNA, 15 bp, Homo sapiens
taacctttcaggcac

SEQ ID NO: 2599 - DNA, 15 bp, Homo sapiens
ataacctttcaggca

SEQ ID NO: 2600 - DNA, 15 bp, Homo sapiens
gataacctttcaggc

SEQ ID NO: 2601 - DNA, 15 bp, Homo sapiens
ggataacctttcagg

SEQ ID NO: 2602 - DNA, 15 bp, Homo sapiens
aggataacctttcag

SEQ ID NO: 2603 - DNA, 15 bp, Homo sapiens
gaggataacctttca

SEQ ID NO: 2604 - DNA, 15 bp, Homo sapiens
agaggataacctttc

SEQ ID NO: 2605 - DNA, 15 bp, Homo sapiens
cagaggataaccttt

SEQ ID NO: 2606 - DNA, 15 bp, Homo sapiens
acagaggataacctt

SEQ ID NO: 2607 - DNA, 15 bp, Homo sapiens
aacagaggataacct

SEQ ID NO: 2608 - DNA, 15 bp, Homo sapiens
gaacagaggataacc

SEQ ID NO: 2609 - DNA, 15 bp, Homo sapiens
tgaacagaggataac

SEQ ID NO: 2610 - DNA, 15 bp, Homo sapiens
ctgaacagaggataa

SEQ ID NO: 2611 - DNA, 15 bp, Homo sapiens
actgaacagaggata

SEQ ID NO: 2612 - DNA, 15 bp, Homo sapiens
aactgaacagaggat

SEQ ID NO: 2613 - DNA, 15 bp, Homo sapiens
aaactgaacagagga

SEQ ID NO: 2614 - DNA, 15 bp, Homo sapiens
caaactgaacagagg

SEQ ID NO: 2615 - DNA, 15 bp, Homo sapiens
ccaaactgaacagag

SEQ ID NO: 2616 - DNA, 15 bp, Homo sapiens
accaaactgaacaga

SEQ ID NO: 2617 - DNA, 15 bp, Homo sapiens
gaccaaactgaacag

SEQ ID NO: 2618 - DNA, 15 bp, Homo sapiens
tgaccaaactgaaca

SEQ ID NO: 2619 - DNA, 15 bp, Homo sapiens
atgaccaaactgaac

SEQ ID NO: 2620 - DNA, 15 bp, Homo sapiens
catgaccaaactgaa

SEQ ID NO: 2621 - DNA, 15 bp, Homo sapiens
tcatgaccaaactga

SEQ ID NO: 2622 - DNA, 15 bp, Homo sapiens
gtcatgaccaaactg

SEQ ID NO: 2623 - DNA, 15 bp, Homo sapiens
ggtcatgaccaaact

SEQ ID NO: 2624 - DNA, 15 bp, Homo sapiens
cggtcatgaccaaac

SEQ ID NO: 2625 - DNA, 15 bp, Homo sapiens
tcggtcatgaccaaa

SEQ ID NO: 2626 - DNA, 15 bp, Homo sapiens
ttcggtcatgaccaa

SEQ ID NO: 2627 - DNA, 15 bp, Homo sapiens
attcggtcatgacca

SEQ ID NO: 2628 - DNA, 15 bp, Homo sapiens
gattcggtcatgacc

SEQ ID NO: 2629 - DNA, 15 bp, Homo sapiens
tgattcggtcatgac

SEQ ID NO: 2630 - DNA, 15 bp, Homo sapiens
gtgattcggtcatga

SEQ ID NO: 2631 - DNA, 15 bp, Homo sapiens
ggtgattcggtcatg

SEQ ID NO: 2632 - DNA, 15 bp, Homo sapiens
gggtgattcggtcat

SEQ ID NO: 2633 - DNA, 15 bp, Homo sapiens
tgggtgattcggtca

SEQ ID NO: 2634 - DNA, 15 bp, Homo sapiens
ttgggtgattcggtc

SEQ ID NO: 2635 - DNA, 15 bp, Homo sapiens
tttgggtgattcggt

SEQ ID NO: 2636 - DNA, 15 bp, Homo sapiens
gtttgggtgattcgg

SEQ ID NO: 2637 - DNA, 15 bp, Homo sapiens
agtttgggtgattcg

SEQ ID NO: 2638 - DNA, 15 bp, Homo sapiens
cagtttgggtgattc

SEQ ID NO: 2639 - DNA, 15 bp, Homo sapiens
tcagtttgggtgatt

SEQ ID NO: 2640 - DNA, 15 bp, Homo sapiens
ttcagtttgggtgat

SEQ ID NO: 2641 - DNA, 15 bp, Homo sapiens
tttcagtttgggtga

SEQ ID NO: 2642 - DNA, 15 bp, Homo sapiens
gtttcagtttgggtg

SEQ ID NO: 2643 - DNA, 15 bp, Homo sapiens
agtttcagtttgggt

SEQ ID NO: 2644 - DNA, 15 bp, Homo sapiens
gagtttcagtttggg

SEQ ID NO: 2645 - DNA, 15 bp, Homo sapiens
tgagtttcagtttgg

SEQ ID NO: 2646 - DNA, 15 bp, Homo sapiens
ctgagtttcagtttg

SEQ ID NO: 2647 - DNA, 15 bp, Homo sapiens
tctgagtttcagttt

SEQ ID NO: 2648 - DNA, 15 bp, Homo sapiens
atctgagtttcagtt

SEQ ID NO: 2649 - DNA, 15 bp, Homo sapiens
catctgagtttcagt

SEQ ID NO: 2650 - DNA, 15 bp, Homo sapiens
tcatctgagtttcag

SEQ ID NO: 2651 - DNA, 15 bp, Homo sapiens
gtcatctgagtttca

SEQ ID NO: 2652 - DNA, 15 bp, Homo sapiens
agtcatctgagtttc

SEQ ID NO: 2653 - DNA, 15 bp, Homo sapiens
aagtcatctgagttt

SEQ ID NO: 2654 - DNA, 15 bp, Homo sapiens
aaagtcatctgagtt

SEQ ID NO: 2655 - DNA, 15 bp, Homo sapiens
aaaagtcatctgagt

SEQ ID NO: 2656 - DNA, 15 bp, Homo sapiens
taaaagtcatctgag

SEQ ID NO: 2657 - DNA, 15 bp, Homo sapiens
ataaaagtcatctga

SEQ ID NO: 2658 - DNA, 15 bp, Homo sapiens
tataaaagtcatctg

SEQ ID NO: 2659 - DNA, 15 bp, Homo sapiens
atataaaagtcatct

SEQ ID NO: 2660 - DNA, 15 bp, Homo sapiens
catataaaagtcatc

SEQ ID NO: 2661 - DNA, 15 bp, Homo sapiens
ccatataaaagtcat

SEQ ID NO: 2662 - DNA, 15 bp, Homo sapiens
gccatataaaagtca

SEQ ID NO: 2663 - DNA, 15 bp, Homo sapiens
tgccatataaaagtc

SEQ ID NO: 2664 - DNA, 15 bp, Homo sapiens
ctgccatataaaagt

SEQ ID NO: 2665 - DNA, 15 bp, Homo sapiens
actgccatataaaag

SEQ ID NO: 2666 - DNA, 15 bp, Homo sapiens
cactgccatataaaa

SEQ ID NO: 2667 - DNA, 15 bp, Homo sapiens
ccactgccatataaa

SEQ ID NO: 2668 - DNA, 15 bp, Homo sapiens
gccactgccatataa

SEQ ID NO: 2669 - DNA, 15 bp, Homo sapiens
tgccactgccatata

SEQ ID NO: 2670 - DNA, 15 bp, Homo sapiens
ttgccactgccatat

SEQ ID NO: 2671 - DNA, 15 bp, Homo sapiens
attgccactgccata

SEQ ID NO: 2672 - DNA, 15 bp, Homo sapiens
cattgccactgccat

SEQ ID NO: 2673 - DNA, 15 bp, Homo sapiens
acattgccactgcca

SEQ ID NO: 2674 - DNA, 15 bp, Homo sapiens
aacattgccactgcc

SEQ ID NO: 2675 - DNA, 15 bp, Homo sapiens
aaacattgccactgc

SEQ ID NO: 2676 - DNA, 15 bp, Homo sapiens
gaaacattgccactg

SEQ ID NO: 2677 - DNA, 15 bp, Homo sapiens
agaaacattgccact

SEQ ID NO: 2678 - DNA, 15 bp, Homo sapiens
cagaaacattgccac

SEQ ID NO: 2679 - DNA, 15 bp, Homo sapiens
acagaaacattgcca

SEQ ID NO: 2680 - DNA, 15 bp, Homo sapiens
cacagaaacattgcc

SEQ ID NO: 2681 - DNA, 15 bp, Homo sapiens
ccacagaaacattgc

SEQ ID NO: 2682 - DNA, 15 bp, Homo sapiens
accacagaaacattg

SEQ ID NO: 2683 - DNA, 15 bp, Homo sapiens
aaccacagaaacatt

SEQ ID NO: 2684 - DNA, 15 bp, Homo sapiens
aaaccacagaaacat

SEQ ID NO: 2685 - DNA, 15 bp, Homo sapiens
aaaaccacagaaaca

SEQ ID NO: 2686 - DNA, 15 bp, Homo sapiens
caaaaccacagaaac

SEQ ID NO: 2687 - DNA, 15 bp, Homo sapiens
gcaaaaccacagaaa

SEQ ID NO: 2688 - DNA, 15 bp, Homo sapiens
tgcaaaaccacagaa

SEQ ID NO: 2689 - DNA, 15 bp, Homo sapiens
gtgcaaaaccacaga

SEQ ID NO: 2690 - DNA, 15 bp, Homo sapiens
agtgcaaaaccacag

SEQ ID NO: 2691 - DNA, 15 bp, Homo sapiens
tagtgcaaaaccaca

SEQ ID NO: 2692 - DNA, 15 bp, Homo sapiens
ttagtgcaaaaccac

SEQ ID NO: 2693 - DNA, 15 bp, Homo sapiens
tttagtgcaaaacca

SEQ ID NO: 2694 - DNA, 15 bp, Homo sapiens
ctttagtgcaaaacc

SEQ ID NO: 2695 - DNA, 15 bp, Homo sapiens
tctttagtgcaaaac

SEQ ID NO: 2696 - DNA, 15 bp, Homo sapiens
gtctttagtgcaaaa

SEQ ID NO: 2697 - DNA, 15 bp, Homo sapiens
agtctttagtgcaaa

SEQ ID NO: 2698 - DNA, 15 bp, Homo sapiens
aagtctttagtgcaa

SEQ ID NO: 2699 - DNA, 15 bp, Homo sapiens
taagtctttagtgca

SEQ ID NO: 2700 - DNA, 15 bp, Homo sapiens
ttaagtctttagtgc

SEQ ID NO: 2701 - DNA, 15 bp, Homo sapiens
cttaagtctttagtg

SEQ ID NO: 2702 - DNA, 15 bp, Homo sapiens
ccttaagtctttagt

SEQ ID NO: 2703 - DNA, 15 bp, Homo sapiens
accttaagtctttag

SEQ ID NO: 2704 - DNA, 15 bp, Homo sapiens
gaccttaagtcttta

SEQ ID NO: 2705 - DNA, 15 bp, Homo sapiens
tgaccttaagtcttt

SEQ ID NO: 2706 - DNA, 15 bp, Homo sapiens
atgaccttaagtctt

SEQ ID NO: 2707 - DNA, 15 bp, Homo sapiens
aatgaccttaagtct

SEQ ID NO: 2708 - DNA, 15 bp, Homo sapiens
taatgaccttaagtc

SEQ ID NO: 2709 - DNA, 15 bp, Homo sapiens
ataatgaccttaagt

SEQ ID NO: 2710 - DNA, 15 bp, Homo sapiens
cataatgaccttaag

SEQ ID NO: 2711 - DNA, 15 bp, Homo sapiens
tcataatgaccttaa

SEQ ID NO: 2712 - DNA, 15 bp, Homo sapiens
ttcataatgacctta

SEQ ID NO: 2713 - DNA, 15 bp, Homo sapiens
cttcataatgacctt

SEQ ID NO: 2714 - DNA, 15 bp, Homo sapiens
tcttcataatgacct

SEQ ID NO: 2715 - DNA, 15 bp, Homo sapiens
ctcttcataatgacc

SEQ ID NO: 2716 - DNA, 15 bp, Homo sapiens
actcttcataatgac

SEQ ID NO: 2717 - DNA, 15 bp, Homo sapiens
cactcttcataatga

SEQ ID NO: 2718 - DNA, 15 bp, Homo sapiens
acactcttcataatg

SEQ ID NO: 2719 - DNA, 15 bp, Homo sapiens
tacactcttcataat

SEQ ID NO: 2720 - DNA, 15 bp, Homo sapiens
ttacactcttcataa

SEQ ID NO: 2721 - DNA, 15 bp, Homo sapiens
tttacactcttcata

SEQ ID NO: 2722 - DNA, 15 bp, Homo sapiens
ttttacactcttcat

SEQ ID NO: 2723 - DNA, 15 bp, Homo sapiens
cttttacactcttca

SEQ ID NO: 2724 - DNA, 15 bp, Homo sapiens
ccttttacactcttc

SEQ ID NO: 2725 - DNA, 15 bp, Homo sapiens
tccttttacactctt

SEQ ID NO: 2726 - DNA, 15 bp, Homo sapiens
atccttttacactct

SEQ ID NO: 2727 - DNA, 15 bp, Homo sapiens
aatccttttacactc

SEQ ID NO: 2728 - DNA, 15 bp, Homo sapiens
caatccttttacact

SEQ ID NO: 2729 - DNA, 15 bp, Homo sapiens
gcaatccttttacac

SEQ ID NO: 2730 - DNA, 15 bp, Homo sapiens
agcaatccttttaca

SEQ ID NO: 2731 - DNA, 15 bp, Homo sapiens
cagcaatccttttac

SEQ ID NO: 2732 - DNA, 15 bp, Homo sapiens
acagcaatcctttta

SEQ ID NO: 2733 - DNA, 15 bp, Homo sapiens
gacagcaatcctttt

SEQ ID NO: 2734 - DNA, 15 bp, Homo sapiens
cgacagcaatccttt

SEQ ID NO: 2735 - DNA, 15 bp, Homo sapiens
gcgacagcaatcctt

SEQ ID NO: 2736 - DNA, 15 bp, Homo sapiens
tgcgacagcaatcct

SEQ ID NO: 2737 - DNA, 15 bp, Homo sapiens
ctgcgacagcaatcc

SEQ ID NO: 2738 - DNA, 15 bp, Homo sapiens
cctgcgacagcaatc

SEQ ID NO: 2739 - DNA, 15 bp, Homo sapiens
ccctgcgacagcaat

SEQ ID NO: 2740 - DNA, 15 bp, Homo sapiens
cccctgcgacagcaa

SEQ ID NO: 2741 - DNA, 15 bp, Homo sapiens
tcccctgcgacagca

SEQ ID NO: 2742 - DNA, 15 bp, Homo sapiens
ctcccctgcgacagc

SEQ ID NO: 2743 - DNA, 15 bp, Homo sapiens
tctcccctgcgacag

SEQ ID NO: 2744 - DNA, 15 bp, Homo sapiens
gtctcccctgcgaca

SEQ ID NO: 2745 - DNA, 15 bp, Homo sapiens
ggtctcccctgcgac

SEQ ID NO: 2746 - DNA, 15 bp, Homo sapiens
cggtctcccctgcga

SEQ ID NO: 2747 - DNA, 15 bp, Homo sapiens
acggtctcccctgcg

SEQ ID NO: 2748 - DNA, 15 bp, Homo sapiens
aacggtctcccctgc

SEQ ID NO: 2749 - DNA, 15 bp, Homo sapiens
aaacggtctcccctg

SEQ ID NO: 2750 - DNA, 15 bp, Homo sapiens
taaacggtctcccct

SEQ ID NO: 2751 - DNA, 15 bp, Homo sapiens
ataaacggtctcccc

SEQ ID NO: 2752 - DNA, 15 bp, Homo sapiens
cataaacggtctccc

SEQ ID NO: 2753 - DNA, 15 bp, Homo sapiens
tcataaacggtctcc

SEQ ID NO: 2754 - DNA, 15 bp, Homo sapiens
gtcataaacggtctc

SEQ ID NO: 2755 - DNA, 15 bp, Homo sapiens
tgtcataaacggtct

SEQ ID NO: 2756 - DNA, 15 bp, Homo sapiens
atgtcataaacggtc

SEQ ID NO: 2757 - DNA, 15 bp, Homo sapiens
aatgtcataaacggt

SEQ ID NO: 2758 - DNA, 15 bp, Homo sapiens
caatgtcataaacgg

SEQ ID NO: 2759 - DNA, 15 bp, Homo sapiens
gcaatgtcataaacg

SEQ ID NO: 2760 - DNA, 15 bp, Homo sapiens
agcaatgtcataaac

SEQ ID NO: 2761 - DNA, 15 bp, Homo sapiens
tagcaatgtcataaa

SEQ ID NO: 2762 - DNA, 15 bp, Homo sapiens
ttagcaatgtcataa

SEQ ID NO: 2763 - DNA, 15 bp, Homo sapiens
cttagcaatgtcata

SEQ ID NO: 2764 - DNA, 15 bp, Homo sapiens
acttagcaatgtcat

SEQ ID NO: 2765 - DNA, 15 bp, Homo sapiens
tacttagcaatgtca

SEQ ID NO: 2766 - DNA, 15 bp, Homo sapiens
atacttagcaatgtc

SEQ ID NO: 2767 - DNA, 15 bp, Homo sapiens
catacttagcaatgt

SEQ ID NO: 2768 - DNA, 15 bp, Homo sapiens
ccatacttagcaatg

SEQ ID NO: 2769 - DNA, 15 bp, Homo sapiens
tccatacttagcaat

SEQ ID NO: 2770 - DNA, 15 bp, Homo sapiens
gtccatacttagcaa

SEQ ID NO: 2771 - DNA, 15 bp, Homo sapiens
ggtccatacttagca

SEQ ID NO: 2772 - DNA, 15 bp, Homo sapiens
gggtccatacttagc

SEQ ID NO: 2773 - DNA, 15 bp, Homo sapiens
ggggtccatacttag

SEQ ID NO: 2774 - DNA, 15 bp, Homo sapiens
cggggtccatactta

SEQ ID NO: 2775 - DNA, 15 bp, Homo sapiens
tcggggtccatactt

SEQ ID NO: 2776 - DNA, 15 bp, Homo sapiens
ctcggggtccatact

SEQ ID NO: 2777 - DNA, 15 bp, Homo sapiens
cctcggggtccatac

SEQ ID NO: 2778 - DNA, 15 bp, Homo sapiens
ccctcggggtccata

SEQ ID NO: 2779 - DNA, 15 bp, Homo sapiens
cccctcggggtccat

SEQ ID NO: 2780 - DNA, 15 bp, Homo sapiens
ccccctcggggtcca

SEQ ID NO: 2781 - DNA, 15 bp, Homo sapiens
tccccctcggggtcc

SEQ ID NO: 2782 - DNA, 15 bp, Homo sapiens
ttccccctcggggtc

SEQ ID NO: 2783 - DNA, 15 bp, Homo sapiens
tttccccctcggggt

SEQ ID NO: 2784 - DNA, 15 bp, Homo sapiens
ttttccccctcgggg

SEQ ID NO: 2785 - DNA, 15 bp, Homo sapiens
tttttccccctcggg

SEQ ID NO: 2786 - DNA, 15 bp, Homo sapiens
ctttttccccctcgg

SEQ ID NO: 2787 - DNA, 15 bp, Homo sapiens
gctttttccccctcg

SEQ ID NO: 2788 - DNA, 15 bp, Homo sapiens
agctttttccccctc

SEQ ID NO: 2789 - DNA, 15 bp, Homo sapiens
gagctttttccccct

SEQ ID NO: 2790 - DNA, 15 bp, Homo sapiens
tgagctttttccccc

SEQ ID NO: 2791 - DNA, 15 bp, Homo sapiens
atgagctttttcccc

SEQ ID NO: 2792 - DNA, 15 bp, Homo sapiens
aatgagctttttccc

SEQ ID NO: 2793 - DNA, 15 bp, Homo sapiens
gaatgagctttttcc

SEQ ID NO: 2794 - DNA, 15 bp, Homo sapiens
agaatgagctttttc

SEQ ID NO: 2795 - DNA, 15 bp, Homo sapiens
cagaatgagcttttt

SEQ ID NO: 2796 - DNA, 15 bp, Homo sapiens
ccagaatgagctttt

SEQ ID NO: 2797 - DNA, 15 bp, Homo sapiens
tccagaatgagcttt

SEQ ID NO: 2798 - DNA, 15 bp, Homo sapiens
ttccagaatgagctt

SEQ ID NO: 2799 - DNA, 15 bp, Homo sapiens
attccagaatgagct

SEQ ID NO: 2800 - DNA, 15 bp, Homo sapiens
aattccagaatgagc

SEQ ID NO: 2801 - DNA, 15 bp, Homo sapiens
caattccagaatgag

SEQ ID NO: 2802 - DNA, 15 bp, Homo sapiens
gcaattccagaatga

SEQ ID NO: 2803 - DNA, 15 bp, Homo sapiens
agcaattccagaatg

SEQ ID NO: 2804 - DNA, 15 bp, Homo sapiens
gagcaattccagaat

SEQ ID NO: 2805 - DNA, 15 bp, Homo sapiens
agagcaattccagaa

SEQ ID NO: 2806 - DNA, 15 bp, Homo sapiens
cagagcaattccaga

SEQ ID NO: 2807 - DNA, 15 bp, Homo sapiens
acagagcaattccag

SEQ ID NO: 2808 - DNA, 15 bp, Homo sapiens
cacagagcaattcca

SEQ ID NO: 2809 - DNA, 15 bp, Homo sapiens
ccacagagcaattcc

SEQ ID NO: 2810 - DNA, 15 bp, Homo sapiens
gccacagagcaattc

SEQ ID NO: 2811 - DNA, 15 bp, Homo sapiens
cgccacagagcaatt

SEQ ID NO: 2812 - DNA, 15 bp, Homo sapiens
ccgccacagagcaat

SEQ ID NO: 2813 - DNA, 15 bp, Homo sapiens
accgccacagagcaa

SEQ ID NO: 2814 - DNA, 15 bp, Homo sapiens
aaccgccacagagca

SEQ ID NO: 2815 - DNA, 15 bp, Homo sapiens
caaccgccacagagc

SEQ ID NO: 2816 - DNA, 15 bp, Homo sapiens
gcaaccgccacagag

SEQ ID NO: 2817 - DNA, 15 bp, Homo sapiens
agcaaccgccacaga

SEQ ID NO: 2818 - DNA, 15 bp, Homo sapiens
aagcaaccgccacag

SEQ ID NO: 2819 - DNA, 15 bp, Homo sapiens
gaagcaaccgccaca

SEQ ID NO: 2820 - DNA, 15 bp, Homo sapiens
agaagcaaccgccac

SEQ ID NO: 2821 - DNA, 15 bp, Homo sapiens
cagaagcaaccgcca

SEQ ID NO: 2822 - DNA, 15 bp, Homo sapiens
acagaagcaaccgcc

SEQ ID NO: 2823 - DNA, 15 bp, Homo sapiens
aacagaagcaaccgc

SEQ ID NO: 2824 - DNA, 15 bp, Homo sapiens
caacagaagcaaccg

SEQ ID NO: 2825 - DNA, 15 bp, Homo sapiens
gcaacagaagcaacc

SEQ ID NO: 2826 - DNA, 15 bp, Homo sapiens
cgcaacagaagcaac

SEQ ID NO: 2827 - DNA, 15 bp, Homo sapiens
tcgcaacagaagcaa

SEQ ID NO: 2828 - DNA, 15 bp, Homo sapiens
ctcgcaacagaagca

SEQ ID NO: 2829 - DNA, 15 bp, Homo sapiens
actcgcaacagaagc

SEQ ID NO: 2830 - DNA, 15 bp, Homo sapiens
cactcgcaacagaag

SEQ ID NO: 2831 - DNA, 15 bp, Homo sapiens
acactcgcaacagaa

SEQ ID NO: 2832 - DNA, 15 bp, Homo sapiens
cacactcgcaacaga

SEQ ID NO: 2833 - DNA, 15 bp, Homo sapiens
acacactcgcaacag

SEQ ID NO: 2834 - DNA, 15 bp, Homo sapiens
aacacactcgcaaca

SEQ ID NO: 2835 - DNA, 15 bp, Homo sapiens
gaacacactcgcaac

SEQ ID NO: 2836 - DNA, 15 bp, Homo sapiens
cgaacacactcgcaa

SEQ ID NO: 2837 - DNA, 15 bp, Homo sapiens
ccgaacacactcgca

SEQ ID NO: 2838 - DNA, 15 bp, Homo sapiens
cccgaacacactcgc

SEQ ID NO: 2839 - DNA, 15 bp, Homo sapiens
acccgaacacactcg

SEQ ID NO: 2840 - DNA, 15 bp, Homo sapiens
cacccgaacacactc

SEQ ID NO: 2841 - DNA, 15 bp, Homo sapiens
acacccgaacacact

SEQ ID NO: 2842 - DNA, 15 bp, Homo sapiens
cacacccgaacacac

SEQ ID NO: 2843 - DNA, 15 bp, Homo sapiens
ccacacccgaacaca

SEQ ID NO: 2844 - DNA, 15 bp, Homo sapiens
cccacacccgaacac

SEQ ID NO: 2845 - DNA, 15 bp, Homo sapiens
acccacacccgaaca

SEQ ID NO: 2846 - DNA, 15 bp, Homo sapiens
aacccacacccgaac

SEQ ID NO: 2847 - DNA, 15 bp, Homo sapiens
caacccacacccgaa

SEQ ID NO: 2848 - DNA, 15 bp, Homo sapiens
ccaacccacacccga

SEQ ID NO: 2849 - DNA, 15 bp, Homo sapiens
accaacccacacccg

SEQ ID NO: 2850 - DNA, 15 bp, Homo sapiens
gaccaacccacaccc

SEQ ID NO: 2851 - DNA, 15 bp, Homo sapiens
tgaccaacccacacc

SEQ ID NO: 2852 - DNA, 15 bp, Homo sapiens
gtgaccaacccacac

SEQ ID NO: 2853 - DNA, 15 bp, Homo sapiens
tgtgaccaacccaca

SEQ ID NO: 2854 - DNA, 15 bp, Homo sapiens
ctgtgaccaacccac

SEQ ID NO: 2855 - DNA, 15 bp, Homo sapiens
gctgtgaccaaccca

SEQ ID NO: 2856 - DNA, 15 bp, Homo sapiens
tgctgtgaccaaccc

SEQ ID NO: 2857 - DNA, 15 bp, Homo sapiens
ctgctgtgaccaacc

SEQ ID NO: 2858 - DNA, 15 bp, Homo sapiens
tctgctgtgaccaac

SEQ ID NO: 2859 - DNA, 15 bp, Homo sapiens
ttctgctgtgaccaa

SEQ ID NO: 2860 - DNA, 15 bp, Homo sapiens
tttctgctgtgacca

SEQ ID NO: 2861 - DNA, 15 bp, Homo sapiens
atttctgctgtgacc

SEQ ID NO: 2862 - DNA, 15 bp, Homo sapiens
catttctgctgtgac

SEQ ID NO: 2863 - DNA, 15 bp, Homo sapiens
ccatttctgctgtga

SEQ ID NO: 2864 - DNA, 15 bp, Homo sapiens
cccatttctgctgtg

SEQ ID NO: 2865 - DNA, 15 bp, Homo sapiens
gcccatttctgctgt

SEQ ID NO: 2866 - DNA, 15 bp, Homo sapiens
agcccatttctgctg

SEQ ID NO: 2867 - DNA, 15 bp, Homo sapiens
gagcccatttctgct

SEQ ID NO: 2868 - DNA, 15 bp, Homo sapiens
ggagcccatttctgc

SEQ ID NO: 2869 - DNA, 15 bp, Homo sapiens
tggagcccatttctg

SEQ ID NO: 2870 - DNA, 15 bp, Homo sapiens
gtggagcccatttct

SEQ ID NO: 2871 - DNA, 15 bp, Homo sapiens
ggtggagcccatttc

SEQ ID NO: 2872 - DNA, 15 bp, Homo sapiens
tggtggagcccattt

SEQ ID NO: 2873 - DNA, 15 bp, Homo sapiens
gtggtggagcccatt

SEQ ID NO: 2874 - DNA, 15 bp, Homo sapiens
tgtggtggagcccat

SEQ ID NO: 2875 - DNA, 15 bp, Homo sapiens
ttgtggtggagccca

SEQ ID NO: 2876 - DNA, 15 bp, Homo sapiens
tttgtggtggagccc

SEQ ID NO: 2877 - DNA, 15 bp, Homo sapiens
ttttgtggtggagcc

SEQ ID NO: 2878 - DNA, 15 bp, Homo sapiens
attttgtggtggagc

SEQ ID NO: 2879 - DNA, 15 bp, Homo sapiens
aattttgtggtggag

SEQ ID NO: 2880 - DNA, 15 bp, Homo sapiens
caattttgtggtgga

SEQ ID NO: 2881 - DNA, 15 bp, Homo sapiens
tcaattttgtggtgg

SEQ ID NO: 2882 - DNA, 15 bp, Homo sapiens
atcaattttgtggtg

SEQ ID NO: 2883 - DNA, 15 bp, Homo sapiens
tatcaattttgtggt

SEQ ID NO: 2884 - DNA, 15 bp, Homo sapiens
atatcaattttgtgg

SEQ ID NO: 2885 - DNA, 15 bp, Homo sapiens
aatatcaattttgtg

SEQ ID NO: 2886 - DNA, 15 bp, Homo sapiens
gaatatcaattttgt

SEQ ID NO: 2887 - DNA, 15 bp, Homo sapiens
ggaatatcaattttg

SEQ ID NO: 2888 - DNA, 15 bp, Homo sapiens
aggaatatcaatttt

SEQ ID NO: 2889 - DNA, 15 bp, Homo sapiens
caggaatatcaattt

SEQ ID NO: 2890 - DNA, 15 bp, Homo sapiens
tcaggaatatcaatt

SEQ ID NO: 2891 - DNA, 15 bp, Homo sapiens
gtcaggaatatcaat

SEQ ID NO: 2892 - DNA, 15 bp, Homo sapiens
agtcaggaatatcaa

SEQ ID NO: 2893 - DNA, 15 bp, Homo sapiens
gagtcaggaatatca

SEQ ID NO: 2894 - DNA, 15 bp, Homo sapiens
tgagtcaggaatatc

SEQ ID NO: 2895 - DNA, 15 bp, Homo sapiens
atgagtcaggaatat

SEQ ID NO: 2896 - DNA, 15 bp, Homo sapiens
catgagtcaggaata

SEQ ID NO: 2897 - DNA, 15 bp, Homo sapiens
ccatgagtcaggaat

SEQ ID NO: 2898 - DNA, 15 bp, Homo sapiens
accatgagtcaggaa

SEQ ID NO: 2899 - DNA, 15 bp, Homo sapiens
gaccatgagtcagga

SEQ ID NO: 2900 - DNA, 15 bp, Homo sapiens
tgaccatgagtcagg

SEQ ID NO: 2901 - DNA, 15 bp, Homo sapiens
ctgaccatgagtcag

SEQ ID NO: 2902 - DNA, 15 bp, Homo sapiens
cctgaccatgagtca

SEQ ID NO: 2903 - DNA, 15 bp, Homo sapiens
gcctgaccatgagtc

SEQ ID NO: 2904 - DNA, 15 bp, Homo sapiens
tgcctgaccatgagt

SEQ ID NO: 2905 - DNA, 15 bp, Homo sapiens
ctgcctgaccatgag

SEQ ID NO: 2906 - DNA, 15 bp, Homo sapiens
tctgcctgaccatga

SEQ ID NO: 2907 - DNA, 15 bp, Homo sapiens
atctgcctgaccatg

SEQ ID NO: 2908 - DNA, 15 bp, Homo sapiens
catctgcctgaccat

SEQ ID NO: 2909 - DNA, 15 bp, Homo sapiens
acatctgcctgacca

SEQ ID NO: 2910 - DNA, 15 bp, Homo sapiens
cacatctgcctgacc

SEQ ID NO: 2911 - DNA, 15 bp, Homo sapiens
acacatctgcctgac

SEQ ID NO: 2912 - DNA, 15 bp, Homo sapiens
cacacatctgcctga

SEQ ID NO: 2913 - DNA, 15 bp, Homo sapiens
gcacacatctgcctg

SEQ ID NO: 2914 - DNA, 15 bp, Homo sapiens
agcacacatctgcct

SEQ ID NO: 2915 - DNA, 15 bp, Homo sapiens
aagcacacatctgcc

SEQ ID NO: 2916 - DNA, 15 bp, Homo sapiens
gaagcacacatctgc

SEQ ID NO: 2917 - DNA, 15 bp, Homo sapiens
agaagcacacatctg

SEQ ID NO: 2918 - DNA, 15 bp, Homo sapiens
cagaagcacacatct

SEQ ID NO: 2919 - DNA, 15 bp, Homo sapiens
ccagaagcacacatc

SEQ ID NO: 2920 - DNA, 15 bp, Homo sapiens
accagaagcacacat

SEQ ID NO: 2921 - DNA, 15 bp, Homo sapiens
aaccagaagcacaca

SEQ ID NO: 2922 - DNA, 15 bp, Homo sapiens
taaccagaagcacac

SEQ ID NO: 2923 - DNA, 15 bp, Homo sapiens
ataaccagaagcaca

SEQ ID NO: 2924 - DNA, 15 bp, Homo sapiens
aataaccagaagcac

SEQ ID NO: 2925 - DNA, 15 bp, Homo sapiens
aaataaccagaagca

SEQ ID NO: 2926 - DNA, 15 bp, Homo sapiens
aaaataaccagaagc

SEQ ID NO: 2927 - DNA, 15 bp, Homo sapiens
aaaaataaccagaag

SEQ ID NO: 2928 - DNA, 15 bp, Homo sapiens
gaaaaataaccagaa

SEQ ID NO: 2929 - DNA, 15 bp, Homo sapiens
ggaaaaataaccaga

SEQ ID NO: 2930 - DNA, 15 bp, Homo sapiens
tggaaaaataaccag

SEQ ID NO: 2931 - DNA, 15 bp, Homo sapiens
ctggaaaaataacca

SEQ ID NO: 2932 - DNA, 15 bp, Homo sapiens
cctggaaaaataacc

SEQ ID NO: 2933 - DNA, 15 bp, Homo sapiens
tcctggaaaaataac

SEQ ID NO: 2934 - DNA, 15 bp, Homo sapiens
ttcctggaaaaataa

SEQ ID NO: 2935 - DNA, 15 bp, Homo sapiens
gttcctggaaaaata

SEQ ID NO: 2936 - DNA, 15 bp, Homo sapiens
tgttcctggaaaaat

SEQ ID NO: 2937 - DNA, 15 bp, Homo sapiens
ctgttcctggaaaaa

SEQ ID NO: 2938 - DNA, 15 bp, Homo sapiens
cctgttcctggaaaa

SEQ ID NO: 2939 - DNA, 15 bp, Homo sapiens
tcctgttcctggaaa

SEQ ID NO: 2940 - DNA, 15 bp, Homo sapiens
ttcctgttcctggaa

SEQ ID NO: 2941 - DNA, 15 bp, Homo sapiens
attcctgttcctgga

SEQ ID NO: 2942 - DNA, 15 bp, Homo sapiens
cattcctgttcctgg

SEQ ID NO: 2943 - DNA, 15 bp, Homo sapiens
ccattcctgttcctg

SEQ ID NO: 2944 - DNA, 15 bp, Homo sapiens
cccattcctgttcct

SEQ ID NO: 2945 - DNA, 15 bp, Homo sapiens
gcccattcctgttcc

SEQ ID NO: 2946 - DNA, 15 bp, Homo sapiens
agcccattcctgttc

SEQ ID NO: 2947 - DNA, 15 bp, Homo sapiens
gagcccattcctgtt

SEQ ID NO: 2948 - DNA, 15 bp, Homo sapiens
agagcccattcctgt

SEQ ID NO: 2949 - DNA, 15 bp, Homo sapiens
cagagcccattcctg

SEQ ID NO: 2950 - DNA, 15 bp, Homo sapiens
gcagagcccattcct

SEQ ID NO: 2951 - DNA, 15 bp, Homo sapiens
ggcagagcccattcc

SEQ ID NO: 2952 - DNA, 15 bp, Homo sapiens
cggcagagcccattc

SEQ ID NO: 2953 - DNA, 15 bp, Homo sapiens
tcggcagagcccatt

SEQ ID NO: 2954 - DNA, 15 bp, Homo sapiens
ctcggcagagcccat

SEQ ID NO: 2955 - DNA, 15 bp, Homo sapiens
gctcggcagagccca

SEQ ID NO: 2956 - DNA, 15 bp, Homo sapiens
ggctcggcagagccc

SEQ ID NO: 2957 - DNA, 15 bp, Homo sapiens
aggctcggcagagcc

SEQ ID NO: 2958 - DNA, 15 bp, Homo sapiens
aaggctcggcagagc

SEQ ID NO: 2959 - DNA, 15 bp, Homo sapiens
aaaggctcggcagag

SEQ ID NO: 2960 - DNA, 15 bp, Homo sapiens
gaaaggctcggcaga

SEQ ID NO: 2961 - DNA, 15 bp, Homo sapiens
tgaaaggctcggcag

SEQ ID NO: 2962 - DNA, 15 bp, Homo sapiens
gtgaaaggctcggca

SEQ ID NO: 2963 - DNA, 15 bp, Homo sapiens
tgtgaaaggctcggc

SEQ ID NO: 2964 - DNA, 15 bp, Homo sapiens
gtgtgaaaggctcgg

SEQ ID NO: 2965 - DNA, 15 bp, Homo sapiens
cgtgtgaaaggctcg

SEQ ID NO: 2966 - DNA, 15 bp, Homo sapiens
acgtgtgaaaggctc

SEQ ID NO: 2967 - DNA, 15 bp, Homo sapiens
aacgtgtgaaaggct

SEQ ID NO: 2968 - DNA, 15 bp, Homo sapiens
caacgtgtgaaaggc

SEQ ID NO: 2969 - DNA, 15 bp, Homo sapiens
acaacgtgtgaaagg

SEQ ID NO: 2970 - DNA, 15 bp, Homo sapiens
cacaacgtgtgaaag

SEQ ID NO: 2971 - DNA, 15 bp, Homo sapiens
acacaacgtgtgaaa

SEQ ID NO: 2972 - DNA, 15 bp, Homo sapiens
gacacaacgtgtgaa

SEQ ID NO: 2973 - DNA, 15 bp, Homo sapiens
agacacaacgtgtga

SEQ ID NO: 2974 - DNA, 15 bp, Homo sapiens
gagacacaacgtgtg

SEQ ID NO: 2975 - DNA, 15 bp, Homo sapiens
agagacacaacgtgt

SEQ ID NO: 2976 - DNA, 15 bp, Homo sapiens
cagagacacaacgtg

SEQ ID NO: 2977 - DNA, 15 bp, Homo sapiens
gcagagacacaacgt

SEQ ID NO: 2978 - DNA, 15 bp, Homo sapiens
agcagagacacaacg

SEQ ID NO: 2979 - DNA, 15 bp, Homo sapiens
cagcagagacacaac

SEQ ID NO: 2980 - DNA, 15 bp, Homo sapiens
acagcagagacacaa

SEQ ID NO: 2981 - DNA, 15 bp, Homo sapiens
cacagcagagacaca

SEQ ID NO: 2982 - DNA, 15 bp, Homo sapiens
gcacagcagagacac

SEQ ID NO: 2983 - DNA, 15 bp, Homo sapiens
cgcacagcagagaca

SEQ ID NO: 2984 - DNA, 15 bp, Homo sapiens
ccgcacagcagagac

SEQ ID NO: 2985 - DNA, 15 bp, Homo sapiens
cccgcacagcagaga

SEQ ID NO: 2986 - DNA, 15 bp, Homo sapiens
tcccgcacagcagag

SEQ ID NO: 2987 - DNA, 15 bp, Homo sapiens
atcccgcacagcaga

SEQ ID NO: 2988 - DNA, 15 bp, Homo sapiens
gatcccgcacagcag

SEQ ID NO: 2989 - DNA, 15 bp, Homo sapiens
tgatcccgcacagca

SEQ ID NO: 2990 - DNA, 15 bp, Homo sapiens
ctgatcccgcacagc

SEQ ID NO: 2991 - DNA, 15 bp, Homo sapiens
actgatcccgcacag

SEQ ID NO: 2992 - DNA, 15 bp, Homo sapiens
tactgatcccgcaca

SEQ ID NO: 2993 - DNA, 15 bp, Homo sapiens
gtactgatcccgcac

SEQ ID NO: 2994 - DNA, 15 bp, Homo sapiens
ggtactgatcccgca

SEQ ID NO: 2995 - DNA, 15 bp, Homo sapiens
gggtactgatcccgc

SEQ ID NO: 2996 - DNA, 15 bp, Homo sapiens
ggggtactgatcccg

SEQ ID NO: 2997 - DNA, 15 bp, Homo sapiens
tggggtactgatccc

SEQ ID NO: 2998 - DNA, 15 bp, Homo sapiens
ctggggtactgatcc

SEQ ID NO: 2999 - DNA, 15 bp, Homo sapiens
tctggggtactgatc

SEQ ID NO: 3000 - DNA, 15 bp, Homo sapiens
gtctggggtactgat

SEQ ID NO: 3001 - DNA, 15 bp, Homo sapiens
agtctggggtactga

SEQ ID NO: 3002 - DNA, 15 bp, Homo sapiens
cagtctggggtactg

SEQ ID NO: 3003 - DNA, 15 bp, Homo sapiens
acagtctggggtact

SEQ ID NO: 3004 - DNA, 15 bp, Homo sapiens
cacagtctggggtac

SEQ ID NO: 3005 - DNA, 15 bp, Homo sapiens
tcacagtctggggta

SEQ ID NO: 3006 - DNA, 15 bp, Homo sapiens
ctcacagtctggggt

SEQ ID NO: 3007 - DNA, 15 bp, Homo sapiens
tctcacagtctgggg

SEQ ID NO: 3008 - DNA, 15 bp, Homo sapiens
atctcacagtctggg

SEQ ID NO: 3009 - DNA, 15 bp, Homo sapiens
tatctcacagtctgg

SEQ ID NO: 3010 - DNA, 15 bp, Homo sapiens
ttatctcacagtctg

SEQ ID NO: 3011 - DNA, 15 bp, Homo sapiens
gttatctcacagtct

SEQ ID NO: 3012 - DNA, 15 bp, Homo sapiens
tgttatctcacagtc

SEQ ID NO: 3013 - DNA, 15 bp, Homo sapiens
ctgttatctcacagt

SEQ ID NO: 3014 - DNA, 15 bp, Homo sapiens
cctgttatctcacag

SEQ ID NO: 3015 - DNA, 15 bp, Homo sapiens
tcctgttatctcaca

SEQ ID NO: 3016 - DNA, 15 bp, Homo sapiens
atcctgttatctcac

SEQ ID NO: 3017 - DNA, 15 bp, Homo sapiens
gatcctgttatctca

SEQ ID NO: 3018 - DNA, 15 bp, Homo sapiens
cgatcctgttatctc

SEQ ID NO: 3019 - DNA, 15 bp, Homo sapiens
tcgatcctgttatct

SEQ ID NO: 3020 - DNA, 15 bp, Homo sapiens
ttcgatcctgttatc

SEQ ID NO: 3021 - DNA, 15 bp, Homo sapiens
attcgatcctgttat

SEQ ID NO: 3022 - DNA, 15 bp, Homo sapiens
aattcgatcctgtta

SEQ ID NO: 3023 - DNA, 15 bp, Homo sapiens
gaattcgatcctgtt

SEQ ID NO: 3024 - DNA, 15 bp, Homo sapiens
tgaattcgatcctgt

SEQ ID NO: 3025 - DNA, 15 bp, Homo sapiens
ctgaattcgatcctg

SEQ ID NO: 3026 - DNA, 15 bp, Homo sapiens
cctgaattcgatcct

SEQ ID NO: 3027 - DNA, 15 bp, Homo sapiens
ccctgaattcgatcc

SEQ ID NO: 3028 - DNA, 15 bp, Homo sapiens
cccctgaattcgatc

SEQ ID NO: 3029 - DNA, 15 bp, Homo sapiens
acccctgaattcgat

SEQ ID NO: 3030 - DNA, 15 bp, Homo sapiens
aacccctgaattcga

SEQ ID NO: 3031 - DNA, 15 bp, Homo sapiens
caacccctgaattcg

SEQ ID NO: 3032 - DNA, 15 bp, Homo sapiens
ccaacccctgaattc

SEQ ID NO: 3033 - DNA, 15 bp, Homo sapiens
accaacccctgaatt

SEQ ID NO: 3034 - DNA, 15 bp, Homo sapiens
aaccaacccctgaat

SEQ ID NO: 3035 - DNA, 15 bp, Homo sapiens
caaccaacccctgaa

SEQ ID NO: 3036 - DNA, 15 bp, Homo sapiens
ccaaccaacccctga

SEQ ID NO: 3037 - DNA, 15 bp, Homo sapiens
accaaccaacccctg

SEQ ID NO: 3038 - DNA, 15 bp, Homo sapiens
caccaaccaacccct

SEQ ID NO: 3039 - DNA, 15 bp, Homo sapiens
tcaccaaccaacccc

SEQ ID NO: 3040 - DNA, 15 bp, Homo sapiens
atcaccaaccaaccc

SEQ ID NO: 3041 - DNA, 15 bp, Homo sapiens
gatcaccaaccaacc

SEQ ID NO: 3042 - DNA, 15 bp, Homo sapiens
ggatcaccaaccaac

SEQ ID NO: 3043 - DNA, 15 bp, Homo sapiens
tggatcaccaaccaa

SEQ ID NO: 3044 - DNA, 15 bp, Homo sapiens
ctggatcaccaacca

SEQ ID NO: 3045 - DNA, 15 bp, Homo sapiens
cctggatcaccaacc

SEQ ID NO: 3046 - DNA, 15 bp, Homo sapiens
tcctggatcaccaac

SEQ ID NO: 3047 - DNA, 15 bp, Homo sapiens
ttcctggatcaccaa

SEQ ID NO: 3048 - DNA, 15 bp, Homo sapiens
gttcctggatcacca

SEQ ID NO: 3049 - DNA, 15 bp, Homo sapiens
ggttcctggatcacc

SEQ ID NO: 3050 - DNA, 15 bp, Homo sapiens
tggttcctggatcac

SEQ ID NO: 3051 - DNA, 15 bp, Homo sapiens
atggttcctggatca

SEQ ID NO: 3052 - DNA, 15 bp, Homo sapiens
tatggttcctggatc

SEQ ID NO: 3053 - DNA, 15 bp, Homo sapiens
gtatggttcctggat

SEQ ID NO: 3054 - DNA, 15 bp, Homo sapiens
ggtatggttcctgga

SEQ ID NO: 3055 - DNA, 15 bp, Homo sapiens
aggtatggttcctgg

SEQ ID NO: 3056 - DNA, 15 bp, Homo sapiens
taggtatggttcctg

SEQ ID NO: 3057 - DNA, 15 bp, Homo sapiens
gtaggtatggttcct

SEQ ID NO: 3058 - DNA, 15 bp, Homo sapiens
agtaggtatggttcc

SEQ ID NO: 3059 - DNA, 15 bp, Homo sapiens
aagtaggtatggttc

SEQ ID NO: 3060 - DNA, 15 bp, Homo sapiens
caagtaggtatggtt

SEQ ID NO: 3061 - DNA, 15 bp, Homo sapiens
ccaagtaggtatggt

SEQ ID NO: 3062 - DNA, 15 bp, Homo sapiens
tccaagtaggtatgg

SEQ ID NO: 3063 - DNA, 15 bp, Homo sapiens
atccaagtaggtatg

SEQ ID NO: 3064 - DNA, 15 bp, Homo sapiens
catccaagtaggtat

SEQ ID NO: 3065 - DNA, 15 bp, Homo sapiens
acatccaagtaggta

SEQ ID NO: 3066 - DNA, 15 bp, Homo sapiens
cacatccaagtaggt

SEQ ID NO: 3067 - DNA, 15 bp, Homo sapiens
tcacatccaagtagg

SEQ ID NO: 3068 - DNA, 15 bp, Homo sapiens
atcacatccaagtag

SEQ ID NO: 3069 - DNA, 15 bp, Homo sapiens
tatcacatccaagta

SEQ ID NO: 3070 - DNA, 15 bp, Homo sapiens
gtatcacatccaagt

SEQ ID NO: 3071 - DNA, 15 bp, Homo sapiens
agtatcacatccaag

SEQ ID NO: 3072 - DNA, 15 bp, Homo sapiens
cagtatcacatccaa

SEQ ID NO: 3073 - DNA, 15 bp, Homo sapiens
tcagtatcacatcca

SEQ ID NO: 3074 - DNA, 15 bp, Homo sapiens
ctcagtatcacatcc

SEQ ID NO: 3075 - DNA, 15 bp, Homo sapiens
actcagtatcacatc

SEQ ID NO: 3076 - DNA, 15 bp, Homo sapiens
cactcagtatcacat

SEQ ID NO: 3077 - DNA, 15 bp, Homo sapiens
ccactcagtatcaca

SEQ ID NO: 3078 - DNA, 15 bp, Homo sapiens
gccactcagtatcac

SEQ ID NO: 3079 - DNA, 15 bp, Homo sapiens
ggccactcagtatca

SEQ ID NO: 3080 - DNA, 15 bp, Homo sapiens
aggccactcagtatc

SEQ ID NO: 3081 - DNA, 15 bp, Homo sapiens
taggccactcagtat

SEQ ID NO: 3082 - DNA, 15 bp, Homo sapiens
ctaggccactcagta

SEQ ID NO: 3083 - DNA, 15 bp, Homo sapiens
tctaggccactcagt

SEQ ID NO: 3084 - DNA, 15 bp, Homo sapiens
gtctaggccactcag

SEQ ID NO: 3085 - DNA, 15 bp, Homo sapiens
cgtctaggccactca

SEQ ID NO: 3086 - DNA, 15 bp, Homo sapiens
acgtctaggccactc

SEQ ID NO: 3087 - DNA, 15 bp, Homo sapiens
aacgtctaggccact

SEQ ID NO: 3088 - DNA, 15 bp, Homo sapiens
caacgtctaggccac

SEQ ID NO: 3089 - DNA, 15 bp, Homo sapiens
acaacgtctaggcca

SEQ ID NO: 3090 - DNA, 15 bp, Homo sapiens
tacaacgtctaggcc

SEQ ID NO: 3091 - DNA, 15 bp, Homo sapiens
ctacaacgtctaggc

SEQ ID NO: 3092 - DNA, 15 bp, Homo sapiens
cctacaacgtctagg

SEQ ID NO: 3093 - DNA, 15 bp, Homo sapiens
tcctacaacgtctag

SEQ ID NO: 3094 - DNA, 15 bp, Homo sapiens
gtcctacaacgtcta

SEQ ID NO: 3095 - DNA, 15 bp, Homo sapiens
agtcctacaacgtct

SEQ ID NO: 3096 - DNA, 15 bp, Homo sapiens
gagtcctacaacgtc

SEQ ID NO: 3097 - DNA, 15 bp, Homo sapiens
agagtcctacaacgt

SEQ ID NO: 3098 - DNA, 15 bp, Homo sapiens
gagagtcctacaacg

SEQ ID NO: 3099 - DNA, 15 bp, Homo sapiens
tgagagtcctacaac

SEQ ID NO: 3100 - DNA, 15 bp, Homo sapiens
atgagagtcctacaa

SEQ ID NO: 3101 - DNA, 15 bp, Homo sapiens
tatgagagtcctaca

SEQ ID NO: 3102 - DNA, 15 bp, Homo sapiens
ttatgagagtcctac

SEQ ID NO: 3103 - DNA, 15 bp, Homo sapiens
cttatgagagtccta

SEQ ID NO: 3104 - DNA, 15 bp, Homo sapiens
acttatgagagtcct

SEQ ID NO: 3105 - DNA, 15 bp, Homo sapiens
aacttatgagagtcc

SEQ ID NO: 3106 - DNA, 15 bp, Homo sapiens
aaacttatgagagtc

SEQ ID NO: 3107 - DNA, 15 bp, Homo sapiens
aaaacttatgagagt

SEQ ID NO: 3108 - DNA, 15 bp, Homo sapiens
taaaacttatgagag

SEQ ID NO: 3109 - DNA, 15 bp, Homo sapiens
ctaaaacttatgaga

SEQ ID NO: 3110 - DNA, 15 bp, Homo sapiens
tctaaaacttatgag

SEQ ID NO: 3111 - DNA, 15 bp, Homo sapiens
gtctaaaacttatga

SEQ ID NO: 3112 - DNA, 15 bp, Homo sapiens
tgtctaaaacttatg

SEQ ID NO: 3113 - DNA, 15 bp, Homo sapiens
atgtctaaaacttat

SEQ ID NO: 3114 - DNA, 15 bp, Homo sapiens
aatgtctaaaactta

SEQ ID NO: 3115 - DNA, 15 bp, Homo sapiens
aaatgtctaaaactt

SEQ ID NO: 3116 - DNA, 15 bp, Homo sapiens
aaaatgtctaaaact

SEQ ID NO: 3117 - DNA, 15 bp, Homo sapiens
caaaatgtctaaaac

SEQ ID NO: 3118 - DNA, 15 bp, Homo sapiens
acaaaatgtctaaaa

SEQ ID NO: 3119 - DNA, 15 bp, Homo sapiens
aacaaaatgtctaaa

SEQ ID NO: 3120 - DNA, 15 bp, Homo sapiens
taacaaaatgtctaa

SEQ ID NO: 3121 - DNA, 15 bp, Homo sapiens
ataacaaaatgtcta

SEQ ID NO: 3122 - DNA, 15 bp, Homo sapiens
tataacaaaatgtct

SEQ ID NO: 3123 - DNA, 15 bp, Homo sapiens
gtataacaaaatgtc

SEQ ID NO: 3124 - DNA, 15 bp, Homo sapiens
agtataacaaaatgt

SEQ ID NO: 3125 - DNA, 15 bp, Homo sapiens
cagtataacaaaatg

SEQ ID NO: 3126 - DNA, 15 bp, Homo sapiens
acagtataacaaaat

SEQ ID NO: 3127 - DNA, 15 bp, Homo sapiens
tacagtataacaaaa

SEQ ID NO: 3128 - DNA, 15 bp, Homo sapiens
ttacagtataacaaa

SEQ ID NO: 3129 - DNA, 15 bp, Homo sapiens
tttacagtataacaa

SEQ ID NO: 3130 - DNA, 15 bp, Homo sapiens
ttttacagtataaca

SEQ ID NO: 3131 - DNA, 15 bp, Homo sapiens
tttttacagtataac

SEQ ID NO: 3132 - DNA, 15 bp, Homo sapiens
atttttacagtataa

SEQ ID NO: 3133 - DNA, 15 bp, Homo sapiens
catttttacagtata

SEQ ID NO: 3134 - DNA, 15 bp, Homo sapiens
tcatttttacagtat

SEQ ID NO: 3135 - DNA, 15 bp, Homo sapiens
ttcatttttacagta

SEQ ID NO: 3136 - DNA, 15 bp, Homo sapiens
cttcatttttacagt

SEQ ID NO: 3137 - DNA, 15 bp, Homo sapiens
gcttcatttttacag

SEQ ID NO: 3138 - DNA, 15 bp, Homo sapiens
tgcttcatttttaca

SEQ ID NO: 3139 - DNA, 15 bp, Homo sapiens
atgcttcatttttac

SEQ ID NO: 3140 - DNA, 15 bp, Homo sapiens
tatgcttcattttta

SEQ ID NO: 3141 - DNA, 15 bp, Homo sapiens
atatgcttcattttt

SEQ ID NO: 3142 - DNA, 15 bp, Homo sapiens
tatatgcttcatttt

SEQ ID NO: 3143 - DNA, 15 bp, Homo sapiens
gtatatgcttcattt

SEQ ID NO: 3144 - DNA, 15 bp, Homo sapiens
cgtatatgcttcatt

SEQ ID NO: 3145 - DNA, 15 bp, Homo sapiens
ccgtatatgcttcat

SEQ ID NO: 3146 - DNA, 15 bp, Homo sapiens
gccgtatatgcttca

SEQ ID NO: 3147 - DNA, 15 bp, Homo sapiens
ggccgtatatgcttc

SEQ ID NO: 3148 - DNA, 15 bp, Homo sapiens
aggccgtatatgctt

SEQ ID NO: 3149 - DNA, 15 bp, Homo sapiens
gaggccgtatatgct

SEQ ID NO: 3150 - DNA, 15 bp, Homo sapiens
tgaggccgtatatgc

SEQ ID NO: 3151 - DNA, 15 bp, Homo sapiens
ctgaggccgtatatg

SEQ ID NO: 3152 - DNA, 15 bp, Homo sapiens
actgaggccgtatat

SEQ ID NO: 3153 - DNA, 15 bp, Homo sapiens
tactgaggccgtata

SEQ ID NO: 3154 - DNA, 15 bp, Homo sapiens
ctactgaggccgtat

SEQ ID NO: 3155 - DNA, 15 bp, Homo sapiens
actactgaggccgta

SEQ ID NO: 3156 - DNA, 15 bp, Homo sapiens
tactactgaggccgt

SEQ ID NO: 3157 - DNA, 15 bp, Homo sapiens
ttactactgaggccg

SEQ ID NO: 3158 - DNA, 15 bp, Homo sapiens
gttactactgaggcc

SEQ ID NO: 3159 - DNA, 15 bp, Homo sapiens
tgttactactgaggc

SEQ ID NO: 3160 - DNA, 15 bp, Homo sapiens
atgttactactgagg

SEQ ID NO: 3161 - DNA, 15 bp, Homo sapiens
aatgttactactgag

SEQ ID NO: 3162 - DNA, 15 bp, Homo sapiens
caatgttactactga

SEQ ID NO: 3163 - DNA, 15 bp, Homo sapiens
gcaatgttactactg

SEQ ID NO: 3164 - DNA, 15 bp, Homo sapiens
tgcaatgttactact

SEQ ID NO: 3165 - DNA, 15 bp, Homo sapiens
gtgcaatgttactac

SEQ ID NO: 3166 - DNA, 15 bp, Homo sapiens
agtgcaatgttacta

SEQ ID NO: 3167 - DNA, 15 bp, Homo sapiens
tagtgcaatgttact

SEQ ID NO: 3168 - DNA, 15 bp, Homo sapiens
ttagtgcaatgttac

SEQ ID NO: 3169 - DNA, 15 bp, Homo sapiens
attagtgcaatgtta

SEQ ID NO: 3170 - DNA, 15 bp, Homo sapiens
tattagtgcaatgtt

SEQ ID NO: 3171 - DNA, 15 bp, Homo sapiens
ctattagtgcaatgt

SEQ ID NO: 3172 - DNA, 15 bp, Homo sapiens
cctattagtgcaatg

SEQ ID NO: 3173 - DNA, 15 bp, Homo sapiens
acctattagtgcaat

SEQ ID NO: 3174 - DNA, 15 bp, Homo sapiens
tacctattagtgcaa

SEQ ID NO: 3175 - DNA, 15 bp, Homo sapiens
ttacctattagtgca

SEQ ID NO: 3176 - DNA, 15 bp, Homo sapiens
attacctattagtgc

SEQ ID NO: 3177 - DNA, 15 bp, Homo sapiens
aattacctattagtg

SEQ ID NO: 3178 - DNA, 15 bp, Homo sapiens
taattacctattagt

SEQ ID NO: 3179 - DNA, 15 bp, Homo sapiens
ataattacctattag

SEQ ID NO: 3180 - DNA, 15 bp, Homo sapiens
aataattacctatta

SEQ ID NO: 3181 - DNA, 15 bp, Homo sapiens
taataattacctatt

SEQ ID NO: 3182 - DNA, 15 bp, Homo sapiens
gtaataattacctat

SEQ ID NO: 3183 - DNA, 15 bp, Homo sapiens
agtaataattaccta

SEQ ID NO: 3184 - DNA, 15 bp, Homo sapiens
gagtaataattacct

SEQ ID NO: 3185 - DNA, 15 bp, Homo sapiens
agagtaataattacc

SEQ ID NO: 3186 - DNA, 15 bp, Homo sapiens
tagagtaataattac

SEQ ID NO: 3187 - DNA, 15 bp, Homo sapiens
ctagagtaataatta

SEQ ID NO: 3188 - DNA, 15 bp, Homo sapiens
tctagagtaataatt

SEQ ID NO: 3189 - DNA, 15 bp, Homo sapiens
ctctagagtaataat

SEQ ID NO: 3190 - DNA, 15 bp, Homo sapiens
tctctagagtaataa

SEQ ID NO: 3191 - DNA, 15 bp, Homo sapiens
ttctctagagtaata

SEQ ID NO: 3192 - DNA, 15 bp, Homo sapiens
attctctagagtaat

SEQ ID NO: 3193 - DNA, 15 bp, Homo sapiens
aattctctagagtaa

SEQ ID NO: 3194 - DNA, 15 bp, Homo sapiens
aaattctctagagta

SEQ ID NO: 3195 - DNA, 15 bp, Homo sapiens
aaaattctctagagt

SEQ ID NO: 3196 - DNA, 15 bp, Homo sapiens
caaaattctctagag

SEQ ID NO: 3197 - DNA, 15 bp, Homo sapiens
ccaaaattctctaga

SEQ ID NO: 3198 - DNA, 15 bp, Homo sapiens
cccaaaattctctag

SEQ ID NO: 3199 - DNA, 15 bp, Homo sapiens
acccaaaattctcta

SEQ ID NO: 3200 - DNA, 15 bp, Homo sapiens
aacccaaaattctct

SEQ ID NO: 3201 - DNA, 15 bp, Homo sapiens
gaacccaaaattctc

SEQ ID NO: 3202 - DNA, 15 bp, Homo sapiens
ggaacccaaaattct

SEQ ID NO: 3203 - DNA, 15 bp, Homo sapiens
tggaacccaaaattc

SEQ ID NO: 3204 - DNA, 15 bp, Homo sapiens
atggaacccaaaatt

SEQ ID NO: 3205 - DNA, 15 bp, Homo sapiens
catggaacccaaaat

SEQ ID NO: 3206 - DNA, 15 bp, Homo sapiens
ccatggaacccaaaa

SEQ ID NO: 3207 - DNA, 15 bp, Homo sapiens
gccatggaacccaaa

SEQ ID NO: 3208 - DNA, 15 bp, Homo sapiens
agccatggaacccaa

SEQ ID NO: 3209 - DNA, 15 bp, Homo sapiens
cagccatggaaccca

SEQ ID NO: 3210 - DNA, 15 bp, Homo sapiens
ccagccatggaaccc

SEQ ID NO: 3211 - DNA, 15 bp, Homo sapiens
tccagccatggaacc

SEQ ID NO: 3212 - DNA, 15 bp, Homo sapiens
ttccagccatggaac

SEQ ID NO: 3213 - DNA, 15 bp, Homo sapiens
attccagccatggaa

SEQ ID NO: 3214 - DNA, 15 bp, Homo sapiens
cattccagccatgga

SEQ ID NO: 3215 - DNA, 15 bp, Homo sapiens
acattccagccatgg

SEQ ID NO: 3216 - DNA, 15 bp, Homo sapiens
aacattccagccatg

SEQ ID NO: 3217 - DNA, 15 bp, Homo sapiens
gaacattccagccat

SEQ ID NO: 3218 - DNA, 15 bp, Homo sapiens
tgaacattccagcca

SEQ ID NO: 3219 - DNA, 15 bp, Homo sapiens
atgaacattccagcc

SEQ ID NO: 3220 - DNA, 15 bp, Homo sapiens
gatgaacattccagc

SEQ ID NO: 3221 - DNA, 15 bp, Homo sapiens
tgatgaacattccag

SEQ ID NO: 3222 - DNA, 15 bp, Homo sapiens
ctgatgaacattcca

SEQ ID NO: 3223 - DNA, 15 bp, Homo sapiens
actgatgaacattcc

SEQ ID NO: 3224 - DNA, 15 bp, Homo sapiens
tactgatgaacattc

SEQ ID NO: 3225 - DNA, 15 bp, Homo sapiens
atactgatgaacatt

SEQ ID NO: 3226 - DNA, 15 bp, Homo sapiens
gatactgatgaacat

SEQ ID NO: 3227 - DNA, 15 bp, Homo sapiens
agatactgatgaaca

SEQ ID NO: 3228 - DNA, 15 bp, Homo sapiens
gagatactgatgaac

SEQ ID NO: 3229 - DNA, 15 bp, Homo sapiens
tgagatactgatgaa

SEQ ID NO: 3230 - DNA, 15 bp, Homo sapiens
ctgagatactgatga

SEQ ID NO: 3231 - DNA, 15 bp, Homo sapiens
gctgagatactgatg

SEQ ID NO: 3232 - DNA, 15 bp, Homo sapiens
tgctgagatactgat

SEQ ID NO: 3233 - DNA, 15 bp, Homo sapiens
ttgctgagatactga

SEQ ID NO: 3234 - DNA, 15 bp, Homo sapiens
attgctgagatactg

SEQ ID NO: 3235 - DNA, 15 bp, Homo sapiens
aattgctgagatact

SEQ ID NO: 3236 - DNA, 15 bp, Homo sapiens
aaattgctgagatac

SEQ ID NO: 3237 - DNA, 15 bp, Homo sapiens
gaaattgctgagata

SEQ ID NO: 3238 - DNA, 15 bp, Homo sapiens
tgaaattgctgagat

SEQ ID NO: 3239 - DNA, 15 bp, Homo sapiens
ctgaaattgctgaga

SEQ ID NO: 3240 - DNA, 15 bp, Homo sapiens
actgaaattgctgag

SEQ ID NO: 3241 - DNA, 15 bp, Homo sapiens
aactgaaattgctga

SEQ ID NO: 3242 - DNA, 15 bp, Homo sapiens
taactgaaattgctg

SEQ ID NO: 3243 - DNA, 15 bp, Homo sapiens
ttaactgaaattgct

SEQ ID NO: 3244 - DNA, 15 bp, Homo sapiens
attaactgaaattgc

SEQ ID NO: 3245 - DNA, 15 bp, Homo sapiens
tattaactgaaattg

SEQ ID NO: 3246 - DNA, 15 bp, Homo sapiens
ttattaactgaaatt

SEQ ID NO: 3247 - DNA, 15 bp, Homo sapiens
gttattaactgaaat

SEQ ID NO: 3248 - DNA, 15 bp, Homo sapiens
ggttattaactgaaa

SEQ ID NO: 3249 - DNA, 15 bp, Homo sapiens
tggttattaactgaa

SEQ ID NO: 3250 - DNA, 15 bp, Homo sapiens
ctggttattaactga

SEQ ID NO: 3251 - DNA, 15 bp, Homo sapiens
tctggttattaactg

SEQ ID NO: 3252 - DNA, 15 bp, Homo sapiens
atctggttattaact

SEQ ID NO: 3253 - DNA, 15 bp, Homo sapiens
aatctggttattaac

SEQ ID NO: 3254 - DNA, 15 bp, Homo sapiens
taatctggttattaa

SEQ ID NO: 3255 - DNA, 15 bp, Homo sapiens
ttaatctggttatta

SEQ ID NO: 3256 - DNA, 15 bp, Homo sapiens
cttaatctggttatt

SEQ ID NO: 3257 - DNA, 15 bp, Homo sapiens
gcttaatctggttat

SEQ ID NO: 3258 - DNA, 15 bp, Homo sapiens
agcttaatctggtta

SEQ ID NO: 3259 - DNA, 15 bp, Homo sapiens
cagcttaatctggtt

SEQ ID NO: 3260 - DNA, 15 bp, Homo sapiens
tcagcttaatctggt

SEQ ID NO: 3261 - DNA, 15 bp, Homo sapiens
gtcagcttaatctgg

SEQ ID NO: 3262 - DNA, 15 bp, Homo sapiens
ggtcagcttaatctg

SEQ ID NO: 3263 - DNA, 15 bp, Homo sapiens
aggtcagcttaatct

SEQ ID NO: 3264 - DNA, 15 bp, Homo sapiens
gaggtcagcttaatc

SEQ ID NO: 3265 - DNA, 15 bp, Homo sapiens
agaggtcagcttaat

SEQ ID NO: 3266 - DNA, 15 bp, Homo sapiens
aagaggtcagcttaa

SEQ ID NO: 3267 - DNA, 15 bp, Homo sapiens
caagaggtcagctta

SEQ ID NO: 3268 - DNA, 15 bp, Homo sapiens
tcaagaggtcagctt

SEQ ID NO: 3269 - DNA, 15 bp, Homo sapiens
ctcaagaggtcagct

SEQ ID NO: 3270 - DNA, 15 bp, Homo sapiens
actcaagaggtcagc

SEQ ID NO: 3271 - DNA, 15 bp, Homo sapiens
gactcaagaggtcag

SEQ ID NO: 3272 - DNA, 15 bp, Homo sapiens
agactcaagaggtca

SEQ ID NO: 3273 - DNA, 15 bp, Homo sapiens
aagactcaagaggtc

SEQ ID NO: 3274 - DNA, 15 bp, Homo sapiens
aaagactcaagaggt

SEQ ID NO: 3275 - DNA, 15 bp, Homo sapiens
aaaagactcaagagg

SEQ ID NO: 3276 - DNA, 15 bp, Homo sapiens
caaaagactcaagag

SEQ ID NO: 3277 - DNA, 15 bp, Homo sapiens
tcaaaagactcaaga

SEQ ID NO: 3278 - DNA, 15 bp, Homo sapiens
ttcaaaagactcaag

SEQ ID NO: 3279 - DNA, 15 bp, Homo sapiens
tttcaaaagactcaa

SEQ ID NO: 3280 - DNA, 15 bp, Homo sapiens
atttcaaaagactca

SEQ ID NO: 3281 - DNA, 15 bp, Homo sapiens
gatttcaaaagactc

SEQ ID NO: 3282 - DNA, 15 bp, Homo sapiens
agatttcaaaagact

SEQ ID NO: 3283 - DNA, 15 bp, Homo sapiens
cagatttcaaaagac

SEQ ID NO: 3284 - DNA, 15 bp, Homo sapiens
gcagatttcaaaaga

SEQ ID NO: 3285 - DNA, 15 bp, Homo sapiens
agcagatttcaaaag

SEQ ID NO: 3286 - DNA, 15 bp, Homo sapiens
cagcagatttcaaaa

SEQ ID NO: 3287 - DNA, 15 bp, Homo sapiens
ccagcagatttcaaa

SEQ ID NO: 3288 - DNA, 15 bp, Homo sapiens
cccagcagatttcaa

SEQ ID NO: 3289 - DNA, 15 bp, Homo sapiens
acccagcagatttca

SEQ ID NO: 3290 - DNA, 15 bp, Homo sapiens
gacccagcagatttc

SEQ ID NO: 3291 - DNA, 15 bp, Homo sapiens
ggacccagcagattt

SEQ ID NO: 3292 - DNA, 15 bp, Homo sapiens
gggacccagcagatt

SEQ ID NO: 3293 - DNA, 15 bp, Homo sapiens
agggacccagcagat

SEQ ID NO: 3294 - DNA, 15 bp, Homo sapiens
tagggacccagcaga

SEQ ID NO: 3295 - DNA, 15 bp, Homo sapiens
atagggacccagcag

SEQ ID NO: 3296 - DNA, 15 bp, Homo sapiens
tatagggacccagca

SEQ ID NO: 3297 - DNA, 15 bp, Homo sapiens
ttatagggacccagc

SEQ ID NO: 3298 - DNA, 15 bp, Homo sapiens
attatagggacccag

SEQ ID NO: 3299 - DNA, 15 bp, Homo sapiens
tattatagggaccca

SEQ ID NO: 3300 - DNA, 15 bp, Homo sapiens
ttattatagggaccc

SEQ ID NO: 3301 - DNA, 15 bp, Homo sapiens
cttattatagggacc

SEQ ID NO: 3302 - DNA, 15 bp, Homo sapiens
tcttattatagggac

SEQ ID NO: 3303 - DNA, 15 bp, Homo sapiens
gtcttattataggga

SEQ ID NO: 3304 - DNA, 15 bp, Homo sapiens
tgtcttattataggg

SEQ ID NO: 3305 - DNA, 15 bp, Homo sapiens
ctgtcttattatagg

SEQ ID NO: 3306 - DNA, 15 bp, Homo sapiens
cctgtcttattatag

SEQ ID NO: 3307 - DNA, 15 bp, Homo sapiens
ccctgtcttattata

SEQ ID NO: 3308 - DNA, 15 bp, Homo sapiens
accctgtcttattat

SEQ ID NO: 3309 - DNA, 15 bp, Homo sapiens
gaccctgtcttatta

SEQ ID NO: 3310 - DNA, 15 bp, Homo sapiens
agaccctgtcttatt

SEQ ID NO: 3311 - DNA, 15 bp, Homo sapiens
cagaccctgtcttat

SEQ ID NO: 3312 - DNA, 15 bp, Homo sapiens
ccagaccctgtctta

SEQ ID NO: 3313 - DNA, 15 bp, Homo sapiens
tccagaccctgtctt

SEQ ID NO: 3314 - DNA, 15 bp, Homo sapiens
atccagaccctgtct

SEQ ID NO: 3315 - DNA, 15 bp, Homo sapiens
aatccagaccctgtc

SEQ ID NO: 3316 - DNA, 15 bp, Homo sapiens
aaatccagaccctgt

SEQ ID NO: 3317 - DNA, 15 bp, Homo sapiens
aaaatccagaccctg

SEQ ID NO: 3318 - DNA, 15 bp, Homo sapiens
aaaaatccagaccct

SEQ ID NO: 3319 - DNA, 15 bp, Homo sapiens
aaaaaatccagaccc

SEQ ID NO: 3320 - DNA, 15 bp, Homo sapiens
taaaaaatccagacc

SEQ ID NO: 3321 - DNA, 15 bp, Homo sapiens
ttaaaaaatccagac

SEQ ID NO: 3322 - DNA, 15 bp, Homo sapiens
attaaaaaatccaga

SEQ ID NO: 3323 - DNA, 15 bp, Homo sapiens
gattaaaaaatccag

SEQ ID NO: 3324 - DNA, 15 bp, Homo sapiens
agattaaaaaatcca

SEQ ID NO: 3325 - DNA, 15 bp, Homo sapiens
aagattaaaaaatcc

SEQ ID NO: 3326 - DNA, 15 bp, Homo sapiens
aaagattaaaaaatc

SEQ ID NO: 3327 - DNA, 15 bp, Homo sapiens
aaaagattaaaaaat

SEQ ID NO: 3328 - DNA, 15 bp, Homo sapiens
caaaagattaaaaaa

SEQ ID NO: 3329 - DNA, 15 bp, Homo sapiens
ccaaaagattaaaaa

SEQ ID NO: 3330 - DNA, 15 bp, Homo sapiens
cccaaaagattaaaa

SEQ ID NO: 3331 - DNA, 15 bp, Homo sapiens
tcccaaaagattaaa

SEQ ID NO: 3332 - DNA, 15 bp, Homo sapiens
ttcccaaaagattaa

SEQ ID NO: 3333 - DNA, 15 bp, Homo sapiens
attcccaaaagatta

SEQ ID NO: 3334 - DNA, 15 bp, Homo sapiens
aattcccaaaagatt

SEQ ID NO: 3335 - DNA, 15 bp, Homo sapiens
aaattcccaaaagat

SEQ ID NO: 3336 - DNA, 15 bp, Homo sapiens
gaaattcccaaaaga

SEQ ID NO: 3337 - DNA, 15 bp, Homo sapiens
ggaaattcccaaaag

SEQ ID NO: 3338 - DNA, 15 bp, Homo sapiens
tggaaattcccaaaa

SEQ ID NO: 3339 - DNA, 15 bp, Homo sapiens
gtggaaattcccaaa

SEQ ID NO: 3340 - DNA, 15 bp, Homo sapiens
ggtggaaattcccaa

SEQ ID NO: 3341 - DNA, 15 bp, Homo sapiens
tggtggaaattccca

SEQ ID NO: 3342 - DNA, 15 bp, Homo sapiens
ttggtggaaattccc

SEQ ID NO: 3343 - DNA, 15 bp, Homo sapiens
cttggtggaaattcc

SEQ ID NO: 3344 - DNA, 15 bp, Homo sapiens
ccttggtggaaattc

SEQ ID NO: 3345 - DNA, 15 bp, Homo sapiens
tccttggtggaaatt

SEQ ID NO: 3346 - DNA, 15 bp, Homo sapiens
atccttggtggaaat

SEQ ID NO: 3347 - DNA, 15 bp, Homo sapiens
aatccttggtggaaa

SEQ ID NO: 3348 - DNA, 15 bp, Homo sapiens
aaatccttggtggaa

SEQ ID NO: 3349 - DNA, 15 bp, Homo sapiens
taaatccttggtgga

SEQ ID NO: 3350 - DNA, 15 bp, Homo sapiens
ctaaatccttggtgg

SEQ ID NO: 3351 - DNA, 15 bp, Homo sapiens
cctaaatccttggtg

SEQ ID NO: 3352 - DNA, 15 bp, Homo sapiens
ccctaaatccttggt

SEQ ID NO: 3353 - DNA, 15 bp, Homo sapiens
tccctaaatccttgg

SEQ ID NO: 3354 - DNA, 15 bp, Homo sapiens
ttccctaaatccttg

SEQ ID NO: 3355 - DNA, 15 bp, Homo sapiens
tttccctaaatcctt

SEQ ID NO: 3356 - DNA, 15 bp, Homo sapiens
atttccctaaatcct

SEQ ID NO: 3357 - DNA, 15 bp, Homo sapiens
tatttccctaaatcc

SEQ ID NO: 3358 - DNA, 15 bp, Homo sapiens
ctatttccctaaatc

SEQ ID NO: 3359 - DNA, 15 bp, Homo sapiens
cctatttccctaaat

SEQ ID NO: 3360 - DNA, 15 bp, Homo sapiens
gcctatttccctaaa

SEQ ID NO: 3361 - DNA, 15 bp, Homo sapiens
agcctatttccctaa

SEQ ID NO: 3362 - DNA, 15 bp, Homo sapiens
aagcctatttcccta

SEQ ID NO: 3363 - DNA, 15 bp, Homo sapiens
aaagcctatttccct

SEQ ID NO: 3364 - DNA, 15 bp, Homo sapiens
aaaagcctatttccc

SEQ ID NO: 3365 - DNA, 15 bp, Homo sapiens
taaaagcctatttcc

SEQ ID NO: 3366 - DNA, 15 bp, Homo sapiens
ataaaagcctatttc

SEQ ID NO: 3367 - DNA, 15 bp, Homo sapiens
cataaaagcctattt

SEQ ID NO: 3368 - DNA, 15 bp, Homo sapiens
ccataaaagcctatt

SEQ ID NO: 3369 - DNA, 15 bp, Homo sapiens
cccataaaagcctat

SEQ ID NO: 3370 - DNA, 15 bp, Homo sapiens
gcccataaaagccta

SEQ ID NO: 3371 - DNA, 15 bp, Homo sapiens
agcccataaaagcct

SEQ ID NO: 3372 - DNA, 15 bp, Homo sapiens
aagcccataaaagcc

SEQ ID NO: 3373 - DNA, 15 bp, Homo sapiens
aaagcccataaaagc

SEQ ID NO: 3374 - DNA, 15 bp, Homo sapiens
aaaagcccataaaag

SEQ ID NO: 3375 - DNA, 15 bp, Homo sapiens
gaaaagcccataaaa

SEQ ID NO: 3376 - DNA, 15 bp, Homo sapiens
tgaaaagcccataaa

SEQ ID NO: 3377 - DNA, 15 bp, Homo sapiens
ctgaaaagcccataa

SEQ ID NO: 3378 - DNA, 15 bp, Homo sapiens
cctgaaaagcccata

SEQ ID NO: 3379 - DNA, 15 bp, Homo sapiens
tcctgaaaagcccat

SEQ ID NO: 3380 - DNA, 15 bp, Homo sapiens
atcctgaaaagccca

SEQ ID NO: 3381 - DNA, 15 bp, Homo sapiens
aatcctgaaaagccc

SEQ ID NO: 3382 - DNA, 15 bp, Homo sapiens
aaatcctgaaaagcc

SEQ ID NO: 3383 - DNA, 15 bp, Homo sapiens
gaaatcctgaaaagc

SEQ ID NO: 3384 - DNA, 15 bp, Homo sapiens
agaaatcctgaaaag

SEQ ID NO: 3385 - DNA, 15 bp, Homo sapiens
tagaaatcctgaaaa

SEQ ID NO: 3386 - DNA, 15 bp, Homo sapiens
atagaaatcctgaaa

SEQ ID NO: 3387 - DNA, 15 bp, Homo sapiens
aatagaaatcctgaa

SEQ ID NO: 3388 - DNA, 15 bp, Homo sapiens
aaatagaaatcctga

SEQ ID NO: 3389 - DNA, 15 bp, Homo sapiens
gaaatagaaatcctg

SEQ ID NO: 3390 - DNA, 15 bp, Homo sapiens
tgaaatagaaatcct

SEQ ID NO: 3391 - DNA, 15 bp, Homo sapiens
ttgaaatagaaatcc

SEQ ID NO: 3392 - DNA, 15 bp, Homo sapiens
tttgaaatagaaatc

SEQ ID NO: 3393 - DNA, 15 bp, Homo sapiens
atttgaaatagaaat

SEQ ID NO: 3394 - DNA, 15 bp, Homo sapiens
gatttgaaatagaaa

SEQ ID NO: 3395 - DNA, 15 bp, Homo sapiens
ggatttgaaatagaa

SEQ ID NO: 3396 - DNA, 15 bp, Homo sapiens
gggatttgaaataga

SEQ ID NO: 3397 - DNA, 15 bp, Homo sapiens
tgggatttgaaatag

SEQ ID NO: 3398 - DNA, 15 bp, Homo sapiens
ttgggatttgaaata

SEQ ID NO: 3399 - DNA, 15 bp, Homo sapiens
attgggatttgaaat

SEQ ID NO: 3400 - DNA, 15 bp, Homo sapiens
cattgggatttgaaa

SEQ ID NO: 3401 - DNA, 15 bp, Homo sapiens
tcattgggatttgaa

SEQ ID NO: 3402 - DNA, 15 bp, Homo sapiens
ctcattgggatttga

SEQ ID NO: 3403 - DNA, 15 bp, Homo sapiens
cctcattgggatttg

SEQ ID NO: 3404 - DNA, 15 bp, Homo sapiens
tcctcattgggattt

SEQ ID NO: 3405 - DNA, 15 bp, Homo sapiens
ttcctcattgggatt

SEQ ID NO: 3406 - DNA, 15 bp, Homo sapiens
cttcctcattgggat

SEQ ID NO: 3407 - DNA, 15 bp, Homo sapiens
acttcctcattggga

SEQ ID NO: 3408 - DNA, 15 bp, Homo sapiens
gacttcctcattggg

SEQ ID NO: 3409 - DNA, 15 bp, Homo sapiens
agacttcctcattgg

SEQ ID NO: 3410 - DNA, 15 bp, Homo sapiens
tagacttcctcattg

SEQ ID NO: 3411 - DNA, 15 bp, Homo sapiens
ctagacttcctcatt

SEQ ID NO: 3412 - DNA, 15 bp, Homo sapiens
cctagacttcctcat

SEQ ID NO: 3413 - DNA, 15 bp, Homo sapiens
tcctagacttcctca

SEQ ID NO: 3414 - DNA, 15 bp, Homo sapiens
ttcctagacttcctc

SEQ ID NO: 3415 - DNA, 15 bp, Homo sapiens
tttcctagacttcct

SEQ ID NO: 3416 - DNA, 15 bp, Homo sapiens
gtttcctagacttcc

SEQ ID NO: 3417 - DNA, 15 bp, Homo sapiens
tgtttcctagacttc

SEQ ID NO: 3418 - DNA, 15 bp, Homo sapiens
gtgtttcctagactt

SEQ ID NO: 3419 - DNA, 15 bp, Homo sapiens
agtgtttcctagact

SEQ ID NO: 3420 - DNA, 15 bp, Homo sapiens
aagtgtttcctagac

SEQ ID NO: 3421 - DNA, 15 bp, Homo sapiens
caagtgtttcctaga

SEQ ID NO: 3422 - DNA, 15 bp, Homo sapiens
gcaagtgtttcctag

SEQ ID NO: 3423 - DNA, 15 bp, Homo sapiens
agcaagtgtttccta

SEQ ID NO: 3424 - DNA, 15 bp, Homo sapiens
aagcaagtgtttcct

SEQ ID NO: 3425 - DNA, 15 bp, Homo sapiens
aaagcaagtgtttcc

SEQ ID NO: 3426 - DNA, 15 bp, Homo sapiens
aaaagcaagtgtttc

SEQ ID NO: 3427 - DNA, 15 bp, Homo sapiens
taaaagcaagtgttt

SEQ ID NO: 3428 - DNA, 15 bp, Homo sapiens
ataaaagcaagtgtt

SEQ ID NO: 3429 - DNA, 15 bp, Homo sapiens
aataaaagcaagtgt

SEQ ID NO: 3430 - DNA, 15 bp, Homo sapiens
aaataaaagcaagtg

SEQ ID NO: 3431 - DNA, 15 bp, Homo sapiens
aaaataaaagcaagt

SEQ ID NO: 3432 - DNA, 15 bp, Homo sapiens
gaaaataaaagcaag

SEQ ID NO: 3433 - DNA, 15 bp, Homo sapiens
agaaaataaaagcaa

SEQ ID NO: 3434 - DNA, 15 bp, Homo sapiens
aagaaaataaaagca

SEQ ID NO: 3435 - DNA, 15 bp, Homo sapiens
caagaaaataaaagc

SEQ ID NO: 3436 - DNA, 15 bp, Homo sapiens
gcaagaaaataaaag

SEQ ID NO: 3437 - DNA, 15 bp, Homo sapiens
ggcaagaaaataaaa

SEQ ID NO: 3438 - DNA, 15 bp, Homo sapiens
aggcaagaaaataaa

SEQ ID NO: 3439 - DNA, 15 bp, Homo sapiens
caggcaagaaaataa

SEQ ID NO: 3440 - DNA, 15 bp, Homo sapiens
tcaggcaagaaaata

SEQ ID NO: 3441 - DNA, 15 bp, Homo sapiens
ttcaggcaagaaaat

SEQ ID NO: 3442 - DNA, 15 bp, Homo sapiens
attcaggcaagaaaa

SEQ ID NO: 3443 - DNA, 15 bp, Homo sapiens
tattcaggcaagaaa

SEQ ID NO: 3444 - DNA, 15 bp, Homo sapiens
atattcaggcaagaa

SEQ ID NO: 3445 - DNA, 15 bp, Homo sapiens
catattcaggcaaga

SEQ ID NO: 3446 - DNA, 15 bp, Homo sapiens
acatattcaggcaag

SEQ ID NO: 3447 - DNA, 15 bp, Homo sapiens
gacatattcaggcaa

SEQ ID NO: 3448 - DNA, 15 bp, Homo sapiens
tgacatattcaggca

SEQ ID NO: 3449 - DNA, 15 bp, Homo sapiens
ctgacatattcaggc

SEQ ID NO: 3450 - DNA, 15 bp, Homo sapiens
tctgacatattcagg

SEQ ID NO: 3451 - DNA, 15 bp, Homo sapiens
ttctgacatattcag

SEQ ID NO: 3452 - DNA, 15 bp, Homo sapiens
gttctgacatattca

SEQ ID NO: 3453 - DNA, 15 bp, Homo sapiens
ggttctgacatattc

SEQ ID NO: 3454 - DNA, 15 bp, Homo sapiens
aggttctgacatatt

SEQ ID NO: 3455 - DNA, 15 bp, Homo sapiens
aaggttctgacatat

SEQ ID NO: 3456 - DNA, 15 bp, Homo sapiens
taaggttctgacata

SEQ ID NO: 3457 - DNA, 15 bp, Homo sapiens
ttaaggttctgacat

SEQ ID NO: 3458 - DNA, 15 bp, Homo sapiens
tttaaggttctgaca

SEQ ID NO: 3459 - DNA, 15 bp, Homo sapiens
atttaaggttctgac

SEQ ID NO: 3460 - DNA, 15 bp, Homo sapiens
gatttaaggttctga

SEQ ID NO: 3461 - DNA, 15 bp, Homo sapiens
tgatttaaggttctg

SEQ ID NO: 3462 - DNA, 15 bp, Homo sapiens
gtgatttaaggttct

SEQ ID NO: 3463 - DNA, 15 bp, Homo sapiens
ggtgatttaaggttc

SEQ ID NO: 3464 - DNA, 15 bp, Homo sapiens
gggtgatttaaggtt

SEQ ID NO: 3465 - DNA, 15 bp, Homo sapiens
tgggtgatttaaggt

SEQ ID NO: 3466 - DNA, 15 bp, Homo sapiens
ttgggtgatttaagg

SEQ ID NO: 3467 - DNA, 15 bp, Homo sapiens
attgggtgatttaag

SEQ ID NO: 3468 - DNA, 15 bp, Homo sapiens
gattgggtgatttaa

SEQ ID NO: 3469 - DNA, 15 bp, Homo sapiens
tgattgggtgattta

SEQ ID NO: 3470 - DNA, 15 bp, Homo sapiens
ttgattgggtgattt

SEQ ID NO: 3471 - DNA, 15 bp, Homo sapiens
attgattgggtgatt

SEQ ID NO: 3472 - DNA, 15 bp, Homo sapiens
gattgattgggtgat

SEQ ID NO: 3473 - DNA, 15 bp, Homo sapiens
agattgattgggtga

SEQ ID NO: 3474 - DNA, 15 bp, Homo sapiens
tagattgattgggtg

SEQ ID NO: 3475 - DNA, 15 bp, Homo sapiens
ctagattgattgggt

SEQ ID NO: 3476 - DNA, 15 bp, Homo sapiens
tctagattgattggg

SEQ ID NO: 3477 - DNA, 15 bp, Homo sapiens
ttctagattgattgg

SEQ ID NO: 3478 - DNA, 15 bp, Homo sapiens
cttctagattgattg

SEQ ID NO: 3479 - DNA, 15 bp, Homo sapiens
acttctagattgatt

SEQ ID NO: 3480 - DNA, 15 bp, Homo sapiens
tacttctagattgat

SEQ ID NO: 3481 - DNA, 15 bp, Homo sapiens
gtacttctagattga

SEQ ID NO: 3482 - DNA, 15 bp, Homo sapiens
agtacttctagattg

SEQ ID NO: 3483 - DNA, 15 bp, Homo sapiens
tagtacttctagatt

SEQ ID NO: 3484 - DNA, 15 bp, Homo sapiens
gtagtacttctagat

SEQ ID NO: 3485 - DNA, 15 bp, Homo sapiens
tgtagtacttctaga

SEQ ID NO: 3486 - DNA, 15 bp, Homo sapiens
ctgtagtacttctag

SEQ ID NO: 3487 - DNA, 15 bp, Homo sapiens
actgtagtacttcta

SEQ ID NO: 3488 - DNA, 15 bp, Homo sapiens
aactgtagtacttct

SEQ ID NO: 3489 - DNA, 15 bp, Homo sapiens
caactgtagtacttc

SEQ ID NO: 3490 - DNA, 15 bp, Homo sapiens
tcaactgtagtactt

SEQ ID NO: 3491 - DNA, 15 bp, Homo sapiens
atcaactgtagtact

SEQ ID NO: 3492 - DNA, 15 bp, Homo sapiens
aatcaactgtagtac

SEQ ID NO: 3493 - DNA, 15 bp, Homo sapiens
taatcaactgtagta

SEQ ID NO: 3494 - DNA, 15 bp, Homo sapiens
ttaatcaactgtagt

SEQ ID NO: 3495 - DNA, 15 bp, Homo sapiens
tttaatcaactgtag

SEQ ID NO: 3496 - DNA, 15 bp, Homo sapiens
ctttaatcaactgta

SEQ ID NO: 3497 - DNA, 15 bp, Homo sapiens
actttaatcaactgt

SEQ ID NO: 3498 - DNA, 15 bp, Homo sapiens
tactttaatcaactg

SEQ ID NO: 3499 - DNA, 15 bp, Homo sapiens
ttactttaatcaact

SEQ ID NO: 3500 - DNA, 15 bp, Homo sapiens
cttactttaatcaac

SEQ ID NO: 3501 - DNA, 15 bp, Homo sapiens
acttactttaatcaa

SEQ ID NO: 3502 - DNA, 15 bp, Homo sapiens
gacttactttaatca

SEQ ID NO: 3503 - DNA, 15 bp, Homo sapiens
tgacttactttaatc

SEQ ID NO: 3504 - DNA, 15 bp, Homo sapiens
gtgacttactttaat

SEQ ID NO: 3505 - DNA, 15 bp, Homo sapiens
ggtgacttactttaa

SEQ ID NO: 3506 - DNA, 15 bp, Homo sapiens
tggtgacttacttta

SEQ ID NO: 3507 - DNA, 15 bp, Homo sapiens
gtggtgacttacttt

SEQ ID NO: 3508 - DNA, 15 bp, Homo sapiens
tgtggtgacttactt

SEQ ID NO: 3509 - DNA, 15 bp, Homo sapiens
ctgtggtgacttact

SEQ ID NO: 3510 - DNA, 15 bp, Homo sapiens
cctgtggtgacttac

SEQ ID NO: 3511 - DNA, 15 bp, Homo sapiens
acctgtggtgactta

SEQ ID NO: 3512 - DNA, 15 bp, Homo sapiens
gacctgtggtgactt

SEQ ID NO: 3513 - DNA, 15 bp, Homo sapiens
tgacctgtggtgact

SEQ ID NO: 3514 - DNA, 15 bp, Homo sapiens
gtgacctgtggtgac

SEQ ID NO: 3515 - DNA, 15 bp, Homo sapiens
ggtgacctgtggtga

SEQ ID NO: 3516 - DNA, 15 bp, Homo sapiens
gggtgacctgtggtg

SEQ ID NO: 3517 - DNA, 15 bp, Homo sapiens
tgggtgacctgtggt

SEQ ID NO: 3518 - DNA, 15 bp, Homo sapiens
atgggtgacctgtgg

SEQ ID NO: 3519 - DNA, 15 bp, Homo sapiens
aatgggtgacctgtg

SEQ ID NO: 3520 - DNA, 15 bp, Homo sapiens
gaatgggtgacctgt

SEQ ID NO: 3521 - DNA, 15 bp, Homo sapiens
cgaatgggtgacctg

SEQ ID NO: 3522 - DNA, 15 bp, Homo sapiens
acgaatgggtgacct

SEQ ID NO: 3523 - DNA, 15 bp, Homo sapiens
cacgaatgggtgacc

SEQ ID NO: 3524 - DNA, 15 bp, Homo sapiens
ccacgaatgggtgac

SEQ ID NO: 3525 - DNA, 15 bp, Homo sapiens
gccacgaatgggtga

SEQ ID NO: 3526 - DNA, 15 bp, Homo sapiens
tgccacgaatgggtg

SEQ ID NO: 3527 - DNA, 15 bp, Homo sapiens
ctgccacgaatgggt

SEQ ID NO: 3528 - DNA, 15 bp, Homo sapiens
cctgccacgaatggg

SEQ ID NO: 3529 - DNA, 15 bp, Homo sapiens
acctgccacgaatgg

SEQ ID NO: 3530 - DNA, 15 bp, Homo sapiens
gacctgccacgaatg

SEQ ID NO: 3531 - DNA, 15 bp, Homo sapiens
tgacctgccacgaat

SEQ ID NO: 3532 - DNA, 15 bp, Homo sapiens
ctgacctgccacgaa

SEQ ID NO: 3533 - DNA, 15 bp, Homo sapiens
gctgacctgccacga

SEQ ID NO: 3534 - DNA, 15 bp, Homo sapiens
agctgacctgccacg

SEQ ID NO: 3535 - DNA, 15 bp, Homo sapiens
tagctgacctgccac

SEQ ID NO: 3536 - DNA, 15 bp, Homo sapiens
ctagctgacctgcca

SEQ ID NO: 3537 - DNA, 15 bp, Homo sapiens
cctagctgacctgcc

SEQ ID NO: 3538 - DNA, 15 bp, Homo sapiens
acctagctgacctgc

SEQ ID NO: 3539 - DNA, 15 bp, Homo sapiens
cacctagctgacctg

SEQ ID NO: 3540 - DNA, 15 bp, Homo sapiens
ccacctagctgacct

SEQ ID NO: 3541 - DNA, 15 bp, Homo sapiens
gccacctagctgacc

SEQ ID NO: 3542 - DNA, 15 bp, Homo sapiens
agccacctagctgac

SEQ ID NO: 3543 - DNA, 15 bp, Homo sapiens
cagccacctagctga

SEQ ID NO: 3544 - DNA, 15 bp, Homo sapiens
tcagccacctagctg

SEQ ID NO: 3545 - DNA, 15 bp, Homo sapiens
atcagccacctagct

SEQ ID NO: 3546 - DNA, 15 bp, Homo sapiens
gatcagccacctagc

SEQ ID NO: 3547 - DNA, 15 bp, Homo sapiens
tgatcagccacctag

SEQ ID NO: 3548 - DNA, 15 bp, Homo sapiens
gtgatcagccaccta

SEQ ID NO: 3549 - DNA, 15 bp, Homo sapiens
agtgatcagccacct

SEQ ID NO: 3550 - DNA, 15 bp, Homo sapiens
cagtgatcagccacc

SEQ ID NO: 3551 - DNA, 15 bp, Homo sapiens
ccagtgatcagccac

SEQ ID NO: 3552 - DNA, 15 bp, Homo sapiens
tccagtgatcagcca

SEQ ID NO: 3553 - DNA, 15 bp, Homo sapiens
ttccagtgatcagcc

SEQ ID NO: 3554 - DNA, 15 bp, Homo sapiens
attccagtgatcagc

SEQ ID NO: 3555 - DNA, 15 bp, Homo sapiens
tattccagtgatcag

SEQ ID NO: 3556 - DNA, 15 bp, Homo sapiens
gtattccagtgatca

SEQ ID NO: 3557 - DNA, 15 bp, Homo sapiens
tgtattccagtgatc

SEQ ID NO: 3558 - DNA, 15 bp, Homo sapiens
ctgtattccagtgat

SEQ ID NO: 3559 - DNA, 15 bp, Homo sapiens
actgtattccagtga

SEQ ID NO: 3560 - DNA, 15 bp, Homo sapiens
gactgtattccagtg

SEQ ID NO: 3561 - DNA, 15 bp, Homo sapiens
tgactgtattccagt

SEQ ID NO: 3562 - DNA, 15 bp, Homo sapiens
atgactgtattccag

SEQ ID NO: 3563 - DNA, 15 bp, Homo sapiens
tatgactgtattcca

SEQ ID NO: 3564 - DNA, 15 bp, Homo sapiens
atatgactgtattcc

SEQ ID NO: 3565 - DNA, 15 bp, Homo sapiens
gatatgactgtattc

SEQ ID NO: 3566 - DNA, 15 bp, Homo sapiens
ggatatgactgtatt

SEQ ID NO: 3567 - DNA, 15 bp, Homo sapiens
gggatatgactgtat

SEQ ID NO: 3568 - DNA, 15 bp, Homo sapiens
ggggatatgactgta

SEQ ID NO: 3569 - DNA, 15 bp, Homo sapiens
tggggatatgactgt

SEQ ID NO: 3570 - DNA, 15 bp, Homo sapiens
ctggggatatgactg

SEQ ID NO: 3571 - DNA, 15 bp, Homo sapiens
cctggggatatgact

SEQ ID NO: 3572 - DNA, 15 bp, Homo sapiens
gcctggggatatgac

SEQ ID NO: 3573 - DNA, 15 bp, Homo sapiens
tgcctggggatatga

SEQ ID NO: 3574 - DNA, 15 bp, Homo sapiens
atgcctggggatatg

SEQ ID NO: 3575 - DNA, 15 bp, Homo sapiens
tatgcctggggatat

SEQ ID NO: 3576 - DNA, 15 bp, Homo sapiens
gtatgcctggggata

SEQ ID NO: 3577 - DNA, 15 bp, Homo sapiens
tgtatgcctggggat

SEQ ID NO: 3578 - DNA, 15 bp, Homo sapiens
gtgtatgcctgggga

SEQ ID NO: 3579 - DNA, 15 bp, Homo sapiens
tgtgtatgcctgggg

SEQ ID NO: 3580 - DNA, 15 bp, Homo sapiens
gtgtgtatgcctggg

SEQ ID NO: 3581 - DNA, 15 bp, Homo sapiens
cgtgtgtatgcctgg

SEQ ID NO: 3582 - DNA, 15 bp, Homo sapiens
tcgtgtgtatgcctg

SEQ ID NO: 3583 - DNA, 15 bp, Homo sapiens
ctcgtgtgtatgcct

SEQ ID NO: 3584 - DNA, 15 bp, Homo sapiens
gctcgtgtgtatgcc

SEQ ID NO: 3585 - DNA, 15 bp, Homo sapiens
ggctcgtgtgtatgc

SEQ ID NO: 3586 - DNA, 15 bp, Homo sapiens
aggctcgtgtgtatg

SEQ ID NO: 3587 - DNA, 15 bp, Homo sapiens
gaggctcgtgtgtat

SEQ ID NO: 3588 - DNA, 15 bp, Homo sapiens
tgaggctcgtgtgta

SEQ ID NO: 3589 - DNA, 15 bp, Homo sapiens
gtgaggctcgtgtgt

SEQ ID NO: 3590 - DNA, 15 bp, Homo sapiens
agtgaggctcgtgtg

SEQ ID NO: 3591 - DNA, 15 bp, Homo sapiens
aagtgaggctcgtgt

SEQ ID NO: 3592 - DNA, 15 bp, Homo sapiens
caagtgaggctcgtg

SEQ ID NO: 3593 - DNA, 15 bp, Homo sapiens
tcaagtgaggctcgt

SEQ ID NO: 3594 - DNA, 15 bp, Homo sapiens
gtcaagtgaggctcg

SEQ ID NO: 3595 - DNA, 15 bp, Homo sapiens
cgtcaagtgaggctc

SEQ ID NO: 3596 - DNA, 15 bp, Homo sapiens
tcgtcaagtgaggct

SEQ ID NO: 3597 - DNA, 15 bp, Homo sapiens
atcgtcaagtgaggc

SEQ ID NO: 3598 - DNA, 15 bp, Homo sapiens
gatcgtcaagtgagg

SEQ ID NO: 3599 - DNA, 15 bp, Homo sapiens
ggatcgtcaagtgag

SEQ ID NO: 3600 - DNA, 15 bp, Homo sapiens
gggatcgtcaagtga

SEQ ID NO: 3601 - DNA, 15 bp, Homo sapiens
tgggatcgtcaagtg

SEQ ID NO: 3602 - DNA, 15 bp, Homo sapiens
ttgggatcgtcaagt

SEQ ID NO: 3603 - DNA, 15 bp, Homo sapiens
tttgggatcgtcaag

SEQ ID NO: 3604 - DNA, 15 bp, Homo sapiens
ctttgggatcgtcaa

SEQ ID NO: 3605 - DNA, 15 bp, Homo sapiens
actttgggatcgtca

SEQ ID NO: 3606 - DNA, 15 bp, Homo sapiens
aactttgggatcgtc

SEQ ID NO: 3607 - DNA, 15 bp, Homo sapiens
aaactttgggatcgt

SEQ ID NO: 3608 - DNA, 15 bp, Homo sapiens
caaactttgggatcg

SEQ ID NO: 3609 - DNA, 15 bp, Homo sapiens
acaaactttgggatc

SEQ ID NO: 3610 - DNA, 15 bp, Homo sapiens
tacaaactttgggat

SEQ ID NO: 3611 - DNA, 15 bp, Homo sapiens
gtacaaactttggga

SEQ ID NO: 3612 - DNA, 15 bp, Homo sapiens
tgtacaaactttggg

SEQ ID NO: 3613 - DNA, 15 bp, Homo sapiens
atgtacaaactttgg

SEQ ID NO: 3614 - DNA, 15 bp, Homo sapiens
gatgtacaaactttg

SEQ ID NO: 3615 - DNA, 15 bp, Homo sapiens
agatgtacaaacttt

SEQ ID NO: 3616 - DNA, 15 bp, Homo sapiens
cagatgtacaaactt

SEQ ID NO: 3617 - DNA, 15 bp, Homo sapiens
tcagatgtacaaact

SEQ ID NO: 3618 - DNA, 15 bp, Homo sapiens
ctcagatgtacaaac

SEQ ID NO: 3619 - DNA, 15 bp, Homo sapiens
gctcagatgtacaaa

SEQ ID NO: 3620 - DNA, 15 bp, Homo sapiens
agctcagatgtacaa

SEQ ID NO: 3621 - DNA, 15 bp, Homo sapiens
aagctcagatgtaca

SEQ ID NO: 3622 - DNA, 15 bp, Homo sapiens
caagctcagatgtac

SEQ ID NO: 3623 - DNA, 15 bp, Homo sapiens
tcaagctcagatgta

SEQ ID NO: 3624 - DNA, 15 bp, Homo sapiens
ctcaagctcagatgt

SEQ ID NO: 3625 - DNA, 15 bp, Homo sapiens
tctcaagctcagatg

SEQ ID NO: 3626 - DNA, 15 bp, Homo sapiens
gtctcaagctcagat

SEQ ID NO: 3627 - DNA, 15 bp, Homo sapiens
cgtctcaagctcaga

SEQ ID NO: 3628 - DNA, 15 bp, Homo sapiens
acgtctcaagctcag

SEQ ID NO: 3629 - DNA, 15 bp, Homo sapiens
cacgtctcaagctca

SEQ ID NO: 3630 - DNA, 15 bp, Homo sapiens
tcacgtctcaagctc

SEQ ID NO: 3631 - DNA, 15 bp, Homo sapiens
gtcacgtctcaagct

SEQ ID NO: 3632 - DNA, 15 bp, Homo sapiens
tgtcacgtctcaagc

SEQ ID NO: 3633 - DNA, 15 bp, Homo sapiens
ttgtcacgtctcaag

SEQ ID NO: 3634 - DNA, 15 bp, Homo sapiens
cttgtcacgtctcaa

SEQ ID NO: 3635 - DNA, 15 bp, Homo sapiens
acttgtcacgtctca

SEQ ID NO: 3636 - DNA, 15 bp, Homo sapiens
aacttgtcacgtctc

SEQ ID NO: 3637 - DNA, 15 bp, Homo sapiens
caacttgtcacgtct

SEQ ID NO: 3638 - DNA, 15 bp, Homo sapiens
tcaacttgtcacgtc

SEQ ID NO: 3639 - DNA, 15 bp, Homo sapiens
ctcaacttgtcacgt

SEQ ID NO: 3640 - DNA, 15 bp, Homo sapiens
cctcaacttgtcacg

SEQ ID NO: 3641 - DNA, 15 bp, Homo sapiens
acctcaacttgtcac

SEQ ID NO: 3642 - DNA, 15 bp, Homo sapiens
gacctcaacttgtca

SEQ ID NO: 3643 - DNA, 15 bp, Homo sapiens
agacctcaacttgtc

SEQ ID NO: 3644 - DNA, 15 bp, Homo sapiens
gagacctcaacttgt

SEQ ID NO: 3645 - DNA, 15 bp, Homo sapiens
agagacctcaacttg

SEQ ID NO: 3646 - DNA, 15 bp, Homo sapiens
cagagacctcaactt

SEQ ID NO: 3647 - DNA, 15 bp, Homo sapiens
gcagagacctcaact

SEQ ID NO: 3648 - DNA, 15 bp, Homo sapiens
agcagagacctcaac

SEQ ID NO: 3649 - DNA, 15 bp, Homo sapiens
aagcagagacctcaa

SEQ ID NO: 3650 - DNA, 15 bp, Homo sapiens
aaagcagagacctca

SEQ ID NO: 3651 - DNA, 15 bp, Homo sapiens
caaagcagagacctc

SEQ ID NO: 3652 - DNA, 15 bp, Homo sapiens
acaaagcagagacct

SEQ ID NO: 3653 - DNA, 15 bp, Homo sapiens
aacaaagcagagacc

SEQ ID NO: 3654 - DNA, 15 bp, Homo sapiens
gaacaaagcagagac

SEQ ID NO: 3655 - DNA, 15 bp, Homo sapiens
agaacaaagcagaga

SEQ ID NO: 3656 - DNA, 15 bp, Homo sapiens
aagaacaaagcagag

SEQ ID NO: 3657 - DNA, 15 bp, Homo sapiens
gaagaacaaagcaga

SEQ ID NO: 3658 - DNA, 15 bp, Homo sapiens
tgaagaacaaagcag

SEQ ID NO: 3659 - DNA, 15 bp, Homo sapiens
atgaagaacaaagca

SEQ ID NO: 3660 - DNA, 15 bp, Homo sapiens
tatgaagaacaaagc

SEQ ID NO: 3661 - DNA, 15 bp, Homo sapiens
ctatgaagaacaaag

SEQ ID NO: 3662 - DNA, 15 bp, Homo sapiens
actatgaagaacaaa

SEQ ID NO: 3663 - DNA, 15 bp, Homo sapiens
aactatgaagaacaa

SEQ ID NO: 3664 - DNA, 15 bp, Homo sapiens
caactatgaagaaca

SEQ ID NO: 3665 - DNA, 15 bp, Homo sapiens
ccaactatgaagaac

SEQ ID NO: 3666 - DNA, 15 bp, Homo sapiens
gccaactatgaagaa

SEQ ID NO: 3667 - DNA, 15 bp, Homo sapiens
tgccaactatgaaga

SEQ ID NO: 3668 - DNA, 15 bp, Homo sapiens
ctgccaactatgaag

SEQ ID NO: 3669 - DNA, 15 bp, Homo sapiens
actgccaactatgaa

SEQ ID NO: 3670 - DNA, 15 bp, Homo sapiens
aactgccaactatga

SEQ ID NO: 3671 - DNA, 15 bp, Homo sapiens
aaactgccaactatg

SEQ ID NO: 3672 - DNA, 15 bp, Homo sapiens
caaactgccaactat

SEQ ID NO: 3673 - DNA, 15 bp, Homo sapiens
acaaactgccaacta

SEQ ID NO: 3674 - DNA, 15 bp, Homo sapiens
gacaaactgccaact

SEQ ID NO: 3675 - DNA, 15 bp, Homo sapiens
agacaaactgccaac

SEQ ID NO: 3676 - DNA, 15 bp, Homo sapiens
gagacaaactgccaa

SEQ ID NO: 3677 - DNA, 15 bp, Homo sapiens
ggagacaaactgcca

SEQ ID NO: 3678 - DNA, 15 bp, Homo sapiens
aggagacaaactgcc

SEQ ID NO: 3679 - DNA, 15 bp, Homo sapiens
gaggagacaaactgc

SEQ ID NO: 3680 - DNA, 15 bp, Homo sapiens
cgaggagacaaactg

SEQ ID NO: 3681 - DNA, 15 bp, Homo sapiens
ccgaggagacaaact

SEQ ID NO: 3682 - DNA, 15 bp, Homo sapiens
cccgaggagacaaac

SEQ ID NO: 3683 - DNA, 15 bp, Homo sapiens
acccgaggagacaaa

SEQ ID NO: 3684 - DNA, 15 bp, Homo sapiens
cacccgaggagacaa

SEQ ID NO: 3685 - DNA, 15 bp, Homo sapiens
gcacccgaggagaca

SEQ ID NO: 3686 - DNA, 15 bp, Homo sapiens
ggcacccgaggagac

SEQ ID NO: 3687 - DNA, 15 bp, Homo sapiens
gggcacccgaggaga

SEQ ID NO: 3688 - DNA, 15 bp, Homo sapiens
ggggcacccgaggag

SEQ ID NO: 3689 - DNA, 15 bp, Homo sapiens
aggggcacccgagga

SEQ ID NO: 3690 - DNA, 15 bp, Homo sapiens
gaggggcacccgagg

SEQ ID NO: 3691 - DNA, 15 bp, Homo sapiens
ggaggggcacccgag

SEQ ID NO: 3692 - DNA, 15 bp, Homo sapiens
cggaggggcacccga

SEQ ID NO: 3693 - DNA, 15 bp, Homo sapiens
ccggaggggcacccg

SEQ ID NO: 3694 - DNA, 15 bp, Homo sapiens
accggaggggcaccc

SEQ ID NO: 3695 - DNA, 15 bp, Homo sapiens
aaccggaggggcacc

SEQ ID NO: 3696 - DNA, 15 bp, Homo sapiens
taaccggaggggcac

SEQ ID NO: 3697 - DNA, 15 bp, Homo sapiens
ctaaccggaggggca

SEQ ID NO: 3698 - DNA, 15 bp, Homo sapiens
gctaaccggaggggc

SEQ ID NO: 3699 - DNA, 15 bp, Homo sapiens
agctaaccggagggg

SEQ ID NO: 3700 - DNA, 15 bp, Homo sapiens
cagctaaccggaggg

SEQ ID NO: 3701 - DNA, 15 bp, Homo sapiens
acagctaaccggagg

SEQ ID NO: 3702 - DNA, 15 bp, Homo sapiens
aacagctaaccggag

SEQ ID NO: 3703 - DNA, 15 bp, Homo sapiens
aaacagctaaccgga

SEQ ID NO: 3704 - DNA, 15 bp, Homo sapiens
taaacagctaaccgg

SEQ ID NO: 3705 - DNA, 15 bp, Homo sapiens
ataaacagctaaccg

SEQ ID NO: 3706 - DNA, 15 bp, Homo sapiens
gataaacagctaacc

SEQ ID NO: 3707 - DNA, 15 bp, Homo sapiens
tgataaacagctaac

SEQ ID NO: 3708 - DNA, 15 bp, Homo sapiens
atgataaacagctaa

SEQ ID NO: 3709 - DNA, 15 bp, Homo sapiens
tatgataaacagcta

SEQ ID NO: 3710 - DNA, 15 bp, Homo sapiens
gtatgataaacagct

SEQ ID NO: 3711 - DNA, 15 bp, Homo sapiens
cgtatgataaacagc

SEQ ID NO: 3712 - DNA, 15 bp, Homo sapiens
acgtatgataaacag

SEQ ID NO: 3713 - DNA, 15 bp, Homo sapiens
gacgtatgataaaca

SEQ ID NO: 3714 - DNA, 15 bp, Homo sapiens
agacgtatgataaac

SEQ ID NO: 3715 - DNA, 15 bp, Homo sapiens
tagacgtatgataaa

SEQ ID NO: 3716 - DNA, 15 bp, Homo sapiens
ctagacgtatgataa

SEQ ID NO: 3717 - DNA, 15 bp, Homo sapiens
gctagacgtatgata

SEQ ID NO: 3718 - DNA, 15 bp, Homo sapiens
ggctagacgtatgat

SEQ ID NO: 3719 - DNA, 15 bp, Homo sapiens
gggctagacgtatga

SEQ ID NO: 3720 - DNA, 15 bp, Homo sapiens
agggctagacgtatg

SEQ ID NO: 3721 - DNA, 15 bp, Homo sapiens
tagggctagacgtat

SEQ ID NO: 3722 - DNA, 15 bp, Homo sapiens
atagggctagacgta

SEQ ID NO: 3723 - DNA, 15 bp, Homo sapiens
gatagggctagacgt

SEQ ID NO: 3724 - DNA, 15 bp, Homo sapiens
tgatagggctagacg

SEQ ID NO: 3725 - DNA, 15 bp, Homo sapiens
ttgatagggctagac

SEQ ID NO: 3726 - DNA, 15 bp, Homo sapiens
gttgatagggctaga

SEQ ID NO: 3727 - DNA, 15 bp, Homo sapiens
tgttgatagggctag

SEQ ID NO: 3728 - DNA, 15 bp, Homo sapiens
ctgttgatagggcta

SEQ ID NO: 3729 - DNA, 15 bp, Homo sapiens
actgttgatagggct

SEQ ID NO: 3730 - DNA, 15 bp, Homo sapiens
cactgttgatagggc

SEQ ID NO: 3731 - DNA, 15 bp, Homo sapiens
gcactgttgataggg

SEQ ID NO: 3732 - DNA, 15 bp, Homo sapiens
tgcactgttgatagg

SEQ ID NO: 3733 - DNA, 15 bp, Homo sapiens
ctgcactgttgatag

SEQ ID NO: 3734 - DNA, 15 bp, Homo sapiens
cctgcactgttgata

SEQ ID NO: 3735 - DNA, 15 bp, Homo sapiens
gcctgcactgttgat

SEQ ID NO: 3736 - DNA, 15 bp, Homo sapiens
tgcctgcactgttga

SEQ ID NO: 3737 - DNA, 15 bp, Homo sapiens
ctgcctgcactgttg

SEQ ID NO: 3738 - DNA, 15 bp, Homo sapiens
gctgcctgcactgtt

SEQ ID NO: 3739 - DNA, 15 bp, Homo sapiens
agctgcctgcactgt

SEQ ID NO: 3740 - DNA, 15 bp, Homo sapiens
aagctgcctgcactg

SEQ ID NO: 3741 - DNA, 15 bp, Homo sapiens
gaagctgcctgcact

SEQ ID NO: 3742 - DNA, 15 bp, Homo sapiens
ggaagctgcctgcac

SEQ ID NO: 3743 - DNA, 15 bp, Homo sapiens
tggaagctgcctgca

SEQ ID NO: 3744 - DNA, 15 bp, Homo sapiens
ctggaagctgcctgc

SEQ ID NO: 3745 - DNA, 15 bp, Homo sapiens
tctggaagctgcctg

SEQ ID NO: 3746 - DNA, 15 bp, Homo sapiens
ctctggaagctgcct

SEQ ID NO: 3747 - DNA, 15 bp, Homo sapiens
actctggaagctgcc

SEQ ID NO: 3748 - DNA, 15 bp, Homo sapiens
tactctggaagctgc

SEQ ID NO: 3749 - DNA, 15 bp, Homo sapiens
atactctggaagctg

SEQ ID NO: 3750 - DNA, 15 bp, Homo sapiens
tatactctggaagct

SEQ ID NO: 3751 - DNA, 15 bp, Homo sapiens
ctatactctggaagc

SEQ ID NO: 3752 - DNA, 15 bp, Homo sapiens
actatactctggaag

SEQ ID NO: 3753 - DNA, 15 bp, Homo sapiens
aactatactctggaa

SEQ ID NO: 3754 - DNA, 15 bp, Homo sapiens
aaactatactctgga

SEQ ID NO: 3755 - DNA, 15 bp, Homo sapiens
aaaactatactctgg

SEQ ID NO: 3756 - DNA, 15 bp, Homo sapiens
gaaaactatactctg

SEQ ID NO: 3757 - DNA, 15 bp, Homo sapiens
agaaaactatactct

SEQ ID NO: 3758 - DNA, 15 bp, Homo sapiens
gagaaaactatactc

SEQ ID NO: 3759 - DNA, 15 bp, Homo sapiens
agagaaaactatact

SEQ ID NO: 3760 - DNA, 15 bp, Homo sapiens
cagagaaaactatac

SEQ ID NO: 3761 - DNA, 15 bp, Homo sapiens
gcagagaaaactata

SEQ ID NO: 3762 - DNA, 15 bp, Homo sapiens
tgcagagaaaactat

SEQ ID NO: 3763 - DNA, 15 bp, Homo sapiens
ttgcagagaaaacta

SEQ ID NO: 3764 - DNA, 15 bp, Homo sapiens
tttgcagagaaaact

SEQ ID NO: 3765 - DNA, 15 bp, Homo sapiens
ctttgcagagaaaac

SEQ ID NO: 3766 - DNA, 15 bp, Homo sapiens
actttgcagagaaaa

SEQ ID NO: 3767 - DNA, 15 bp, Homo sapiens
cactttgcagagaaa

SEQ ID NO: 3768 - DNA, 15 bp, Homo sapiens
gcactttgcagagaa

SEQ ID NO: 3769 - DNA, 15 bp, Homo sapiens
ggcactttgcagaga

SEQ ID NO: 3770 - DNA, 15 bp, Homo sapiens
aggcactttgcagag

SEQ ID NO: 3771 - DNA, 15 bp, Homo sapiens
caggcactttgcaga

SEQ ID NO: 3772 - DNA, 15 bp, Homo sapiens
ccaggcactttgcag

SEQ ID NO: 3773 - DNA, 15 bp, Homo sapiens
accaggcactttgca

SEQ ID NO: 3774 - DNA, 15 bp, Homo sapiens
caccaggcactttgc

SEQ ID NO: 3775 - DNA, 15 bp, Homo sapiens
ccaccaggcactttg

SEQ ID NO: 3776 - DNA, 15 bp, Homo sapiens
tccaccaggcacttt

SEQ ID NO: 3777 - DNA, 15 bp, Homo sapiens
ctccaccaggcactt

SEQ ID NO: 3778 - DNA, 15 bp, Homo sapiens
cctccaccaggcact

SEQ ID NO: 3779 - DNA, 15 bp, Homo sapiens
ccctccaccaggcac

SEQ ID NO: 3780 - DNA, 15 bp, Homo sapiens
cccctccaccaggca

SEQ ID NO: 3781 - DNA, 15 bp, Homo sapiens
acccctccaccaggc

SEQ ID NO: 3782 - DNA, 15 bp, Homo sapiens
tacccctccaccagg

SEQ ID NO: 3783 - DNA, 15 bp, Homo sapiens
gtacccctccaccag

SEQ ID NO: 3784 - DNA, 15 bp, Homo sapiens
ggtacccctccacca

SEQ ID NO: 3785 - DNA, 15 bp, Homo sapiens
aggtacccctccacc

SEQ ID NO: 3786 - DNA, 15 bp, Homo sapiens
gaggtacccctccac

SEQ ID NO: 3787 - DNA, 15 bp, Homo sapiens
ggaggtacccctcca

SEQ ID NO: 3788 - DNA, 15 bp, Homo sapiens
aggaggtacccctcc

SEQ ID NO: 3789 - DNA, 15 bp, Homo sapiens
aaggaggtacccctc

SEQ ID NO: 3790 - DNA, 15 bp, Homo sapiens
aaaggaggtacccct

SEQ ID NO: 3791 - DNA, 15 bp, Homo sapiens
aaaaggaggtacccc

SEQ ID NO: 3792 - DNA, 15 bp, Homo sapiens
gaaaaggaggtaccc

SEQ ID NO: 3793 - DNA, 15 bp, Homo sapiens
ggaaaaggaggtacc

SEQ ID NO: 3794 - DNA, 15 bp, Homo sapiens
tggaaaaggaggtac

SEQ ID NO: 3795 - DNA, 15 bp, Homo sapiens
atggaaaaggaggta

SEQ ID NO: 3796 - DNA, 15 bp, Homo sapiens
aatggaaaaggaggt

SEQ ID NO: 3797 - DNA, 15 bp, Homo sapiens
caatggaaaaggagg

SEQ ID NO: 3798 - DNA, 15 bp, Homo sapiens
acaatggaaaaggag

SEQ ID NO: 3799 - DNA, 15 bp, Homo sapiens
gacaatggaaaagga

SEQ ID NO: 3800 - DNA, 15 bp, Homo sapiens
ggacaatggaaaagg

SEQ ID NO: 3801 - DNA, 15 bp, Homo sapiens
aggacaatggaaaag

SEQ ID NO: 3802 - DNA, 15 bp, Homo sapiens
taggacaatggaaaa

SEQ ID NO: 3803 - DNA, 15 bp, Homo sapiens
ttaggacaatggaaa

SEQ ID NO: 3804 - DNA, 15 bp, Homo sapiens
attaggacaatggaa

SEQ ID NO: 3805 - DNA, 15 bp, Homo sapiens
cattaggacaatgga

SEQ ID NO: 3806 - DNA, 15 bp, Homo sapiens
ccattaggacaatgg

SEQ ID NO: 3807 - DNA, 15 bp, Homo sapiens
gccattaggacaatg

SEQ ID NO: 3808 - DNA, 15 bp, Homo sapiens
agccattaggacaat

SEQ ID NO: 3809 - DNA, 15 bp, Homo sapiens
gagccattaggacaa

SEQ ID NO: 3810 - DNA, 15 bp, Homo sapiens
ggagccattaggaca

SEQ ID NO: 3811 - DNA, 15 bp, Homo sapiens
tggagccattaggac

SEQ ID NO: 3812 - DNA, 15 bp, Homo sapiens
gtggagccattagga

SEQ ID NO: 3813 - DNA, 15 bp, Homo sapiens
agtggagccattagg

SEQ ID NO: 3814 - DNA, 15 bp, Homo sapiens
cagtggagccattag

SEQ ID NO: 3815 - DNA, 15 bp, Homo sapiens
ccagtggagccatta

SEQ ID NO: 3816 - DNA, 15 bp, Homo sapiens
cccagtggagccatt

SEQ ID NO: 3817 - DNA, 15 bp, Homo sapiens
gcccagtggagccat

SEQ ID NO: 3818 - DNA, 15 bp, Homo sapiens
agcccagtggagcca

SEQ ID NO: 3819 - DNA, 15 bp, Homo sapiens
aagcccagtggagcc

SEQ ID NO: 3820 - DNA, 15 bp, Homo sapiens
gaagcccagtggagc

SEQ ID NO: 3821 - DNA, 15 bp, Homo sapiens
ggaagcccagtggag

SEQ ID NO: 3822 - DNA, 15 bp, Homo sapiens
tggaagcccagtgga

SEQ ID NO: 3823 - DNA, 15 bp, Homo sapiens
atggaagcccagtgg

SEQ ID NO: 3824 - DNA, 15 bp, Homo sapiens
tatggaagcccagtg

SEQ ID NO: 3825 - DNA, 15 bp, Homo sapiens
gtatggaagcccagt

SEQ ID NO: 3826 - DNA, 15 bp, Homo sapiens
ggtatggaagcccag

SEQ ID NO: 3827 - DNA, 15 bp, Homo sapiens
tggtatggaagccca

SEQ ID NO: 3828 - DNA, 15 bp, Homo sapiens
ctggtatggaagccc

SEQ ID NO: 3829 - DNA, 15 bp, Homo sapiens
gctggtatggaagcc

SEQ ID NO: 3830 - DNA, 15 bp, Homo sapiens
ggctggtatggaagc

SEQ ID NO: 3831 - DNA, 15 bp, Homo sapiens
gggctggtatggaag

SEQ ID NO: 3832 - DNA, 15 bp, Homo sapiens
agggctggtatggaa

SEQ ID NO: 3833 - DNA, 15 bp, Homo sapiens
aagggctggtatgga

SEQ ID NO: 3834 - DNA, 15 bp, Homo sapiens
aaagggctggtatgg

SEQ ID NO: 3835 - DNA, 15 bp, Homo sapiens
gaaagggctggtatg

SEQ ID NO: 3836 - DNA, 15 bp, Homo sapiens
ggaaagggctggtat

SEQ ID NO: 3837 - DNA, 15 bp, Homo sapiens
tggaaagggctggta

SEQ ID NO: 3838 - DNA, 15 bp, Homo sapiens
ctggaaagggctggt

SEQ ID NO: 3839 - DNA, 15 bp, Homo sapiens
actggaaagggctgg

SEQ ID NO: 3840 - DNA, 15 bp, Homo sapiens
cactggaaagggctg

SEQ ID NO: 3841 - DNA, 15 bp, Homo sapiens
acactggaaagggct

SEQ ID NO: 3842 - DNA, 15 bp, Homo sapiens
gacactggaaagggc

SEQ ID NO: 3843 - DNA, 15 bp, Homo sapiens
agacactggaaaggg

SEQ ID NO: 3844 - DNA, 15 bp, Homo sapiens
aagacactggaaagg

SEQ ID NO: 3845 - DNA, 15 bp, Homo sapiens
taagacactggaaag

SEQ ID NO: 3846 - DNA, 15 bp, Homo sapiens
ttaagacactggaaa

SEQ ID NO: 3847 - DNA, 15 bp, Homo sapiens
gttaagacactggaa

SEQ ID NO: 3848 - DNA, 15 bp, Homo sapiens
tgttaagacactgga

SEQ ID NO: 3849 - DNA, 15 bp, Homo sapiens
ctgttaagacactgg

SEQ ID NO: 3850 - DNA, 15 bp, Homo sapiens
gctgttaagacactg

SEQ ID NO: 3851 - DNA, 15 bp, Homo sapiens
agctgttaagacact

SEQ ID NO: 3852 - DNA, 15 bp, Homo sapiens
gagctgttaagacac

SEQ ID NO: 3853 - DNA, 15 bp, Homo sapiens
tgagctgttaagaca

SEQ ID NO: 3854 - DNA, 15 bp, Homo sapiens
ttgagctgttaagac

SEQ ID NO: 3855 - DNA, 15 bp, Homo sapiens
tttgagctgttaaga

SEQ ID NO: 3856 - DNA, 15 bp, Homo sapiens
ctttgagctgttaag

SEQ ID NO: 3857 - DNA, 15 bp, Homo sapiens
tctttgagctgttaa

SEQ ID NO: 3858 - DNA, 15 bp, Homo sapiens
ttctttgagctgtta

SEQ ID NO: 3859 - DNA, 15 bp, Homo sapiens
tttctttgagctgtt

SEQ ID NO: 3860 - DNA, 15 bp, Homo sapiens
gtttctttgagctgt

SEQ ID NO: 3861 - DNA, 15 bp, Homo sapiens
ggtttctttgagctg

SEQ ID NO: 3862 - DNA, 15 bp, Homo sapiens
gggtttctttgagct

SEQ ID NO: 3863 - DNA, 15 bp, Homo sapiens
tgggtttctttgagc

SEQ ID NO: 3864 - DNA, 15 bp, Homo sapiens
atgggtttctttgag

SEQ ID NO: 3865 - DNA, 15 bp, Homo sapiens
gatgggtttctttga

SEQ ID NO: 3866 - DNA, 15 bp, Homo sapiens
agatgggtttctttg

SEQ ID NO: 3867 - DNA, 15 bp, Homo sapiens
cagatgggtttcttt

SEQ ID NO: 3868 - DNA, 15 bp, Homo sapiens
acagatgggtttctt

SEQ ID NO: 3869 - DNA, 15 bp, Homo sapiens
cacagatgggtttct

SEQ ID NO: 3870 - DNA, 15 bp, Homo sapiens
ccacagatgggtttc

SEQ ID NO: 3871 - DNA, 15 bp, Homo sapiens
gccacagatgggttt

SEQ ID NO: 3872 - DNA, 15 bp, Homo sapiens
agccacagatgggtt

SEQ ID NO: 3873 - DNA, 15 bp, Homo sapiens
aagccacagatgggt

SEQ ID NO: 3874 - DNA, 15 bp, Homo sapiens
aaagccacagatggg

SEQ ID NO: 3875 - DNA, 15 bp, Homo sapiens
gaaagccacagatgg

SEQ ID NO: 3876 - DNA, 15 bp, Homo sapiens
agaaagccacagatg

SEQ ID NO: 3877 - DNA, 15 bp, Homo sapiens
aagaaagccacagat

SEQ ID NO: 3878 - DNA, 15 bp, Homo sapiens
caagaaagccacaga

SEQ ID NO: 3879 - DNA, 15 bp, Homo sapiens
acaagaaagccacag

SEQ ID NO: 3880 - DNA, 15 bp, Homo sapiens
aacaagaaagccaca

SEQ ID NO: 3881 - DNA, 15 bp, Homo sapiens
taacaagaaagccac

SEQ ID NO: 3882 - DNA, 15 bp, Homo sapiens
ctaacaagaaagcca

SEQ ID NO: 3883 - DNA, 15 bp, Homo sapiens
gctaacaagaaagcc

SEQ ID NO: 3884 - DNA, 15 bp, Homo sapiens
tgctaacaagaaagc

SEQ ID NO: 3885 - DNA, 15 bp, Homo sapiens
gtgctaacaagaaag

SEQ ID NO: 3886 - DNA, 15 bp, Homo sapiens
agtgctaacaagaaa

SEQ ID NO: 3887 - DNA, 15 bp, Homo sapiens
cagtgctaacaagaa

SEQ ID NO: 3888 - DNA, 15 bp, Homo sapiens
ccagtgctaacaaga

SEQ ID NO: 3889 - DNA, 15 bp, Homo sapiens
gccagtgctaacaag

SEQ ID NO: 3890 - DNA, 15 bp, Homo sapiens
ggccagtgctaacaa

SEQ ID NO: 3891 - DNA, 15 bp, Homo sapiens
aggccagtgctaaca

SEQ ID NO: 3892 - DNA, 15 bp, Homo sapiens
taggccagtgctaac

SEQ ID NO: 3893 - DNA, 15 bp, Homo sapiens
ataggccagtgctaa

SEQ ID NO: 3894 - DNA, 15 bp, Homo sapiens
gataggccagtgcta

SEQ ID NO: 3895 - DNA, 15 bp, Homo sapiens
tgataggccagtgct

SEQ ID NO: 3896 - DNA, 15 bp, Homo sapiens
gtgataggccagtgc

SEQ ID NO: 3897 - DNA, 15 bp, Homo sapiens
tgtgataggccagtg

SEQ ID NO: 3898 - DNA, 15 bp, Homo sapiens
gtgtgataggccagt

SEQ ID NO: 3899 - DNA, 15 bp, Homo sapiens
ggtgtgataggccag

SEQ ID NO: 3900 - DNA, 15 bp, Homo sapiens
aggtgtgataggcca

SEQ ID NO: 3901 - DNA, 15 bp, Homo sapiens
aaggtgtgataggcc

SEQ ID NO: 3902 - DNA, 15 bp, Homo sapiens
gaaggtgtgataggc

SEQ ID NO: 3903 - DNA, 15 bp, Homo sapiens
ggaaggtgtgatagg

SEQ ID NO: 3904 - DNA, 15 bp, Homo sapiens
aggaaggtgtgatag

SEQ ID NO: 3905 - DNA, 15 bp, Homo sapiens
taggaaggtgtgata

SEQ ID NO: 3906 - DNA, 15 bp, Homo sapiens
ataggaaggtgtgat

SEQ ID NO: 3907 - DNA, 15 bp, Homo sapiens
aataggaaggtgtga

SEQ ID NO: 3908 - DNA, 15 bp, Homo sapiens
caataggaaggtgtg

SEQ ID NO: 3909 - DNA, 15 bp, Homo sapiens
gcaataggaaggtgt

SEQ ID NO: 3910 - DNA, 15 bp, Homo sapiens
ggcaataggaaggtg

SEQ ID NO: 3911 - DNA, 15 bp, Homo sapiens
aggcaataggaaggt

SEQ ID NO: 3912 - DNA, 15 bp, Homo sapiens
caggcaataggaagg

SEQ ID NO: 3913 - DNA, 15 bp, Homo sapiens
acaggcaataggaag

SEQ ID NO: 3914 - DNA, 15 bp, Homo sapiens
aacaggcaataggaa

SEQ ID NO: 3915 - DNA, 15 bp, Homo sapiens
taacaggcaatagga

SEQ ID NO: 3916 - DNA, 15 bp, Homo sapiens
ttaacaggcaatagg

SEQ ID NO: 3917 - DNA, 15 bp, Homo sapiens
gttaacaggcaatag

SEQ ID NO: 3918 - DNA, 15 bp, Homo sapiens
agttaacaggcaata

SEQ ID NO: 3919 - DNA, 15 bp, Homo sapiens
tagttaacaggcaat

SEQ ID NO: 3920 - DNA, 15 bp, Homo sapiens
ttagttaacaggcaa

SEQ ID NO: 3921 - DNA, 15 bp, Homo sapiens
tttagttaacaggca

SEQ ID NO: 3922 - DNA, 15 bp, Homo sapiens
ttttagttaacaggc

SEQ ID NO: 3923 - DNA, 15 bp, Homo sapiens
attttagttaacagg

SEQ ID NO: 3924 - DNA, 15 bp, Homo sapiens
aattttagttaacag

SEQ ID NO: 3925 - DNA, 15 bp, Homo sapiens
aaattttagttaaca

SEQ ID NO: 3926 - DNA, 15 bp, Homo sapiens
aaaattttagttaac

SEQ ID NO: 3927 - DNA, 15 bp, Homo sapiens
caaaattttagttaa

SEQ ID NO: 3928 - DNA, 15 bp, Homo sapiens
gcaaaattttagtta

SEQ ID NO: 3929 - DNA, 15 bp, Homo sapiens
ggcaaaattttagtt

SEQ ID NO: 3930 - DNA, 15 bp, Homo sapiens
aggcaaaattttagt

SEQ ID NO: 3931 - DNA, 15 bp, Homo sapiens
caggcaaaattttag

SEQ ID NO: 3932 - DNA, 15 bp, Homo sapiens
ccaggcaaaatttta

SEQ ID NO: 3933 - DNA, 15 bp, Homo sapiens
tccaggcaaaatttt

SEQ ID NO: 3934 - DNA, 15 bp, Homo sapiens
ttccaggcaaaattt

SEQ ID NO: 3935 - DNA, 15 bp, Homo sapiens
attccaggcaaaatt

SEQ ID NO: 3936 - DNA, 15 bp, Homo sapiens
cattccaggcaaaat

SEQ ID NO: 3937 - DNA, 15 bp, Homo sapiens
gcattccaggcaaaa

SEQ ID NO: 3938 - DNA, 15 bp, Homo sapiens
agcattccaggcaaa

SEQ ID NO: 3939 - DNA, 15 bp, Homo sapiens
aagcattccaggcaa

SEQ ID NO: 3940 - DNA, 15 bp, Homo sapiens
aaagcattccaggca

SEQ ID NO: 3941 - DNA, 15 bp, Homo sapiens
taaagcattccaggc

SEQ ID NO: 3942 - DNA, 15 bp, Homo sapiens
ttaaagcattccagg

SEQ ID NO: 3943 - DNA, 15 bp, Homo sapiens
cttaaagcattccag

SEQ ID NO: 3944 - DNA, 15 bp, Homo sapiens
gcttaaagcattcca

SEQ ID NO: 3945 - DNA, 15 bp, Homo sapiens
agcttaaagcattcc

SEQ ID NO: 3946 - DNA, 15 bp, Homo sapiens
aagcttaaagcattc

SEQ ID NO: 3947 - DNA, 15 bp, Homo sapiens
taagcttaaagcatt

SEQ ID NO: 3948 - DNA, 15 bp, Homo sapiens
ctaagcttaaagcat

SEQ ID NO: 3949 - DNA, 15 bp, Homo sapiens
tctaagcttaaagca

SEQ ID NO: 3950 - DNA, 15 bp, Homo sapiens
ctctaagcttaaagc

SEQ ID NO: 3951 - DNA, 15 bp, Homo sapiens
actctaagcttaaag

SEQ ID NO: 3952 - DNA, 15 bp, Homo sapiens
tactctaagcttaaa

SEQ ID NO: 3953 - DNA, 15 bp, Homo sapiens
gtactctaagcttaa

SEQ ID NO: 3954 - DNA, 15 bp, Homo sapiens
agtactctaagctta

SEQ ID NO: 3955 - DNA, 15 bp, Homo sapiens
cagtactctaagctt

SEQ ID NO: 3956 - DNA, 15 bp, Homo sapiens
ccagtactctaagct

SEQ ID NO: 3957 - DNA, 15 bp, Homo sapiens
cccagtactctaagc

SEQ ID NO: 3958 - DNA, 15 bp, Homo sapiens
acccagtactctaag

SEQ ID NO: 3959 - DNA, 15 bp, Homo sapiens
gacccagtactctaa

SEQ ID NO: 3960 - DNA, 15 bp, Homo sapiens
agacccagtactcta

SEQ ID NO: 3961 - DNA, 15 bp, Homo sapiens
aagacccagtactct

SEQ ID NO: 3962 - DNA, 15 bp, Homo sapiens
aaagacccagtactc

SEQ ID NO: 3963 - DNA, 15 bp, Homo sapiens
caaagacccagtact

SEQ ID NO: 3964 - DNA, 15 bp, Homo sapiens
acaaagacccagtac

SEQ ID NO: 3965 - DNA, 15 bp, Homo sapiens
aacaaagacccagta

SEQ ID NO: 3966 - DNA, 15 bp, Homo sapiens
aaacaaagacccagt

SEQ ID NO: 3967 - DNA, 15 bp, Homo sapiens
gaaacaaagacccag

SEQ ID NO: 3968 - DNA, 15 bp, Homo sapiens
tgaaacaaagaccca

SEQ ID NO: 3969 - DNA, 15 bp, Homo sapiens
gtgaaacaaagaccc

SEQ ID NO: 3970 - DNA, 15 bp, Homo sapiens
ggtgaaacaaagacc

SEQ ID NO: 3971 - DNA, 15 bp, Homo sapiens
gggtgaaacaaagac

SEQ ID NO: 3972 - DNA, 15 bp, Homo sapiens
cgggtgaaacaaaga

SEQ ID NO: 3973 - DNA, 15 bp, Homo sapiens
tcgggtgaaacaaag

SEQ ID NO: 3974 - DNA, 15 bp, Homo sapiens
atcgggtgaaacaaa

SEQ ID NO: 3975 - DNA, 15 bp, Homo sapiens
aatcgggtgaaacaa

SEQ ID NO: 3976 - DNA, 15 bp, Homo sapiens
caatcgggtgaaaca

SEQ ID NO: 3977 - DNA, 15 bp, Homo sapiens
tcaatcgggtgaaac

SEQ ID NO: 3978 - DNA, 15 bp, Homo sapiens
atcaatcgggtgaaa

SEQ ID NO: 3979 - DNA, 15 bp, Homo sapiens
tatcaatcgggtgaa

SEQ ID NO: 3980 - DNA, 15 bp, Homo sapiens
ctatcaatcgggtga

SEQ ID NO: 3981 - DNA, 15 bp, Homo sapiens
cctatcaatcgggtg

SEQ ID NO: 3982 - DNA, 15 bp, Homo sapiens
tcctatcaatcgggt

SEQ ID NO: 3983 - DNA, 15 bp, Homo sapiens
ctcctatcaatcggg

SEQ ID NO: 3984 - DNA, 15 bp, Homo sapiens
tctcctatcaatcgg

SEQ ID NO: 3985 - DNA, 15 bp, Homo sapiens
ctctcctatcaatcg

SEQ ID NO: 3986 - DNA, 15 bp, Homo sapiens
actctcctatcaatc

SEQ ID NO: 3987 - DNA, 15 bp, Homo sapiens
cactctcctatcaat

SEQ ID NO: 3988 - DNA, 15 bp, Homo sapiens
acactctcctatcaa

SEQ ID NO: 3989 - DNA, 15 bp, Homo sapiens
gacactctcctatca

SEQ ID NO: 3990 - DNA, 15 bp, Homo sapiens
tgacactctcctatc

SEQ ID NO: 3991 - DNA, 15 bp, Homo sapiens
atgacactctcctat

SEQ ID NO: 3992 - DNA, 15 bp, Homo sapiens
catgacactctccta

SEQ ID NO: 3993 - DNA, 15 bp, Homo sapiens
gcatgacactctcct

SEQ ID NO: 3994 - DNA, 15 bp, Homo sapiens
tgcatgacactctcc

SEQ ID NO: 3995 - DNA, 15 bp, Homo sapiens
ctgcatgacactctc

SEQ ID NO: 3996 - DNA, 15 bp, Homo sapiens
actgcatgacactct

SEQ ID NO: 3997 - DNA, 15 bp, Homo sapiens
gactgcatgacactc

SEQ ID NO: 3998 - DNA, 15 bp, Homo sapiens
tgactgcatgacact

SEQ ID NO: 3999 - DNA, 15 bp, Homo sapiens
ctgactgcatgacac

SEQ ID NO: 4000 - DNA, 15 bp, Homo sapiens
gctgactgcatgaca

SEQ ID NO: 4001 - DNA, 15 bp, Homo sapiens
ggctgactgcatgac

SEQ ID NO: 4002 - DNA, 15 bp, Homo sapiens
cggctgactgcatga

SEQ ID NO: 4003 - DNA, 15 bp, Homo sapiens
tcggctgactgcatg

SEQ ID NO: 4004 - DNA, 15 bp, Homo sapiens
ttcggctgactgcat

SEQ ID NO: 4005 - DNA, 15 bp, Homo sapiens
gttcggctgactgca

SEQ ID NO: 4006 - DNA, 15 bp, Homo sapiens
agttcggctgactgc

SEQ ID NO: 4007 - DNA, 15 bp, Homo sapiens
gagttcggctgactg

SEQ ID NO: 4008 - DNA, 15 bp, Homo sapiens
ggagttcggctgact

SEQ ID NO: 4009 - DNA, 15 bp, Homo sapiens
cggagttcggctgac

SEQ ID NO: 4010 - DNA, 15 bp, Homo sapiens
tcggagttcggctga

SEQ ID NO: 4011 - DNA, 15 bp, Homo sapiens
gtcggagttcggctg

SEQ ID NO: 4012 - DNA, 15 bp, Homo sapiens
agtcggagttcggct

SEQ ID NO: 4013 - DNA, 15 bp, Homo sapiens
aagtcggagttcggc

SEQ ID NO: 4014 - DNA, 15 bp, Homo sapiens
gaagtcggagttcgg

SEQ ID NO: 4015 - DNA, 15 bp, Homo sapiens
agaagtcggagttcg

SEQ ID NO: 4016 - DNA, 15 bp, Homo sapiens
cagaagtcggagttc

SEQ ID NO: 4017 - DNA, 15 bp, Homo sapiens
acagaagtcggagtt

SEQ ID NO: 4018 - DNA, 15 bp, Homo sapiens
cacagaagtcggagt

SEQ ID NO: 4019 - DNA, 15 bp, Homo sapiens
gcacagaagtcggag

SEQ ID NO: 4020 - DNA, 15 bp, Homo sapiens
agcacagaagtcgga

SEQ ID NO: 4021 - DNA, 15 bp, Homo sapiens
cagcacagaagtcgg

SEQ ID NO: 4022 - DNA, 15 bp, Homo sapiens
acagcacagaagtcg

SEQ ID NO: 4023 - DNA, 15 bp, Homo sapiens
aacagcacagaagtc

SEQ ID NO: 4024 - DNA, 15 bp, Homo sapiens
aaacagcacagaagt

SEQ ID NO: 4025 - DNA, 15 bp, Homo sapiens
taaacagcacagaag

SEQ ID NO: 4026 - DNA, 15 bp, Homo sapiens
ttaaacagcacagaa

SEQ ID NO: 4027 - DNA, 15 bp, Homo sapiens
tttaaacagcacaga

SEQ ID NO: 4028 - DNA, 15 bp, Homo sapiens
atttaaacagcacag

SEQ ID NO: 4029 - DNA, 15 bp, Homo sapiens
gatttaaacagcaca

SEQ ID NO: 4030 - DNA, 15 bp, Homo sapiens
ggatttaaacagcac

SEQ ID NO: 4031 - DNA, 15 bp, Homo sapiens
aggatttaaacagca

SEQ ID NO: 4032 - DNA, 15 bp, Homo sapiens
aaggatttaaacagc

SEQ ID NO: 4033 - DNA, 15 bp, Homo sapiens
taaggatttaaacag

SEQ ID NO: 4034 - DNA, 15 bp, Homo sapiens
ctaaggatttaaaca

SEQ ID NO: 4035 - DNA, 15 bp, Homo sapiens
cctaaggatttaaac

SEQ ID NO: 4036 - DNA, 15 bp, Homo sapiens
acctaaggatttaaa

SEQ ID NO: 4037 - DNA, 15 bp, Homo sapiens
tacctaaggatttaa

SEQ ID NO: 4038 - DNA, 15 bp, Homo sapiens
ctacctaaggattta

SEQ ID NO: 4039 - DNA, 15 bp, Homo sapiens
cctacctaaggattt

SEQ ID NO: 4040 - DNA, 15 bp, Homo sapiens
acctacctaaggatt

SEQ ID NO: 4041 - DNA, 15 bp, Homo sapiens
gacctacctaaggat

SEQ ID NO: 4042 - DNA, 15 bp, Homo sapiens
agacctacctaagga

SEQ ID NO: 4043 - DNA, 15 bp, Homo sapiens
cagacctacctaagg

SEQ ID NO: 4044 - DNA, 15 bp, Homo sapiens
ccagacctacctaag

SEQ ID NO: 4045 - DNA, 15 bp, Homo sapiens
cccagacctacctaa

SEQ ID NO: 4046 - DNA, 15 bp, Homo sapiens
ccccagacctaccta

SEQ ID NO: 4047 - DNA, 15 bp, Homo sapiens
gccccagacctacct

SEQ ID NO: 4048 - DNA, 15 bp, Homo sapiens
tgccccagacctacc

SEQ ID NO: 4049 - DNA, 15 bp, Homo sapiens
ttgccccagacctac

SEQ ID NO: 4050 - DNA, 15 bp, Homo sapiens
cttgccccagaccta

SEQ ID NO: 4051 - DNA, 15 bp, Homo sapiens
ccttgccccagacct

SEQ ID NO: 4052 - DNA, 15 bp, Homo sapiens
gccttgccccagacc

SEQ ID NO: 4053 - DNA, 15 bp, Homo sapiens
tgccttgccccagac

SEQ ID NO: 4054 - DNA, 15 bp, Homo sapiens
gtgccttgccccaga

SEQ ID NO: 4055 - DNA, 15 bp, Homo sapiens
tgtgccttgccccag

SEQ ID NO: 4056 - DNA, 15 bp, Homo sapiens
ttgtgccttgcccca

SEQ ID NO: 4057 - DNA, 15 bp, Homo sapiens
tttgtgccttgcccc

SEQ ID NO: 4058 - DNA, 15 bp, Homo sapiens
gtttgtgccttgccc

SEQ ID NO: 4059 - DNA, 15 bp, Homo sapiens
ggtttgtgccttgcc

SEQ ID NO: 4060 - DNA, 15 bp, Homo sapiens
tggtttgtgccttgc

SEQ ID NO: 4061 - DNA, 15 bp, Homo sapiens
gtggtttgtgccttg

SEQ ID NO: 4062 - DNA, 15 bp, Homo sapiens
agtggtttgtgcctt

SEQ ID NO: 4063 - DNA, 15 bp, Homo sapiens
cagtggtttgtgcct

SEQ ID NO: 4064 - DNA, 15 bp, Homo sapiens
acagtggtttgtgcc

SEQ ID NO: 4065 - DNA, 15 bp, Homo sapiens
cacagtggtttgtgc

SEQ ID NO: 4066 - DNA, 15 bp, Homo sapiens
acacagtggtttgtg

SEQ ID NO: 4067 - DNA, 15 bp, Homo sapiens
tacacagtggtttgt

SEQ ID NO: 4068 - DNA, 15 bp, Homo sapiens
atacacagtggtttg

SEQ ID NO: 4069 - DNA, 15 bp, Homo sapiens
aatacacagtggttt

SEQ ID NO: 4070 - DNA, 15 bp, Homo sapiens
gaatacacagtggtt

SEQ ID NO: 4071 - DNA, 15 bp, Homo sapiens
tgaatacacagtggt

SEQ ID NO: 4072 - DNA, 15 bp, Homo sapiens
ttgaatacacagtgg

SEQ ID NO: 4073 - DNA, 15 bp, Homo sapiens
tttgaatacacagtg

SEQ ID NO: 4074 - DNA, 15 bp, Homo sapiens
ctttgaatacacagt

SEQ ID NO: 4075 - DNA, 15 bp, Homo sapiens
cctttgaatacacag

SEQ ID NO: 4076 - DNA, 15 bp, Homo sapiens
ccctttgaatacaca

SEQ ID NO: 4077 - DNA, 15 bp, Homo sapiens
accctttgaatacac

SEQ ID NO: 4078 - DNA, 15 bp, Homo sapiens
aaccctttgaataca

SEQ ID NO: 4079 - DNA, 15 bp, Homo sapiens
taaccctttgaatac

SEQ ID NO: 4080 - DNA, 15 bp, Homo sapiens
ataaccctttgaata

SEQ ID NO: 4081 - DNA, 15 bp, Homo sapiens
cataaccctttgaat

SEQ ID NO: 4082 - DNA, 15 bp, Homo sapiens
ccataaccctttgaa

SEQ ID NO: 4083 - DNA, 15 bp, Homo sapiens
accataaccctttga

SEQ ID NO: 4084 - DNA, 15 bp, Homo sapiens
caccataaccctttg

SEQ ID NO: 4085 - DNA, 15 bp, Homo sapiens
gcaccataacccttt

SEQ ID NO: 4086 - DNA, 15 bp, Homo sapiens
agcaccataaccctt

SEQ ID NO: 4087 - DNA, 15 bp, Homo sapiens
aagcaccataaccct

SEQ ID NO: 4088 - DNA, 15 bp, Homo sapiens
caagcaccataaccc

SEQ ID NO: 4089 - DNA, 15 bp, Homo sapiens
gcaagcaccataacc

SEQ ID NO: 4090 - DNA, 15 bp, Homo sapiens
tgcaagcaccataac

SEQ ID NO: 4091 - DNA, 15 bp, Homo sapiens
atgcaagcaccataa

SEQ ID NO: 4092 - DNA, 15 bp, Homo sapiens
aatgcaagcaccata

SEQ ID NO: 4093 - DNA, 15 bp, Homo sapiens
gaatgcaagcaccat

SEQ ID NO: 4094 - DNA, 15 bp, Homo sapiens
agaatgcaagcacca

SEQ ID NO: 4095 - DNA, 15 bp, Homo sapiens
cagaatgcaagcacc

SEQ ID NO: 4096 - DNA, 15 bp, Homo sapiens
acagaatgcaagcac

SEQ ID NO: 4097 - DNA, 15 bp, Homo sapiens
cacagaatgcaagca

SEQ ID NO: 4098 - DNA, 15 bp, Homo sapiens
acacagaatgcaagc

SEQ ID NO: 4099 - DNA, 15 bp, Homo sapiens
cacacagaatgcaag

SEQ ID NO: 4100 - DNA, 15 bp, Homo sapiens
acacacagaatgcaa

SEQ ID NO: 4101 - DNA, 15 bp, Homo sapiens
tacacacagaatgca

SEQ ID NO: 4102 - DNA, 15 bp, Homo sapiens
atacacacagaatgc

SEQ ID NO: 4103 - DNA, 15 bp, Homo sapiens
tatacacacagaatg

SEQ ID NO: 4104 - DNA, 15 bp, Homo sapiens
atatacacacagaat

SEQ ID NO: 4105 - DNA, 15 bp, Homo sapiens
catatacacacagaa

SEQ ID NO: 4106 - DNA, 15 bp, Homo sapiens
acatatacacacaga

SEQ ID NO: 4107 - DNA, 15 bp, Homo sapiens
aacatatacacacag

SEQ ID NO: 4108 - DNA, 15 bp, Homo sapiens
aaacatatacacaca

SEQ ID NO: 4109 - DNA, 15 bp, Homo sapiens
caaacatatacacac

SEQ ID NO: 4110 - DNA, 15 bp, Homo sapiens
acaaacatatacaca

SEQ ID NO: 4111 - DNA, 15 bp, Homo sapiens
tacaaacatatacac

SEQ ID NO: 4112 - DNA, 15 bp, Homo sapiens
ttacaaacatataca

SEQ ID NO: 4113 - DNA, 15 bp, Homo sapiens
attacaaacatatac

SEQ ID NO: 4114 - DNA, 15 bp, Homo sapiens
aattacaaacatata

SEQ ID NO: 4115 - DNA, 15 bp, Homo sapiens
aaattacaaacatat

SEQ ID NO: 4116 - DNA, 15 bp, Homo sapiens
gaaattacaaacata

SEQ ID NO: 4117 - DNA, 15 bp, Homo sapiens
ggaaattacaaacat

SEQ ID NO: 4118 - DNA, 15 bp, Homo sapiens
tggaaattacaaaca

SEQ ID NO: 4119 - DNA, 15 bp, Homo sapiens
ttggaaattacaaac

SEQ ID NO: 4120 - DNA, 15 bp, Homo sapiens
gttggaaattacaaa

SEQ ID NO: 4121 - DNA, 15 bp, Homo sapiens
ggttggaaattacaa

SEQ ID NO: 4122 - DNA, 15 bp, Homo sapiens
tggttggaaattaca

SEQ ID NO: 4123 - DNA, 15 bp, Homo sapiens
ctggttggaaattac

SEQ ID NO: 4124 - DNA, 15 bp, Homo sapiens
tctggttggaaatta

SEQ ID NO: 4125 - DNA, 15 bp, Homo sapiens
ctctggttggaaatt

SEQ ID NO: 4126 - DNA, 15 bp, Homo sapiens
actctggttggaaat

SEQ ID NO: 4127 - DNA, 15 bp, Homo sapiens
gactctggttggaaa

SEQ ID NO: 4128 - DNA, 15 bp, Homo sapiens
cgactctggttggaa

SEQ ID NO: 4129 - DNA, 15 bp, Homo sapiens
acgactctggttgga

SEQ ID NO: 4130 - DNA, 15 bp, Homo sapiens
aacgactctggttgg

SEQ ID NO: 4131 - DNA, 15 bp, Homo sapiens
aaacgactctggttg

SEQ ID NO: 4132 - DNA, 15 bp, Homo sapiens
gaaacgactctggtt

SEQ ID NO: 4133 - DNA, 15 bp, Homo sapiens
ggaaacgactctggt

SEQ ID NO: 4134 - DNA, 15 bp, Homo sapiens
gggaaacgactctgg

SEQ ID NO: 4135 - DNA, 15 bp, Homo sapiens
cgggaaacgactctg

SEQ ID NO: 4136 - DNA, 15 bp, Homo sapiens
acgggaaacgactct

SEQ ID NO: 4137 - DNA, 15 bp, Homo sapiens
cacgggaaacgactc

SEQ ID NO: 4138 - DNA, 15 bp, Homo sapiens
gcacgggaaacgact

SEQ ID NO: 4139 - DNA, 15 bp, Homo sapiens
ggcacgggaaacgac

SEQ ID NO: 4140 - DNA, 15 bp, Homo sapiens
aggcacgggaaacga

SEQ ID NO: 4141 - DNA, 15 bp, Homo sapiens
caggcacgggaaacg

SEQ ID NO: 4142 - DNA, 15 bp, Homo sapiens
gcaggcacgggaaac

SEQ ID NO: 4143 - DNA, 15 bp, Homo sapiens
ggcaggcacgggaaa

SEQ ID NO: 4144 - DNA, 15 bp, Homo sapiens
gggcaggcacgggaa

SEQ ID NO: 4145 - DNA, 15 bp, Homo sapiens
agggcaggcacggga

SEQ ID NO: 4146 - DNA, 15 bp, Homo sapiens
cagggcaggcacggg

SEQ ID NO: 4147 - DNA, 15 bp, Homo sapiens
gcagggcaggcacgg

SEQ ID NO: 4148 - DNA, 15 bp, Homo sapiens
ggcagggcaggcacg

SEQ ID NO: 4149 - DNA, 15 bp, Homo sapiens
aggcagggcaggcac

SEQ ID NO: 4150 - DNA, 15 bp, Homo sapiens
gaggcagggcaggca

SEQ ID NO: 4151 - DNA, 15 bp, Homo sapiens
agaggcagggcaggc

SEQ ID NO: 4152 - DNA, 15 bp, Homo sapiens
cagaggcagggcagg

SEQ ID NO: 4153 - DNA, 15 bp, Homo sapiens
acagaggcagggcag

SEQ ID NO: 4154 - DNA, 15 bp, Homo sapiens
cacagaggcagggca

SEQ ID NO: 4155 - DNA, 15 bp, Homo sapiens
gcacagaggcagggc

SEQ ID NO: 4156 - DNA, 15 bp, Homo sapiens
tgcacagaggcaggg

SEQ ID NO: 4157 - DNA, 15 bp, Homo sapiens
ttgcacagaggcagg

SEQ ID NO: 4158 - DNA, 15 bp, Homo sapiens
attgcacagaggcag

SEQ ID NO: 4159 - DNA, 15 bp, Homo sapiens
gattgcacagaggca

SEQ ID NO: 4160 - DNA, 15 bp, Homo sapiens
agattgcacagaggc

SEQ ID NO: 4161 - DNA, 15 bp, Homo sapiens
tagattgcacagagg

SEQ ID NO: 4162 - DNA, 15 bp, Homo sapiens
ctagattgcacagag

SEQ ID NO: 4163 - DNA, 15 bp, Homo sapiens
actagattgcacaga

SEQ ID NO: 4164 - DNA, 15 bp, Homo sapiens
gactagattgcacag

SEQ ID NO: 4165 - DNA, 15 bp, Homo sapiens
agactagattgcaca

SEQ ID NO: 4166 - DNA, 15 bp, Homo sapiens
tagactagattgcac

SEQ ID NO: 4167 - DNA, 15 bp, Homo sapiens
ctagactagattgca

SEQ ID NO: 4168 - DNA, 15 bp, Homo sapiens
actagactagattgc

SEQ ID NO: 4169 - DNA, 15 bp, Homo sapiens
tactagactagattg

SEQ ID NO: 4170 - DNA, 15 bp, Homo sapiens
ctactagactagatt

SEQ ID NO: 4171 - DNA, 15 bp, Homo sapiens
cctactagactagat

SEQ ID NO: 4172 - DNA, 15 bp, Homo sapiens
ccctactagactaga

SEQ ID NO: 4173 - DNA, 15 bp, Homo sapiens
accctactagactag

SEQ ID NO: 4174 - DNA, 15 bp, Homo sapiens
taccctactagacta

SEQ ID NO: 4175 - DNA, 15 bp, Homo sapiens
ctaccctactagact

SEQ ID NO: 4176 - DNA, 15 bp, Homo sapiens
cctaccctactagac

SEQ ID NO: 4177 - DNA, 15 bp, Homo sapiens
ccctaccctactaga

SEQ ID NO: 4178 - DNA, 15 bp, Homo sapiens
tccctaccctactag

SEQ ID NO: 4179 - DNA, 15 bp, Homo sapiens
ctccctaccctacta

SEQ ID NO: 4180 - DNA, 15 bp, Homo sapiens
cctccctaccctact

SEQ ID NO: 4181 - DNA, 15 bp, Homo sapiens
gcctccctaccctac

SEQ ID NO: 4182 - DNA, 15 bp, Homo sapiens
tgcctccctacccta

SEQ ID NO: 4183 - DNA, 15 bp, Homo sapiens
ttgcctccctaccct

SEQ ID NO: 4184 - DNA, 15 bp, Homo sapiens
cttgcctccctaccc

SEQ ID NO: 4185 - DNA, 15 bp, Homo sapiens
gcttgcctccctacc

SEQ ID NO: 4186 - DNA, 15 bp, Homo sapiens
agcttgcctccctac

SEQ ID NO: 4187 - DNA, 15 bp, Homo sapiens
cagcttgcctcccta

SEQ ID NO: 4188 - DNA, 15 bp, Homo sapiens
acagcttgcctccct

SEQ ID NO: 4189 - DNA, 15 bp, Homo sapiens
cacagcttgcctccc

SEQ ID NO: 4190 - DNA, 15 bp, Homo sapiens
ccacagcttgcctcc

SEQ ID NO: 4191 - DNA, 15 bp, Homo sapiens
tccacagcttgcctc

SEQ ID NO: 4192 - DNA, 15 bp, Homo sapiens
ctccacagcttgcct

SEQ ID NO: 4193 - DNA, 15 bp, Homo sapiens
actccacagcttgcc

SEQ ID NO: 4194 - DNA, 15 bp, Homo sapiens
aactccacagcttgc

SEQ ID NO: 4195 - DNA, 15 bp, Homo sapiens
aaactccacagcttg

SEQ ID NO: 4196 - DNA, 15 bp, Homo sapiens
caaactccacagctt

SEQ ID NO: 4197 - DNA, 15 bp, Homo sapiens
tcaaactccacagct

SEQ ID NO: 4198 - DNA, 15 bp, Homo sapiens
ttcaaactccacagc

SEQ ID NO: 4199 - DNA, 15 bp, Homo sapiens
tttcaaactccacag

SEQ ID NO: 4200 - DNA, 15 bp, Homo sapiens
ttttcaaactccaca

SEQ ID NO: 4201 - DNA, 15 bp, Homo sapiens
tttttcaaactccac

SEQ ID NO: 4202 - DNA, 15 bp, Homo sapiens
ttttttcaaactcca

SEQ ID NO: 4203 - DNA, 15 bp, Homo sapiens
tttttttcaaactcc

SEQ ID NO: 4204 - DNA, 15 bp, Homo sapiens
ttttttttcaaactc

SEQ ID NO: 4205 - DNA, 15 bp, Homo sapiens
tttttttttcaaact

SEQ ID NO: 4206 - DNA, 15 bp, Homo sapiens
ttttttttttcaaac

SEQ ID NO: 4207 - DNA, 15 bp, Homo sapiens
tttttttttttcaaa

SEQ ID NO: 4208 - DNA, 15 bp, Homo sapiens
ttttttttttttcaa

SEQ ID NO: 4209 - DNA, 15 bp, Homo sapiens
tttttttttttttca

SEQ ID NO: 4210 - DNA, 15 bp, Homo sapiens
ttttttttttttttt

SEQ ID NO: 4211 - DNA, 15 bp, Homo sapiens
agctttttttttttt

SEQ ID NO: 4212 - DNA, 15 bp, Homo sapiens
tagcttttttttttt

SEQ ID NO: 4213 - DNA, 15 bp, Homo sapiens
ctagctttttttttt

SEQ ID NO: 4214 - DNA, 15 bp, Homo sapiens
tctagcttttttttt

SEQ ID NO: 4215 - DNA, 15 bp, Homo sapiens
atctagctttttttt

SEQ ID NO: 4216 - DNA, 15 bp, Homo sapiens
catctagcttttttt

SEQ ID NO: 4217 - DNA, 15 bp, Homo sapiens
tcatctagctttttt

SEQ ID NO: 4218 - DNA, 15 bp, Homo sapiens
ctcatctagcttttt

SEQ ID NO: 4219 - DNA, 15 bp, Homo sapiens
actcatctagctttt

SEQ ID NO: 4220 - DNA, 15 bp, Homo sapiens
aactcatctagcttt

SEQ ID NO: 4221 - DNA, 15 bp, Homo sapiens
aaactcatctagctt

SEQ ID NO: 4222 - DNA, 15 bp, Homo sapiens
taaactcatctagct

SEQ ID NO: 4223 - DNA, 15 bp, Homo sapiens
ttaaactcatctagc

SEQ ID NO: 4224 - DNA, 15 bp, Homo sapiens
attaaactcatctag

SEQ ID NO: 4225 - DNA, 15 bp, Homo sapiens
tattaaactcatcta

SEQ ID NO: 4226 - DNA, 15 bp, Homo sapiens
ctattaaactcatct

SEQ ID NO: 4227 - DNA, 15 bp, Homo sapiens
cctattaaactcatc

SEQ ID NO: 4228 - DNA, 15 bp, Homo sapiens
gcctattaaactcat

SEQ ID NO: 4229 - DNA, 15 bp, Homo sapiens
agcctattaaactca

SEQ ID NO: 4230 - DNA, 15 bp, Homo sapiens
cagcctattaaactc

SEQ ID NO: 4231 - DNA, 15 bp, Homo sapiens
acagcctattaaact

SEQ ID NO: 4232 - DNA, 15 bp, Homo sapiens
aacagcctattaaac

SEQ ID NO: 4233 - DNA, 15 bp, Homo sapiens
taacagcctattaaa

SEQ ID NO: 4234 - DNA, 15 bp, Homo sapiens
gtaacagcctattaa

SEQ ID NO: 4235 - DNA, 15 bp, Homo sapiens
ggtaacagcctatta

SEQ ID NO: 4236 - DNA, 15 bp, Homo sapiens
gggtaacagcctatt

SEQ ID NO: 4237 - DNA, 15 bp, Homo sapiens
ggggtaacagcctat

SEQ ID NO: 4238 - DNA, 15 bp, Homo sapiens
gggggtaacagccta

SEQ ID NO: 4239 - DNA, 15 bp, Homo sapiens
agggggtaacagcct

SEQ ID NO: 4240 - DNA, 15 bp, Homo sapiens
gagggggtaacagcc

SEQ ID NO: 4241 - DNA, 15 bp, Homo sapiens
ggagggggtaacagc

SEQ ID NO: 4242 - DNA, 15 bp, Homo sapiens
tggagggggtaacag

SEQ ID NO: 4243 - DNA, 15 bp, Homo sapiens
ctggagggggtaaca

SEQ ID NO: 4244 - DNA, 15 bp, Homo sapiens
tctggagggggtaac

SEQ ID NO: 4245 - DNA, 15 bp, Homo sapiens
ttctggagggggtaa

SEQ ID NO: 4246 - DNA, 15 bp, Homo sapiens
gttctggagggggta

SEQ ID NO: 4247 - DNA, 15 bp, Homo sapiens
tgttctggagggggt

SEQ ID NO: 4248 - DNA, 15 bp, Homo sapiens
atgttctggaggggg

SEQ ID NO: 4249 - DNA, 15 bp, Homo sapiens
aatgttctggagggg

SEQ ID NO: 4250 - DNA, 15 bp, Homo sapiens
gaatgttctggaggg

SEQ ID NO: 4251 - DNA, 15 bp, Homo sapiens
ggaatgttctggagg

SEQ ID NO: 4252 - DNA, 15 bp, Homo sapiens
aggaatgttctggag

SEQ ID NO: 4253 - DNA, 15 bp, Homo sapiens
gaggaatgttctgga

SEQ ID NO: 4254 - DNA, 15 bp, Homo sapiens
ggaggaatgttctgg

SEQ ID NO: 4255 - DNA, 15 bp, Homo sapiens
gggaggaatgttctg

SEQ ID NO: 4256 - DNA, 15 bp, Homo sapiens
tgggaggaatgttct

SEQ ID NO: 4257 - DNA, 15 bp, Homo sapiens
atgggaggaatgttc

SEQ ID NO: 4258 - DNA, 15 bp, Homo sapiens
catgggaggaatgtt

SEQ ID NO: 4259 - DNA, 15 bp, Homo sapiens
acatgggaggaatgt

SEQ ID NO: 4260 - DNA, 15 bp, Homo sapiens
cacatgggaggaatg

SEQ ID NO: 4261 - DNA, 15 bp, Homo sapiens
ccacatgggaggaat

SEQ ID NO: 4262 - DNA, 15 bp, Homo sapiens
tccacatgggaggaa

SEQ ID NO: 4263 - DNA, 15 bp, Homo sapiens
ctccacatgggagga

SEQ ID NO: 4264 - DNA, 15 bp, Homo sapiens
tctccacatgggagg

SEQ ID NO: 4265 - DNA, 15 bp, Homo sapiens
atctccacatgggag

SEQ ID NO: 4266 - DNA, 15 bp, Homo sapiens
catctccacatggga

SEQ ID NO: 4267 - DNA, 15 bp, Homo sapiens
tcatctccacatggg

SEQ ID NO: 4268 - DNA, 15 bp, Homo sapiens
ttcatctccacatgg

SEQ ID NO: 4269 - DNA, 15 bp, Homo sapiens
tttcatctccacatg

SEQ ID NO: 4270 - DNA, 15 bp, Homo sapiens
gtttcatctccacat

SEQ ID NO: 4271 - DNA, 15 bp, Homo sapiens
cgtttcatctccaca

SEQ ID NO: 4272 - DNA, 15 bp, Homo sapiens
tcgtttcatctccac

SEQ ID NO: 4273 - DNA, 15 bp, Homo sapiens
ctcgtttcatctcca

SEQ ID NO: 4274 - DNA, 15 bp, Homo sapiens
tctcgtttcatctcc

SEQ ID NO: 4275 - DNA, 15 bp, Homo sapiens
ttctcgtttcatctc

SEQ ID NO: 4276 - DNA, 15 bp, Homo sapiens
cttctcgtttcatct

SEQ ID NO: 4277 - DNA, 15 bp, Homo sapiens
acttctcgtttcatc

SEQ ID NO: 4278 - DNA, 15 bp, Homo sapiens
aacttctcgtttcat

SEQ ID NO: 4279 - DNA, 15 bp, Homo sapiens
gaacttctcgtttca

SEQ ID NO: 4280 - DNA, 15 bp, Homo sapiens
tgaacttctcgtttc

SEQ ID NO: 4281 - DNA, 15 bp, Homo sapiens
atgaacttctcgttt

SEQ ID NO: 4282 - DNA, 15 bp, Homo sapiens
aatgaacttctcgtt

SEQ ID NO: 4283 - DNA, 15 bp, Homo sapiens
aaatgaacttctcgt

SEQ ID NO: 4284 - DNA, 15 bp, Homo sapiens
gaaatgaacttctcg

SEQ ID NO: 4285 - DNA, 15 bp, Homo sapiens
agaaatgaacttctc

SEQ ID NO: 4286 - DNA, 15 bp, Homo sapiens
aagaaatgaacttct

SEQ ID NO: 4287 - DNA, 15 bp, Homo sapiens
aaagaaatgaacttc

SEQ ID NO: 4288 - DNA, 15 bp, Homo sapiens
taaagaaatgaactt

SEQ ID NO: 4289 - DNA, 15 bp, Homo sapiens
ttaaagaaatgaact

SEQ ID NO: 4290 - DNA, 15 bp, Homo sapiens
gttaaagaaatgaac

SEQ ID NO: 4291 - DNA, 15 bp, Homo sapiens
ggttaaagaaatgaa

SEQ ID NO: 4292 - DNA, 15 bp, Homo sapiens
aggttaaagaaatga

SEQ ID NO: 4293 - DNA, 15 bp, Homo sapiens
taggttaaagaaatg

SEQ ID NO: 4294 - DNA, 15 bp, Homo sapiens
ttaggttaaagaaat

SEQ ID NO: 4295 - DNA, 15 bp, Homo sapiens
tttaggttaaagaaa

SEQ ID NO: 4296 - DNA, 15 bp, Homo sapiens
ttttaggttaaagaa

SEQ ID NO: 4297 - DNA, 15 bp, Homo sapiens
attttaggttaaaga

SEQ ID NO: 4298 - DNA, 15 bp, Homo sapiens
tattttaggttaaag

SEQ ID NO: 4299 - DNA, 15 bp, Homo sapiens
ttattttaggttaaa

SEQ ID NO: 4300 - DNA, 15 bp, Homo sapiens
tttattttaggttaa

SEQ ID NO: 4301 - DNA, 15 bp, Homo sapiens
ctttattttaggtta

SEQ ID NO: 4302 - DNA, 15 bp, Homo sapiens
tctttattttaggtt

SEQ ID NO: 4303 - DNA, 15 bp, Homo sapiens
ttctttattttaggt

SEQ ID NO: 4304 - DNA, 15 bp, Homo sapiens
gttctttattttagg

SEQ ID NO: 4305 - DNA, 15 bp, Homo sapiens
tgttctttattttag

SEQ ID NO: 4306 - DNA, 15 bp, Homo sapiens
ttgttctttatttta

SEQ ID NO: 4307 - DNA, 15 bp, Homo sapiens
gttgttctttatttt

SEQ ID NO: 4308 - DNA, 15 bp, Homo sapiens
tgttgttctttattt

SEQ ID NO: 4309 - DNA, 15 bp, Homo sapiens
ctgttgttctttatt

SEQ ID NO: 4310 - DNA, 15 bp, Homo sapiens
tctgttgttctttat

SEQ ID NO: 4311 - DNA, 15 bp, Homo sapiens
ctctgttgttcttta

SEQ ID NO: 4312 - DNA, 15 bp, Homo sapiens
tctctgttgttcttt

SEQ ID NO: 4313 - DNA, 15 bp, Homo sapiens
atctctgttgttctt

SEQ ID NO: 4314 - DNA, 15 bp, Homo sapiens
tatctctgttgttct

SEQ ID NO: 4315 - DNA, 15 bp, Homo sapiens
ttatctctgttgttc

SEQ ID NO: 4316 - DNA, 15 bp, Homo sapiens
tttatctctgttgtt

SEQ ID NO: 4317 - DNA, 15 bp, Homo sapiens
ttttatctctgttgt

SEQ ID NO: 4318 - DNA, 15 bp, Homo sapiens
attttatctctgttg

SEQ ID NO: 4319 - DNA, 15 bp, Homo sapiens
aattttatctctgtt

SEQ ID NO: 4320 - DNA, 15 bp, Homo sapiens
caattttatctctgt

SEQ ID NO: 4321 - DNA, 15 bp, Homo sapiens
acaattttatctctg

SEQ ID NO: 4322 - DNA, 15 bp, Homo sapiens
aacaattttatctct

SEQ ID NO: 4323 - DNA, 15 bp, Homo sapiens
taacaattttatctc

SEQ ID NO: 4324 - DNA, 15 bp, Homo sapiens
ctaacaattttatct

SEQ ID NO: 4325 - DNA, 15 bp, Homo sapiens
actaacaattttatc

SEQ ID NO: 4326 - DNA, 15 bp, Homo sapiens
aactaacaattttat

SEQ ID NO: 4327 - DNA, 15 bp, Homo sapiens
gaactaacaatttta

SEQ ID NO: 4328 - DNA, 15 bp, Homo sapiens
ggaactaacaatttt

SEQ ID NO: 4329 - DNA, 15 bp, Homo sapiens
aggaactaacaattt

SEQ ID NO: 4330 - DNA, 15 bp, Homo sapiens
aaggaactaacaatt

SEQ ID NO: 4331 - DNA, 15 bp, Homo sapiens
taaggaactaacaat

SEQ ID NO: 4332 - DNA, 15 bp, Homo sapiens
ataaggaactaacaa

SEQ ID NO: 4333 - DNA, 15 bp, Homo sapiens
aataaggaactaaca

SEQ ID NO: 4334 - DNA, 15 bp, Homo sapiens
caataaggaactaac

SEQ ID NO: 4335 - DNA, 15 bp, Homo sapiens
ccaataaggaactaa

SEQ ID NO: 4336 - DNA, 15 bp, Homo sapiens
tccaataaggaacta

SEQ ID NO: 4337 - DNA, 15 bp, Homo sapiens
ctccaataaggaact

SEQ ID NO: 4338 - DNA, 15 bp, Homo sapiens
gctccaataaggaac

SEQ ID NO: 4339 - DNA, 15 bp, Homo sapiens
ggctccaataaggaa

SEQ ID NO: 4340 - DNA, 15 bp, Homo sapiens
aggctccaataagga

SEQ ID NO: 4341 - DNA, 15 bp, Homo sapiens
caggctccaataagg

SEQ ID NO: 4342 - DNA, 15 bp, Homo sapiens
ccaggctccaataag

SEQ ID NO: 4343 - DNA, 15 bp, Homo sapiens
accaggctccaataa

SEQ ID NO: 4344 - DNA, 15 bp, Homo sapiens
aaccaggctccaata

SEQ ID NO: 4345 - DNA, 15 bp, Homo sapiens
aaaccaggctccaat

SEQ ID NO: 4346 - DNA, 15 bp, Homo sapiens
gaaaccaggctccaa

SEQ ID NO: 4347 - DNA, 15 bp, Homo sapiens
ggaaaccaggctcca

SEQ ID NO: 4348 - DNA, 15 bp, Homo sapiens
tggaaaccaggctcc

SEQ ID NO: 4349 - DNA, 15 bp, Homo sapiens
atggaaaccaggctc

SEQ ID NO: 4350 - DNA, 15 bp, Homo sapiens
aatggaaaccaggct

SEQ ID NO: 4351 - DNA, 15 bp, Homo sapiens
caatggaaaccaggc

SEQ ID NO: 4352 - DNA, 15 bp, Homo sapiens
gcaatggaaaccagg

SEQ ID NO: 4353 - DNA, 15 bp, Homo sapiens
agcaatggaaaccag

SEQ ID NO: 4354 - DNA, 15 bp, Homo sapiens
tagcaatggaaacca

SEQ ID NO: 4355 - DNA, 15 bp, Homo sapiens
ttagcaatggaaacc

SEQ ID NO: 4356 - DNA, 15 bp, Homo sapiens
attagcaatggaaac

SEQ ID NO: 4357 - DNA, 15 bp, Homo sapiens
cattagcaatggaaa

SEQ ID NO: 4358 - DNA, 15 bp, Homo sapiens
acattagcaatggaa

SEQ ID NO: 4359 - DNA, 15 bp, Homo sapiens
tacattagcaatgga

SEQ ID NO: 4360 - DNA, 15 bp, Homo sapiens
gtacattagcaatgg

SEQ ID NO: 4361 - DNA, 15 bp, Homo sapiens
ggtacattagcaatg

SEQ ID NO: 4362 - DNA, 15 bp, Homo sapiens
aggtacattagcaat

SEQ ID NO: 4363 - DNA, 15 bp, Homo sapiens
caggtacattagcaa

SEQ ID NO: 4364 - DNA, 15 bp, Homo sapiens
gcaggtacattagca

SEQ ID NO: 4365 - DNA, 15 bp, Homo sapiens
agcaggtacattagc

SEQ ID NO: 4366 - DNA, 15 bp, Homo sapiens
aagcaggtacattag

SEQ ID NO: 4367 - DNA, 15 bp, Homo sapiens
caagcaggtacatta

SEQ ID NO: 4368 - DNA, 15 bp, Homo sapiens
ccaagcaggtacatt

SEQ ID NO: 4369 - DNA, 15 bp, Homo sapiens
cccaagcaggtacat

SEQ ID NO: 4370 - DNA, 15 bp, Homo sapiens
tcccaagcaggtaca

SEQ ID NO: 4371 - DNA, 15 bp, Homo sapiens
gtcccaagcaggtac

SEQ ID NO: 4372 - DNA, 15 bp, Homo sapiens
agtcccaagcaggta

SEQ ID NO: 4373 - DNA, 15 bp, Homo sapiens
gagtcccaagcaggt

SEQ ID NO: 4374 - DNA, 15 bp, Homo sapiens
agagtcccaagcagg

SEQ ID NO: 4375 - DNA, 15 bp, Homo sapiens
cagagtcccaagcag

SEQ ID NO: 4376 - DNA, 15 bp, Homo sapiens
gcagagtcccaagca

SEQ ID NO: 4377 - DNA, 15 bp, Homo sapiens
tgcagagtcccaagc

SEQ ID NO: 4378 - DNA, 15 bp, Homo sapiens
atgcagagtcccaag

SEQ ID NO: 4379 - DNA, 15 bp, Homo sapiens
catgcagagtcccaa

SEQ ID NO: 4380 - DNA, 15 bp, Homo sapiens
tcatgcagagtccca

SEQ ID NO: 4381 - DNA, 15 bp, Homo sapiens
atcatgcagagtccc

SEQ ID NO: 4382 - DNA, 15 bp, Homo sapiens
tatcatgcagagtcc

SEQ ID NO: 4383 - DNA, 15 bp, Homo sapiens
ttatcatgcagagtc

SEQ ID NO: 4384 - DNA, 15 bp, Homo sapiens
tttatcatgcagagt

SEQ ID NO: 4385 - DNA, 15 bp, Homo sapiens
atttatcatgcagag

SEQ ID NO: 4386 - DNA, 15 bp, Homo sapiens
catttatcatgcaga

SEQ ID NO: 4387 - DNA, 15 bp, Homo sapiens
tcatttatcatgcag

SEQ ID NO: 4388 - DNA, 15 bp, Homo sapiens
gtcatttatcatgca

SEQ ID NO: 4389 - DNA, 15 bp, Homo sapiens
cgtcatttatcatgc

SEQ ID NO: 4390 - DNA, 15 bp, Homo sapiens
acgtcatttatcatg

SEQ ID NO: 4391 - DNA, 15 bp, Homo sapiens
cacgtcatttatcat

SEQ ID NO: 4392 - DNA, 15 bp, Homo sapiens
acacgtcatttatca

SEQ ID NO: 4393 - DNA, 15 bp, Homo sapiens
gacacgtcatttatc

SEQ ID NO: 4394 - DNA, 15 bp, Homo sapiens
ggacacgtcatttat

SEQ ID NO: 4395 - DNA, 15 bp, Homo sapiens
aggacacgtcattta

SEQ ID NO: 4396 - DNA, 15 bp, Homo sapiens
caggacacgtcattt

SEQ ID NO: 4397 - DNA, 15 bp, Homo sapiens
ccaggacacgtcatt

SEQ ID NO: 4398 - DNA, 15 bp, Homo sapiens
tccaggacacgtcat

SEQ ID NO: 4399 - DNA, 15 bp, Homo sapiens
ttccaggacacgtca

SEQ ID NO: 4400 - DNA, 15 bp, Homo sapiens
gttccaggacacgtc

SEQ ID NO: 4401 - DNA, 15 bp, Homo sapiens
ggttccaggacacgt

SEQ ID NO: 4402 - DNA, 15 bp, Homo sapiens
aggttccaggacacg

SEQ ID NO: 4403 - DNA, 15 bp, Homo sapiens
caggttccaggacac

SEQ ID NO: 4404 - DNA, 15 bp, Homo sapiens
tcaggttccaggaca

SEQ ID NO: 4405 - DNA, 15 bp, Homo sapiens
ttcaggttccaggac

SEQ ID NO: 4406 - DNA, 15 bp, Homo sapiens
tttcaggttccagga

SEQ ID NO: 4407 - DNA, 15 bp, Homo sapiens
atttcaggttccagg

SEQ ID NO: 4408 - DNA, 15 bp, Homo sapiens
gatttcaggttccag

SEQ ID NO: 4409 - DNA, 15 bp, Homo sapiens
agatttcaggttcca

SEQ ID NO: 4410 - DNA, 15 bp, Homo sapiens
aagatttcaggttcc

SEQ ID NO: 4411 - DNA, 15 bp, Homo sapiens
aaagatttcaggttc

SEQ ID NO: 4412 - DNA, 15 bp, Homo sapiens
aaaagatttcaggtt

SEQ ID NO: 4413 - DNA, 15 bp, Homo sapiens
taaaagatttcaggt

SEQ ID NO: 4414 - DNA, 15 bp, Homo sapiens
ataaaagatttcagg

SEQ ID NO: 4415 - DNA, 15 bp, Homo sapiens
tataaaagatttcag

SEQ ID NO: 4416 - DNA, 15 bp, Homo sapiens
ttataaaagatttca

SEQ ID NO: 4417 - DNA, 15 bp, Homo sapiens
tttataaaagatttc

SEQ ID NO: 4418 - DNA, 15 bp, Homo sapiens
ctttataaaagattt

SEQ ID NO: 4419 - DNA, 15 bp, Homo sapiens
cctttataaaagatt

SEQ ID NO: 4420 - DNA, 15 bp, Homo sapiens
acctttataaaagat

SEQ ID NO: 4421 - DNA, 15 bp, Homo sapiens
aacctttataaaaga

SEQ ID NO: 4422 - DNA, 15 bp, Homo sapiens
taacctttataaaag

SEQ ID NO: 4423 - DNA, 15 bp, Homo sapiens
ttaacctttataaaa

SEQ ID NO: 4424 - DNA, 15 bp, Homo sapiens
attaacctttataaa

SEQ ID NO: 4425 - DNA, 15 bp, Homo sapiens
tattaacctttataa

SEQ ID NO: 4426 - DNA, 15 bp, Homo sapiens
atattaacctttata

SEQ ID NO: 4427 - DNA, 15 bp, Homo sapiens
gatattaacctttat

SEQ ID NO: 4428 - DNA, 15 bp, Homo sapiens
tgatattaaccttta

SEQ ID NO: 4429 - DNA, 15 bp, Homo sapiens
ctgatattaaccttt

SEQ ID NO: 4430 - DNA, 15 bp, Homo sapiens
gctgatattaacctt

SEQ ID NO: 4431 - DNA, 15 bp, Homo sapiens
tgctgatattaacct

SEQ ID NO: 4432 - DNA, 15 bp, Homo sapiens
ctgctgatattaacc

SEQ ID NO: 4433 - DNA, 15 bp, Homo sapiens
tctgctgatattaac

SEQ ID NO: 4434 - DNA, 15 bp, Homo sapiens
ttctgctgatattaa

SEQ ID NO: 4435 - DNA, 15 bp, Homo sapiens
tttctgctgatatta

SEQ ID NO: 4436 - DNA, 15 bp, Homo sapiens
atttctgctgatatt

SEQ ID NO: 4437 - DNA, 15 bp, Homo sapiens
gatttctgctgatat

SEQ ID NO: 4438 - DNA, 15 bp, Homo sapiens
agatttctgctgata

SEQ ID NO: 4439 - DNA, 15 bp, Homo sapiens
aagatttctgctgat

SEQ ID NO: 4440 - DNA, 15 bp, Homo sapiens
aaagatttctgctga

SEQ ID NO: 4441 - DNA, 15 bp, Homo sapiens
aaaagatttctgctg

SEQ ID NO: 4442 - DNA, 15 bp, Homo sapiens
taaaagatttctgct

SEQ ID NO: 4443 - DNA, 15 bp, Homo sapiens
ttaaaagatttctgc

SEQ ID NO: 4444 - DNA, 15 bp, Homo sapiens
attaaaagatttctg

SEQ ID NO: 4445 - DNA, 15 bp, Homo sapiens
aattaaaagatttct

SEQ ID NO: 4446 - DNA, 15 bp, Homo sapiens
taattaaaagatttc

SEQ ID NO: 4447 - DNA, 15 bp, Homo sapiens
ctaattaaaagattt

SEQ ID NO: 4448 - DNA, 15 bp, Homo sapiens
gctaattaaaagatt

SEQ ID NO: 4449 - DNA, 15 bp, Homo sapiens
agctaattaaaagat

SEQ ID NO: 4450 - DNA, 15 bp, Homo sapiens
tagctaattaaaaga

SEQ ID NO: 4451 - DNA, 15 bp, Homo sapiens
ttagctaattaaaag

SEQ ID NO: 4452 - DNA, 15 bp, Homo sapiens
cttagctaattaaaa

SEQ ID NO: 4453 - DNA, 15 bp, Homo sapiens
tcttagctaattaaa

SEQ ID NO: 4454 - DNA, 15 bp, Homo sapiens
ctcttagctaattaa

SEQ ID NO: 4455 - DNA, 15 bp, Homo sapiens
gctcttagctaatta

SEQ ID NO: 4456 - DNA, 15 bp, Homo sapiens
tgctcttagctaatt

SEQ ID NO: 4457 - DNA, 15 bp, Homo sapiens
ctgctcttagctaat

SEQ ID NO: 4458 - DNA, 15 bp, Homo sapiens
gctgctcttagctaa

SEQ ID NO: 4459 - DNA, 15 bp, Homo sapiens
agctgctcttagcta

SEQ ID NO: 4460 - DNA, 15 bp, Homo sapiens
aagctgctcttagct

SEQ ID NO: 4461 - DNA, 15 bp, Homo sapiens
caagctgctcttagc

SEQ ID NO: 4462 - DNA, 15 bp, Homo sapiens
acaagctgctcttag

SEQ ID NO: 4463 - DNA, 15 bp, Homo sapiens
aacaagctgctctta

SEQ ID NO: 4464 - DNA, 15 bp, Homo sapiens
gaacaagctgctctt

SEQ ID NO: 4465 - DNA, 15 bp, Homo sapiens
agaacaagctgctct

SEQ ID NO: 4466 - DNA, 15 bp, Homo sapiens
gagaacaagctgctc

SEQ ID NO: 4467 - DNA, 15 bp, Homo sapiens
tgagaacaagctgct

SEQ ID NO: 4468 - DNA, 15 bp, Homo sapiens
ttgagaacaagctgc

SEQ ID NO: 4469 - DNA, 15 bp, Homo sapiens
cttgagaacaagctg

SEQ ID NO: 4470 - DNA, 15 bp, Homo sapiens
gcttgagaacaagct

SEQ ID NO: 4471 - DNA, 15 bp, Homo sapiens
agcttgagaacaagc

SEQ ID NO: 4472 - DNA, 15 bp, Homo sapiens
cagcttgagaacaag

SEQ ID NO: 4473 - DNA, 15 bp, Homo sapiens
gcagcttgagaacaa

SEQ ID NO: 4474 - DNA, 15 bp, Homo sapiens
ggcagcttgagaaca

SEQ ID NO: 4475 - DNA, 15 bp, Homo sapiens
gggcagcttgagaac

SEQ ID NO: 4476 - DNA, 15 bp, Homo sapiens
cgggcagcttgagaa

SEQ ID NO: 4477 - DNA, 15 bp, Homo sapiens
tcgggcagcttgaga

SEQ ID NO: 4478 - DNA, 15 bp, Homo sapiens
ctcgggcagcttgag

SEQ ID NO: 4479 - DNA, 15 bp, Homo sapiens
actcgggcagcttga

SEQ ID NO: 4480 - DNA, 15 bp, Homo sapiens
aactcgggcagcttg

SEQ ID NO: 4481 - DNA, 15 bp, Homo sapiens
taactcgggcagctt

SEQ ID NO: 4482 - DNA, 15 bp, Homo sapiens
ataactcgggcagct

SEQ ID NO: 4483 - DNA, 15 bp, Homo sapiens
gataactcgggcagc

SEQ ID NO: 4484 - DNA, 15 bp, Homo sapiens
agataactcgggcag

SEQ ID NO: 4485 - DNA, 15 bp, Homo sapiens
aagataactcgggca

SEQ ID NO: 4486 - DNA, 15 bp, Homo sapiens
caagataactcgggc

SEQ ID NO: 4487 - DNA, 15 bp, Homo sapiens
ccaagataactcggg

SEQ ID NO: 4488 - DNA, 15 bp, Homo sapiens
tccaagataactcgg

SEQ ID NO: 4489 - DNA, 15 bp, Homo sapiens
ctccaagataactcg

SEQ ID NO: 4490 - DNA, 15 bp, Homo sapiens
cctccaagataactc

SEQ ID NO: 4491 - DNA, 15 bp, Homo sapiens
tcctccaagataact

SEQ ID NO: 4492 - DNA, 15 bp, Homo sapiens
ctcctccaagataac

SEQ ID NO: 4493 - DNA, 15 bp, Homo sapiens
tctcctccaagataa

SEQ ID NO: 4494 - DNA, 15 bp, Homo sapiens
ctctcctccaagata

SEQ ID NO: 4495 - DNA, 15 bp, Homo sapiens
tctctcctccaagat

SEQ ID NO: 4496 - DNA, 15 bp, Homo sapiens
ttctctcctccaaga

SEQ ID NO: 4497 - DNA, 15 bp, Homo sapiens
attctctcctccaag

SEQ ID NO: 4498 - DNA, 15 bp, Homo sapiens
gattctctcctccaa

SEQ ID NO: 4499 - DNA, 15 bp, Homo sapiens
tgattctctcctcca

SEQ ID NO: 4500 - DNA, 15 bp, Homo sapiens
gtgattctctcctcc

SEQ ID NO: 4501 - DNA, 15 bp, Homo sapiens
tgtgattctctcctc

SEQ ID NO: 4502 - DNA, 15 bp, Homo sapiens
ctgtgattctctcct

SEQ ID NO: 4503 - DNA, 15 bp, Homo sapiens
cctgtgattctctcc

SEQ ID NO: 4504 - DNA, 15 bp, Homo sapiens
tcctgtgattctctc

SEQ ID NO: 4505 - DNA, 15 bp, Homo sapiens
ttcctgtgattctct

SEQ ID NO: 4506 - DNA, 15 bp, Homo sapiens
tttcctgtgattctc

SEQ ID NO: 4507 - DNA, 15 bp, Homo sapiens
atttcctgtgattct

SEQ ID NO: 4508 - DNA, 15 bp, Homo sapiens
catttcctgtgattc

SEQ ID NO: 4509 - DNA, 15 bp, Homo sapiens
acatttcctgtgatt

SEQ ID NO: 4510 - DNA, 15 bp, Homo sapiens
aacatttcctgtgat

SEQ ID NO: 4511 - DNA, 15 bp, Homo sapiens
aaacatttcctgtga

SEQ ID NO: 4512 - DNA, 15 bp, Homo sapiens
caaacatttcctgtg

SEQ ID NO: 4513 - DNA, 15 bp, Homo sapiens
tcaaacatttcctgt

SEQ ID NO: 4514 - DNA, 15 bp, Homo sapiens
atcaaacatttcctg

SEQ ID NO: 4515 - DNA, 15 bp, Homo sapiens
tatcaaacatttcct

SEQ ID NO: 4516 - DNA, 15 bp, Homo sapiens
atatcaaacatttcc

SEQ ID NO: 4517 - DNA, 15 bp, Homo sapiens
aatatcaaacatttc

SEQ ID NO: 4518 - DNA, 15 bp, Homo sapiens
aaatatcaaacattt

SEQ ID NO: 4519 - DNA, 15 bp, Homo sapiens
gaaatatcaaacatt

SEQ ID NO: 4520 - DNA, 15 bp, Homo sapiens
agaaatatcaaacat

SEQ ID NO: 4521 - DNA, 15 bp, Homo sapiens
tagaaatatcaaaca

SEQ ID NO: 4522 - DNA, 15 bp, Homo sapiens
ctagaaatatcaaac

SEQ ID NO: 4523 - DNA, 15 bp, Homo sapiens
actagaaatatcaaa

SEQ ID NO: 4524 - DNA, 15 bp, Homo sapiens
tactagaaatatcaa

SEQ ID NO: 4525 - DNA, 15 bp, Homo sapiens
ttactagaaatatca

SEQ ID NO: 4526 - DNA, 15 bp, Homo sapiens
gttactagaaatatc

SEQ ID NO: 4527 - DNA, 15 bp, Homo sapiens
ggttactagaaatat

SEQ ID NO: 4528 - DNA, 15 bp, Homo sapiens
tggttactagaaata

SEQ ID NO: 4529 - DNA, 15 bp, Homo sapiens
ctggttactagaaat

SEQ ID NO: 4530 - DNA, 15 bp, Homo sapiens
actggttactagaaa

SEQ ID NO: 4531 - DNA, 15 bp, Homo sapiens
cactggttactagaa

SEQ ID NO: 4532 - DNA, 15 bp, Homo sapiens
acactggttactaga

SEQ ID NO: 4533 - DNA, 15 bp, Homo sapiens
aacactggttactag

SEQ ID NO: 4534 - DNA, 15 bp, Homo sapiens
aaacactggttacta

SEQ ID NO: 4535 - DNA, 15 bp, Homo sapiens
aaaacactggttact

SEQ ID NO: 4536 - DNA, 15 bp, Homo sapiens
gaaaacactggttac

SEQ ID NO: 4537 - DNA, 15 bp, Homo sapiens
tgaaaacactggtta

SEQ ID NO: 4538 - DNA, 15 bp, Homo sapiens
ctgaaaacactggtt

SEQ ID NO: 4539 - DNA, 15 bp, Homo sapiens
actgaaaacactggt

SEQ ID NO: 4540 - DNA, 15 bp, Homo sapiens
cactgaaaacactgg

SEQ ID NO: 4541 - DNA, 15 bp, Homo sapiens
gcactgaaaacactg

SEQ ID NO: 4542 - DNA, 15 bp, Homo sapiens
cgcactgaaaacact

SEQ ID NO: 4543 - DNA, 15 bp, Homo sapiens
acgcactgaaaacac

SEQ ID NO: 4544 - DNA, 15 bp, Homo sapiens
cacgcactgaaaaca

SEQ ID NO: 4545 - DNA, 15 bp, Homo sapiens
ccacgcactgaaaac

SEQ ID NO: 4546 - DNA, 15 bp, Homo sapiens
cccacgcactgaaaa

SEQ ID NO: 4547 - DNA, 15 bp, Homo sapiens
ccccacgcactgaaa

SEQ ID NO: 4548 - DNA, 15 bp, Homo sapiens
accccacgcactgaa

SEQ ID NO: 4549 - DNA, 15 bp, Homo sapiens
taccccacgcactga

SEQ ID NO: 4550 - DNA, 15 bp, Homo sapiens
ttaccccacgcactg

SEQ ID NO: 4551 - DNA, 15 bp, Homo sapiens
tttaccccacgcact

SEQ ID NO: 4552 - DNA, 15 bp, Homo sapiens
ctttaccccacgcac

SEQ ID NO: 4553 - DNA, 15 bp, Homo sapiens
gctttaccccacgca

SEQ ID NO: 4554 - DNA, 15 bp, Homo sapiens
tgctttaccccacgc

SEQ ID NO: 4555 - DNA, 15 bp, Homo sapiens
gtgctttaccccacg

SEQ ID NO: 4556 - DNA, 15 bp, Homo sapiens
tgtgctttaccccac

SEQ ID NO: 4557 - DNA, 15 bp, Homo sapiens
gtgtgctttacccca

SEQ ID NO: 4558 - DNA, 15 bp, Homo sapiens
agtgtgctttacccc

SEQ ID NO: 4559 - DNA, 15 bp, Homo sapiens
gagtgtgctttaccc

SEQ ID NO: 4560 - DNA, 15 bp, Homo sapiens
ggagtgtgctttacc

SEQ ID NO: 4561 - DNA, 15 bp, Homo sapiens
aggagtgtgctttac

SEQ ID NO: 4562 - DNA, 15 bp, Homo sapiens
taggagtgtgcttta

SEQ ID NO: 4563 - DNA, 15 bp, Homo sapiens
ctaggagtgtgcttt

SEQ ID NO: 4564 - DNA, 15 bp, Homo sapiens
tctaggagtgtgctt

SEQ ID NO: 4565 - DNA, 15 bp, Homo sapiens
gtctaggagtgtgct

SEQ ID NO: 4566 - DNA, 15 bp, Homo sapiens
agtctaggagtgtgc

SEQ ID NO: 4567 - DNA, 15 bp, Homo sapiens
cagtctaggagtgtg

SEQ ID NO: 4568 - DNA, 15 bp, Homo sapiens
ccagtctaggagtgt

SEQ ID NO: 4569 - DNA, 15 bp, Homo sapiens
gccagtctaggagtg

SEQ ID NO: 4570 - DNA, 15 bp, Homo sapiens
ggccagtctaggagt

SEQ ID NO: 4571 - DNA, 15 bp, Homo sapiens
tggccagtctaggag

SEQ ID NO: 4572 - DNA, 15 bp, Homo sapiens
ctggccagtctagga

SEQ ID NO: 4573 - DNA, 15 bp, Homo sapiens
actggccagtctagg

SEQ ID NO: 4574 - DNA, 15 bp, Homo sapiens
gactggccagtctag

SEQ ID NO: 4575 - DNA, 15 bp, Homo sapiens
ggactggccagtcta

SEQ ID NO: 4576 - DNA, 15 bp, Homo sapiens
gggactggccagtct

SEQ ID NO: 4577 - DNA, 15 bp, Homo sapiens
tgggactggccagtc

SEQ ID NO: 4578 - DNA, 15 bp, Homo sapiens
ttgggactggccagt

SEQ ID NO: 4579 - DNA, 15 bp, Homo sapiens
tttgggactggccag

SEQ ID NO: 4580 - DNA, 15 bp, Homo sapiens
ctttgggactggcca

SEQ ID NO: 4581 - DNA, 15 bp, Homo sapiens
tctttgggactggcc

SEQ ID NO: 4582 - DNA, 15 bp, Homo sapiens
ctctttgggactggc

SEQ ID NO: 4583 - DNA, 15 bp, Homo sapiens
actctttgggactgg

SEQ ID NO: 4584 - DNA, 15 bp, Homo sapiens
cactctttgggactg

SEQ ID NO: 4585 - DNA, 15 bp, Homo sapiens
acactctttgggact

SEQ ID NO: 4586 - DNA, 15 bp, Homo sapiens
cacactctttgggac

SEQ ID NO: 4587 - DNA, 15 bp, Homo sapiens
ccacactctttggga

SEQ ID NO: 4588 - DNA, 15 bp, Homo sapiens
gccacactctttggg

SEQ ID NO: 4589 - DNA, 15 bp, Homo sapiens
tgccacactctttgg

SEQ ID NO: 4590 - DNA, 15 bp, Homo sapiens
ctgccacactctttg

SEQ ID NO: 4591 - DNA, 15 bp, Homo sapiens
cctgccacactcttt

SEQ ID NO: 4592 - DNA, 15 bp, Homo sapiens
tcctgccacactctt

SEQ ID NO: 4593 - DNA, 15 bp, Homo sapiens
gtcctgccacactct

SEQ ID NO: 4594 - DNA, 15 bp, Homo sapiens
tgtcctgccacactc

SEQ ID NO: 4595 - DNA, 15 bp, Homo sapiens
gtgtcctgccacact

SEQ ID NO: 4596 - DNA, 15 bp, Homo sapiens
ggtgtcctgccacac

SEQ ID NO: 4597 - DNA, 15 bp, Homo sapiens
aggtgtcctgccaca

SEQ ID NO: 4598 - DNA, 15 bp, Homo sapiens
caggtgtcctgccac

SEQ ID NO: 4599 - DNA, 15 bp, Homo sapiens
gcaggtgtcctgcca

SEQ ID NO: 4600 - DNA, 15 bp, Homo sapiens
agcaggtgtcctgcc

SEQ ID NO: 4601 - DNA, 15 bp, Homo sapiens
aagcaggtgtcctgc

SEQ ID NO: 4602 - DNA, 15 bp, Homo sapiens
caagcaggtgtcctg

SEQ ID NO: 4603 - DNA, 15 bp, Homo sapiens
acaagcaggtgtcct

SEQ ID NO: 4604 - DNA, 15 bp, Homo sapiens
aacaagcaggtgtcc

SEQ ID NO: 4605 - DNA, 15 bp, Homo sapiens
aaacaagcaggtgtc

SEQ ID NO: 4606 - DNA, 15 bp, Homo sapiens
aaaacaagcaggtgt

SEQ ID NO: 4607 - DNA, 15 bp, Homo sapiens
gaaaacaagcaggtg

SEQ ID NO: 4608 - DNA, 15 bp, Homo sapiens
ggaaaacaagcaggt

SEQ ID NO: 4609 - DNA, 15 bp, Homo sapiens
gggaaaacaagcagg

SEQ ID NO: 4610 - DNA, 15 bp, Homo sapiens
agggaaaacaagcag

SEQ ID NO: 4611 - DNA, 15 bp, Homo sapiens
cagggaaaacaagca

SEQ ID NO: 4612 - DNA, 15 bp, Homo sapiens
gcagggaaaacaagc

SEQ ID NO: 4613 - DNA, 15 bp, Homo sapiens
ggcagggaaaacaag

SEQ ID NO: 4614 - DNA, 15 bp, Homo sapiens
gggcagggaaaacaa

SEQ ID NO: 4615 - DNA, 15 bp, Homo sapiens
agggcagggaaaaca

SEQ ID NO: 4616 - DNA, 15 bp, Homo sapiens
gagggcagggaaaac

SEQ ID NO: 4617 - DNA, 15 bp, Homo sapiens
agagggcagggaaaa

SEQ ID NO: 4618 - DNA, 15 bp, Homo sapiens
cagagggcagggaaa

SEQ ID NO: 4619 - DNA, 15 bp, Homo sapiens
gcagagggcagggaa

SEQ ID NO: 4620 - DNA, 15 bp, Homo sapiens
agcagagggcaggga

SEQ ID NO: 4621 - DNA, 15 bp, Homo sapiens
tagcagagggcaggg

SEQ ID NO: 4622 - DNA, 15 bp, Homo sapiens
atagcagagggcagg

SEQ ID NO: 4623 - DNA, 15 bp, Homo sapiens
catagcagagggcag

SEQ ID NO: 4624 - DNA, 15 bp, Homo sapiens
ccatagcagagggca

SEQ ID NO: 4625 - DNA, 15 bp, Homo sapiens
accatagcagagggc

SEQ ID NO: 4626 - DNA, 15 bp, Homo sapiens
caccatagcagaggg

SEQ ID NO: 4627 - DNA, 15 bp, Homo sapiens
tcaccatagcagagg

SEQ ID NO: 4628 - DNA, 15 bp, Homo sapiens
gtcaccatagcagag

SEQ ID NO: 4629 - DNA, 15 bp, Homo sapiens
tgtcaccatagcaga

SEQ ID NO: 4630 - DNA, 15 bp, Homo sapiens
atgtcaccatagcag

SEQ ID NO: 4631 - DNA, 15 bp, Homo sapiens
gatgtcaccatagca

SEQ ID NO: 4632 - DNA, 15 bp, Homo sapiens
ggatgtcaccatagc

SEQ ID NO: 4633 - DNA, 15 bp, Homo sapiens
aggatgtcaccatag

SEQ ID NO: 4634 - DNA, 15 bp, Homo sapiens
aaggatgtcaccata

SEQ ID NO: 4635 - DNA, 15 bp, Homo sapiens
caaggatgtcaccat

SEQ ID NO: 4636 - DNA, 15 bp, Homo sapiens
gcaaggatgtcacca

SEQ ID NO: 4637 - DNA, 15 bp, Homo sapiens
tgcaaggatgtcacc

SEQ ID NO: 4638 - DNA, 15 bp, Homo sapiens
ctgcaaggatgtcac

SEQ ID NO: 4639 - DNA, 15 bp, Homo sapiens
tctgcaaggatgtca

SEQ ID NO: 4640 - DNA, 15 bp, Homo sapiens
gtctgcaaggatgtc

SEQ ID NO: 4641 - DNA, 15 bp, Homo sapiens
ggtctgcaaggatgt

SEQ ID NO: 4642 - DNA, 15 bp, Homo sapiens
tggtctgcaaggatg

SEQ ID NO: 4643 - DNA, 15 bp, Homo sapiens
ctggtctgcaaggat

SEQ ID NO: 4644 - DNA, 15 bp, Homo sapiens
actggtctgcaagga

SEQ ID NO: 4645 - DNA, 15 bp, Homo sapiens
gactggtctgcaagg

SEQ ID NO: 4646 - DNA, 15 bp, Homo sapiens
agactggtctgcaag

SEQ ID NO: 4647 - DNA, 15 bp, Homo sapiens
aagactggtctgcaa

SEQ ID NO: 4648 - DNA, 15 bp, Homo sapiens
caagactggtctgca

SEQ ID NO: 4649 - DNA, 15 bp, Homo sapiens
gcaagactggtctgc

SEQ ID NO: 4650 - DNA, 15 bp, Homo sapiens
cgcaagactggtctg

SEQ ID NO: 4651 - DNA, 15 bp, Homo sapiens
acgcaagactggtct

SEQ ID NO: 4652 - DNA, 15 bp, Homo sapiens
cacgcaagactggtc

SEQ ID NO: 4653 - DNA, 15 bp, Homo sapiens
ccacgcaagactggt

SEQ ID NO: 4654 - DNA, 15 bp, Homo sapiens
gccacgcaagactgg

SEQ ID NO: 4655 - DNA, 15 bp, Homo sapiens
agccacgcaagactg

SEQ ID NO: 4656 - DNA, 15 bp, Homo sapiens
cagccacgcaagact

SEQ ID NO: 4657 - DNA, 15 bp, Homo sapiens
ccagccacgcaagac

SEQ ID NO: 4658 - DNA, 15 bp, Homo sapiens
gccagccacgcaaga

SEQ ID NO: 4659 - DNA, 15 bp, Homo sapiens
tgccagccacgcaag

SEQ ID NO: 4660 - DNA, 15 bp, Homo sapiens
ctgccagccacgcaa

SEQ ID NO: 4661 - DNA, 15 bp, Homo sapiens
tctgccagccacgca

SEQ ID NO: 4662 - DNA, 15 bp, Homo sapiens
gtctgccagccacgc

SEQ ID NO: 4663 - DNA, 15 bp, Homo sapiens
cgtctgccagccacg

SEQ ID NO: 4664 - DNA, 15 bp, Homo sapiens
gcgtctgccagccac

SEQ ID NO: 4665 - DNA, 15 bp, Homo sapiens
tgcgtctgccagcca

SEQ ID NO: 4666 - DNA, 15 bp, Homo sapiens
ttgcgtctgccagcc

SEQ ID NO: 4667 - DNA, 15 bp, Homo sapiens
attgcgtctgccagc

SEQ ID NO: 4668 - DNA, 15 bp, Homo sapiens
gattgcgtctgccag

SEQ ID NO: 4669 - DNA, 15 bp, Homo sapiens
agattgcgtctgcca

SEQ ID NO: 4670 - DNA, 15 bp, Homo sapiens
aagattgcgtctgcc

SEQ ID NO: 4671 - DNA, 15 bp, Homo sapiens
aaagattgcgtctgc

SEQ ID NO: 4672 - DNA, 15 bp, Homo sapiens
aaaagattgcgtctg

SEQ ID NO: 4673 - DNA, 15 bp, Homo sapiens
aaaaagattgcgtct

SEQ ID NO: 4674 - DNA, 15 bp, Homo sapiens
aaaaaagattgcgtc

SEQ ID NO: 4675 - DNA, 15 bp, Homo sapiens
aaaaaaagattgcgt

SEQ ID NO: 4676 - DNA, 15 bp, Homo sapiens
gaaaaaaagattgcg

SEQ ID NO: 4677 - DNA, 15 bp, Homo sapiens
agaaaaaaagattgc

SEQ ID NO: 4678 - DNA, 15 bp, Homo sapiens
aagaaaaaaagattg

SEQ ID NO: 4679 - DNA, 15 bp, Homo sapiens
caagaaaaaaagatt

SEQ ID NO: 4680 - DNA, 15 bp, Homo sapiens
ccaagaaaaaaagat

SEQ ID NO: 4681 - DNA, 15 bp, Homo sapiens
cccaagaaaaaaaga

SEQ ID NO: 4682 - DNA, 15 bp, Homo sapiens
acccaagaaaaaaag

SEQ ID NO: 4683 - DNA, 15 bp, Homo sapiens
tacccaagaaaaaaa

SEQ ID NO: 4684 - DNA, 15 bp, Homo sapiens
ctacccaagaaaaaa

SEQ ID NO: 4685 - DNA, 15 bp, Homo sapiens
tctacccaagaaaaa

SEQ ID NO: 4686 - DNA, 15 bp, Homo sapiens
ctctacccaagaaaa

SEQ ID NO: 4687 - DNA, 15 bp, Homo sapiens
gctctacccaagaaa

SEQ ID NO: 4688 - DNA, 15 bp, Homo sapiens
tgctctacccaagaa

SEQ ID NO: 4689 - DNA, 15 bp, Homo sapiens
atgctctacccaaga

SEQ ID NO: 4690 - DNA, 15 bp, Homo sapiens
aatgctctacccaag

SEQ ID NO: 4691 - DNA, 15 bp, Homo sapiens
taatgctctacccaa

SEQ ID NO: 4692 - DNA, 15 bp, Homo sapiens
ataatgctctaccca

SEQ ID NO: 4693 - DNA, 15 bp, Homo sapiens
gataatgctctaccc

SEQ ID NO: 4694 - DNA, 15 bp, Homo sapiens
tgataatgctctacc

SEQ ID NO: 4695 - DNA, 15 bp, Homo sapiens
gtgataatgctctac

SEQ ID NO: 4696 - DNA, 15 bp, Homo sapiens
ggtgataatgctcta

SEQ ID NO: 4697 - DNA, 15 bp, Homo sapiens
cggtgataatgctct

SEQ ID NO: 4698 - DNA, 15 bp, Homo sapiens
gcggtgataatgctc

SEQ ID NO: 4699 - DNA, 15 bp, Homo sapiens
agcggtgataatgct

SEQ ID NO: 4700 - DNA, 15 bp, Homo sapiens
cagcggtgataatgc

SEQ ID NO: 4701 - DNA, 15 bp, Homo sapiens
gcagcggtgataatg

SEQ ID NO: 4702 - DNA, 15 bp, Homo sapiens
cgcagcggtgataat

SEQ ID NO: 4703 - DNA, 15 bp, Homo sapiens
tcgcagcggtgataa

SEQ ID NO: 4704 - DNA, 15 bp, Homo sapiens
atcgcagcggtgata

SEQ ID NO: 4705 - DNA, 15 bp, Homo sapiens
catcgcagcggtgat

SEQ ID NO: 4706 - DNA, 15 bp, Homo sapiens
ccatcgcagcggtga

SEQ ID NO: 4707 - DNA, 15 bp, Homo sapiens
tccatcgcagcggtg

SEQ ID NO: 4708 - DNA, 15 bp, Homo sapiens
ttccatcgcagcggt

SEQ ID NO: 4709 - DNA, 15 bp, Homo sapiens
cttccatcgcagcgg

SEQ ID NO: 4710 - DNA, 15 bp, Homo sapiens
ccttccatcgcagcg

SEQ ID NO: 4711 - DNA, 15 bp, Homo sapiens
tccttccatcgcagc

SEQ ID NO: 4712 - DNA, 15 bp, Homo sapiens
gtccttccatcgcag

SEQ ID NO: 4713 - DNA, 15 bp, Homo sapiens
ggtccttccatcgca

SEQ ID NO: 4714 - DNA, 15 bp, Homo sapiens
aggtccttccatcgc

SEQ ID NO: 4715 - DNA, 15 bp, Homo sapiens
aaggtccttccatcg

SEQ ID NO: 4716 - DNA, 15 bp, Homo sapiens
caaggtccttccatc

SEQ ID NO: 4717 - DNA, 15 bp, Homo sapiens
acaaggtccttccat

SEQ ID NO: 4718 - DNA, 15 bp, Homo sapiens
gacaaggtccttcca

SEQ ID NO: 4719 - DNA, 15 bp, Homo sapiens
ggacaaggtccttcc

SEQ ID NO: 4720 - DNA, 15 bp, Homo sapiens
aggacaaggtccttc

SEQ ID NO: 4721 - DNA, 15 bp, Homo sapiens
gaggacaaggtcctt

SEQ ID NO: 4722 - DNA, 15 bp, Homo sapiens
cgaggacaaggtcct

SEQ ID NO: 4723 - DNA, 15 bp, Homo sapiens
ccgaggacaaggtcc

SEQ ID NO: 4724 - DNA, 15 bp, Homo sapiens
accgaggacaaggtc

SEQ ID NO: 4725 - DNA, 15 bp, Homo sapiens
caccgaggacaaggt

SEQ ID NO: 4726 - DNA, 15 bp, Homo sapiens
gcaccgaggacaagg

SEQ ID NO: 4727 - DNA, 15 bp, Homo sapiens
ggcaccgaggacaag

SEQ ID NO: 4728 - DNA, 15 bp, Homo sapiens
aggcaccgaggacaa

SEQ ID NO: 4729 - DNA, 15 bp, Homo sapiens
gaggcaccgaggaca

SEQ ID NO: 4730 - DNA, 15 bp, Homo sapiens
ggaggcaccgaggac

SEQ ID NO: 4731 - DNA, 15 bp, Homo sapiens
tggaggcaccgagga

SEQ ID NO: 4732 - DNA, 15 bp, Homo sapiens
atggaggcaccgagg

SEQ ID NO: 4733 - DNA, 15 bp, Homo sapiens
tatggaggcaccgag

SEQ ID NO: 4734 - DNA, 15 bp, Homo sapiens
gtatggaggcaccga

SEQ ID NO: 4735 - DNA, 15 bp, Homo sapiens
ggtatggaggcaccg

SEQ ID NO: 4736 - DNA, 15 bp, Homo sapiens
tggtatggaggcacc

SEQ ID NO: 4737 - DNA, 15 bp, Homo sapiens
ctggtatggaggcac

SEQ ID NO: 4738 - DNA, 15 bp, Homo sapiens
gctggtatggaggca

SEQ ID NO: 4739 - DNA, 15 bp, Homo sapiens
ggctggtatggaggc

SEQ ID NO: 4740 - DNA, 15 bp, Homo sapiens
gggctggtatggagg

SEQ ID NO: 4741 - DNA, 15 bp, Homo sapiens
agggctggtatggag

SEQ ID NO: 4742 - DNA, 15 bp, Homo sapiens
tcactggaaagggct

SEQ ID NO: 4743 - DNA, 15 bp, Homo sapiens
ttcactggaaagggc

SEQ ID NO: 4744 - DNA, 15 bp, Homo sapiens
tttcactggaaaggg

SEQ ID NO: 4745 - DNA, 15 bp, Homo sapiens
gtttcactggaaagg

SEQ ID NO: 4746 - DNA, 15 bp, Homo sapiens
agtttcactggaaag

SEQ ID NO: 4747 - DNA, 15 bp, Homo sapiens
tagtttcactggaaa

SEQ ID NO: 4748 - DNA, 15 bp, Homo sapiens
gtagtttcactggaa

SEQ ID NO: 4749 - DNA, 15 bp, Homo sapiens
agtagtttcactgga

SEQ ID NO: 4750 - DNA, 15 bp, Homo sapiens
cagtagtttcactgg

SEQ ID NO: 4751 - DNA, 15 bp, Homo sapiens
gcagtagtttcactg

SEQ ID NO: 4752 - DNA, 15 bp, Homo sapiens
agcagtagtttcact

SEQ ID NO: 4753 - DNA, 15 bp, Homo sapiens
cagcagtagtttcac

SEQ ID NO: 4754 - DNA, 15 bp, Homo sapiens
acagcagtagtttca

SEQ ID NO: 4755 - DNA, 15 bp, Homo sapiens
gacagcagtagtttc

SEQ ID NO: 4756 - DNA, 15 bp, Homo sapiens
ggacagcagtagttt

SEQ ID NO: 4757 - DNA, 15 bp, Homo sapiens
gggacagcagtagtt

SEQ ID NO: 4758 - DNA, 15 bp, Homo sapiens
cgggacagcagtagt

SEQ ID NO: 4759 - DNA, 15 bp, Homo sapiens
ccgggacagcagtag

SEQ ID NO: 4760 - DNA, 15 bp, Homo sapiens
gccgggacagcagta

SEQ ID NO: 4761 - DNA, 15 bp, Homo sapiens
tgccgggacagcagt

SEQ ID NO: 4762 - DNA, 15 bp, Homo sapiens
ttgccgggacagcag

SEQ ID NO: 4763 - DNA, 15 bp, Homo sapiens
cttgccgggacagca

SEQ ID NO: 4764 - DNA, 15 bp, Homo sapiens
gcttgccgggacagc

SEQ ID NO: 4765 - DNA, 15 bp, Homo sapiens
ggcttgccgggacag

SEQ ID NO: 4766 - DNA, 15 bp, Homo sapiens
gggcttgccgggaca

SEQ ID NO: 4767 - DNA, 15 bp, Homo sapiens
ggggcttgccgggac

SEQ ID NO: 4768 - DNA, 15 bp, Homo sapiens
aggggcttgccggga

SEQ ID NO: 4769 - DNA, 15 bp, Homo sapiens
caggggcttgccggg

SEQ ID NO: 4770 - DNA, 15 bp, Homo sapiens
acaggggcttgccgg

SEQ ID NO: 4771 - DNA, 15 bp, Homo sapiens
cacaggggcttgccg

SEQ ID NO: 4772 - DNA, 15 bp, Homo sapiens
gcacaggggcttgcc

SEQ ID NO: 4773 - DNA, 15 bp, Homo sapiens
cgcacaggggcttgc

SEQ ID NO: 4774 - DNA, 15 bp, Homo sapiens
acgcacaggggcttg

SEQ ID NO: 4775 - DNA, 15 bp, Homo sapiens
cacgcacaggggctt

SEQ ID NO: 4776 - DNA, 15 bp, Homo sapiens
acacgcacaggggct

SEQ ID NO: 4777 - DNA, 15 bp, Homo sapiens
cacacgcacaggggc

SEQ ID NO: 4778 - DNA, 15 bp, Homo sapiens
gcacacgcacagggg

SEQ ID NO: 4779 - DNA, 15 bp, Homo sapiens
tgcacacgcacaggg

SEQ ID NO: 4780 - DNA, 15 bp, Homo sapiens
atgcacacgcacagg

SEQ ID NO: 4781 - DNA, 15 bp, Homo sapiens
gatgcacacgcacag

SEQ ID NO: 4782 - DNA, 15 bp, Homo sapiens
tgatgcacacgcaca

SEQ ID NO: 4783 - DNA, 15 bp, Homo sapiens
atgatgcacacgcac

SEQ ID NO: 4784 - DNA, 15 bp, Homo sapiens
aatgatgcacacgca

SEQ ID NO: 4785 - DNA, 15 bp, Homo sapiens
gaatgatgcacacgc

SEQ ID NO: 4786 - DNA, 15 bp, Homo sapiens
ggaatgatgcacacg

SEQ ID NO: 4787 - DNA, 15 bp, Homo sapiens
cggaatgatgcacac

SEQ ID NO: 4788 - DNA, 15 bp, Homo sapiens
ccggaatgatgcaca

SEQ ID NO: 4789 - DNA, 15 bp, Homo sapiens
cccggaatgatgcac

SEQ ID NO: 4790 - DNA, 15 bp, Homo sapiens
acccggaatgatgca

SEQ ID NO: 4791 - DNA, 15 bp, Homo sapiens
tacccggaatgatgc

SEQ ID NO: 4792 - DNA, 15 bp, Homo sapiens
ctacccggaatgatg

SEQ ID NO: 4793 - DNA, 15 bp, Homo sapiens
cctacccggaatgat

SEQ ID NO: 4794 - DNA, 15 bp, Homo sapiens
tcctacccggaatga

SEQ ID NO: 4795 - DNA, 15 bp, Homo sapiens
gtcctacccggaatg

SEQ ID NO: 4796 - DNA, 15 bp, Homo sapiens
tgtcctacccggaat

SEQ ID NO: 4797 - DNA, 15 bp, Homo sapiens
ttgtcctacccggaa

SEQ ID NO: 4798 - DNA, 15 bp, Homo sapiens
cttgtcctacccgga

SEQ ID NO: 4799 - DNA, 15 bp, Homo sapiens
tcttgtcctacccgg

SEQ ID NO: 4800 - DNA, 15 bp, Homo sapiens
atcttgtcctacccg

SEQ ID NO: 4801 - DNA, 15 bp, Homo sapiens
catcttgtcctaccc

SEQ ID NO: 4802 - DNA, 15 bp, Homo sapiens
acatcttgtcctacc

SEQ ID NO: 4803 - DNA, 15 bp, Homo sapiens
cacatcttgtcctac

SEQ ID NO: 4804 - DNA, 15 bp, Homo sapiens
tcacatcttgtccta

SEQ ID NO: 4805 - DNA, 15 bp, Homo sapiens
ttcacatcttgtcct

SEQ ID NO: 4806 - DNA, 15 bp, Homo sapiens
gttcacatcttgtcc

SEQ ID NO: 4807 - DNA, 15 bp, Homo sapiens
tgttcacatcttgtc

SEQ ID NO: 4808 - DNA, 15 bp, Homo sapiens
ctgttcacatcttgt

SEQ ID NO: 4809 - DNA, 15 bp, Homo sapiens
cctgttcacatcttg

SEQ ID NO: 4810 - DNA, 15 bp, Homo sapiens
acctgttcacatctt

SEQ ID NO: 4811 - DNA, 15 bp, Homo sapiens
gacctgttcacatct

SEQ ID NO: 4812 - DNA, 15 bp, Homo sapiens
ggacctgttcacatc

SEQ ID NO: 4813 - DNA, 15 bp, Homo sapiens
gggacctgttcacat

SEQ ID NO: 4814 - DNA, 15 bp, Homo sapiens
agggacctgttcaca

SEQ ID NO: 4815 - DNA, 15 bp, Homo sapiens
gagggacctgttcac

SEQ ID NO: 4816 - DNA, 15 bp, Homo sapiens
agagggacctgttca

SEQ ID NO: 4817 - DNA, 15 bp, Homo sapiens
aagagggacctgttc

SEQ ID NO: 4818 - DNA, 15 bp, Homo sapiens
gaagagggacctgtt

SEQ ID NO: 4819 - DNA, 15 bp, Homo sapiens
agaagagggacctgt

SEQ ID NO: 4820 - DNA, 15 bp, Homo sapiens
aagaagagggacctg

SEQ ID NO: 4821 - DNA, 15 bp, Homo sapiens
aaagaagagggacct

SEQ ID NO: 4822 - DNA, 15 bp, Homo sapiens
caaagaagagggacc

SEQ ID NO: 4823 - DNA, 15 bp, Homo sapiens
ccaaagaagagggac

SEQ ID NO: 4824 - DNA, 15 bp, Homo sapiens
cccaaagaagaggga

SEQ ID NO: 4825 - DNA, 15 bp, Homo sapiens
gcccaaagaagaggg

SEQ ID NO: 4826 - DNA, 15 bp, Homo sapiens
agcccaaagaagagg

SEQ ID NO: 4827 - DNA, 15 bp, Homo sapiens
aagcccaaagaagag

SEQ ID NO: 4828 - DNA, 15 bp, Homo sapiens
taagcccaaagaaga

SEQ ID NO: 4829 - DNA, 15 bp, Homo sapiens
ttaagcccaaagaag

SEQ ID NO: 4830 - DNA, 15 bp, Homo sapiens
cttaagcccaaagaa

SEQ ID NO: 4831 - DNA, 15 bp, Homo sapiens
acttaagcccaaaga

SEQ ID NO: 4832 - DNA, 15 bp, Homo sapiens
tacttaagcccaaag

SEQ ID NO: 4833 - DNA, 15 bp, Homo sapiens
ctacttaagcccaaa

SEQ ID NO: 4834 - DNA, 15 bp, Homo sapiens
tctacttaagcccaa

SEQ ID NO: 4835 - DNA, 15 bp, Homo sapiens
ttctacttaagccca

SEQ ID NO: 4836 - DNA, 15 bp, Homo sapiens
cttctacttaagccc

SEQ ID NO: 4837 - DNA, 15 bp, Homo sapiens
acttctacttaagcc

SEQ ID NO: 4838 - DNA, 15 bp, Homo sapiens
aacttctacttaagc

SEQ ID NO: 4839 - DNA, 15 bp, Homo sapiens
caacttctacttaag

SEQ ID NO: 4840 - DNA, 15 bp, Homo sapiens
acaacttctacttaa

SEQ ID NO: 4841 - DNA, 15 bp, Homo sapiens
cacaacttctactta

SEQ ID NO: 4842 - DNA, 15 bp, Homo sapiens
gcacaacttctactt

SEQ ID NO: 4843 - DNA, 15 bp, Homo sapiens
agcacaacttctact

SEQ ID NO: 4844 - DNA, 15 bp, Homo sapiens
gagcacaacttctac

SEQ ID NO: 4845 - DNA, 15 bp, Homo sapiens
agagcacaacttcta

SEQ ID NO: 4846 - DNA, 15 bp, Homo sapiens
aagagcacaacttct

SEQ ID NO: 4847 - DNA, 15 bp, Homo sapiens
gaagagcacaacttc

SEQ ID NO: 4848 - DNA, 15 bp, Homo sapiens
agaagagcacaactt

SEQ ID NO: 4849 - DNA, 15 bp, Homo sapiens
cagaagagcacaact

SEQ ID NO: 4850 - DNA, 15 bp, Homo sapiens
gcagaagagcacaac

SEQ ID NO: 4851 - DNA, 15 bp, Homo sapiens
agcagaagagcacaa

SEQ ID NO: 4852 - DNA, 15 bp, Homo sapiens
aagcagaagagcaca

SEQ ID NO: 4853 - DNA, 15 bp, Homo sapiens
aaagcagaagagcac

SEQ ID NO: 4854 - DNA, 15 bp, Homo sapiens
aaaagcagaagagca

SEQ ID NO: 4855 - DNA, 15 bp, Homo sapiens
taaaagcagaagagc

SEQ ID NO: 4856 - DNA, 15 bp, Homo sapiens
gtaaaagcagaagag

SEQ ID NO: 4857 - DNA, 15 bp, Homo sapiens
ggtaaaagcagaaga

SEQ ID NO: 4858 - DNA, 15 bp, Homo sapiens
aggtaaaagcagaag

SEQ ID NO: 4859 - DNA, 15 bp, Homo sapiens
caggtaaaagcagaa

SEQ ID NO: 4860 - DNA, 15 bp, Homo sapiens
acaggtaaaagcaga

SEQ ID NO: 4861 - DNA, 15 bp, Homo sapiens
cacaggtaaaagcag

SEQ ID NO: 4862 - DNA, 15 bp, Homo sapiens
acacaggtaaaagca

SEQ ID NO: 4863 - DNA, 15 bp, Homo sapiens
cacacaggtaaaagc

SEQ ID NO: 4864 - DNA, 15 bp, Homo sapiens
gcacacaggtaaaag

SEQ ID NO: 4865 - DNA, 15 bp, Homo sapiens
agcacacaggtaaaa

SEQ ID NO: 4866 - DNA, 15 bp, Homo sapiens
gagcacacaggtaaa

SEQ ID NO: 4867 - DNA, 15 bp, Homo sapiens
agagcacacaggtaa

SEQ ID NO: 4868 - DNA, 15 bp, Homo sapiens
aagagcacacaggta

SEQ ID NO: 4869 - DNA, 15 bp, Homo sapiens
gaagagcacacaggt

SEQ ID NO: 4870 - DNA, 15 bp, Homo sapiens
agaagagcacacagg

SEQ ID NO: 4871 - DNA, 15 bp, Homo sapiens
cagaagagcacacag

SEQ ID NO: 4872 - DNA, 15 bp, Homo sapiens
gcagaagagcacaca

SEQ ID NO: 4873 - DNA, 15 bp, Homo sapiens
agcagaagagcacac

SEQ ID NO: 4874 - DNA, 15 bp, Homo sapiens
aacaggtaaaagcag

SEQ ID NO: 4875 - DNA, 15 bp, Homo sapiens
gaacaggtaaaagca

SEQ ID NO: 4876 - DNA, 15 bp, Homo sapiens
agaacaggtaaaagc

SEQ ID NO: 4877 - DNA, 15 bp, Homo sapiens
gagaacaggtaaaag

SEQ ID NO: 4878 - DNA, 15 bp, Homo sapiens
agagaacaggtaaaa

SEQ ID NO: 4879 - DNA, 15 bp, Homo sapiens
aagagaacaggtaaa

SEQ ID NO: 4880 - DNA, 15 bp, Homo sapiens
gaagagaacaggtaa

SEQ ID NO: 4881 - DNA, 15 bp, Homo sapiens
agaagagaacaggta

SEQ ID NO: 4882 - DNA, 15 bp, Homo sapiens
cagaagagaacaggt

SEQ ID NO: 4883 - DNA, 15 bp, Homo sapiens
gcagaagagaacagg

SEQ ID NO: 4884 - DNA, 15 bp, Homo sapiens
ggcagaagagaacag

SEQ ID NO: 4885 - DNA, 15 bp, Homo sapiens
aggcagaagagaaca

SEQ ID NO: 4886 - DNA, 15 bp, Homo sapiens
aaggcagaagagaac

SEQ ID NO: 4887 - DNA, 15 bp, Homo sapiens
aaaggcagaagagaa

SEQ ID NO: 4888 - DNA, 15 bp, Homo sapiens
gaaaggcagaagaga

SEQ ID NO: 4889 - DNA, 15 bp, Homo sapiens
agaaaggcagaagag

SEQ ID NO: 4890 - DNA, 15 bp, Homo sapiens
gagaaaggcagaaga

SEQ ID NO: 4891 - DNA, 15 bp, Homo sapiens
agagaaaggcagaag

SEQ ID NO: 4892 - DNA, 15 bp, Homo sapiens
aagagaaaggcagaa

SEQ ID NO: 4893 - DNA, 15 bp, Homo sapiens
caagagaaaggcaga

SEQ ID NO: 4894 - DNA, 15 bp, Homo sapiens
gcaagagaaaggcag

SEQ ID NO: 4895 - DNA, 15 bp, Homo sapiens
tgcaagagaaaggca

SEQ ID NO: 4896 - DNA, 15 bp, Homo sapiens
ttgcaagagaaaggc

SEQ ID NO: 4897 - DNA, 15 bp, Homo sapiens
cttgcaagagaaagg

SEQ ID NO: 4898 - DNA, 15 bp, Homo sapiens
tcttgcaagagaaag

SEQ ID NO: 4899 - DNA, 15 bp, Homo sapiens
ttcttgcaagagaaa

SEQ ID NO: 4900 - DNA, 15 bp, Homo sapiens
tttcttgcaagagaa

SEQ ID NO: 4901 - DNA, 15 bp, Homo sapiens
gtttcttgcaagaga

SEQ ID NO: 4902 - DNA, 15 bp, Homo sapiens
ggtttcttgcaagag

SEQ ID NO: 4903 - DNA, 15 bp, Homo sapiens
aggtttcttgcaaga

SEQ ID NO: 4904 - DNA, 15 bp, Homo sapiens
caggtttcttgcaag

SEQ ID NO: 4905 - DNA, 15 bp, Homo sapiens
acaggtttcttgcaa

SEQ ID NO: 4906 - DNA, 15 bp, Homo sapiens
gacaggtttcttgca

SEQ ID NO: 4907 - DNA, 15 bp, Homo sapiens
cgacaggtttcttgc

SEQ ID NO: 4908 - DNA, 15 bp, Homo sapiens
tcgacaggtttcttg

SEQ ID NO: 4909 - DNA, 15 bp, Homo sapiens
ttcgacaggtttctt

SEQ ID NO: 4910 - DNA, 15 bp, Homo sapiens
tttcgacaggtttct

SEQ ID NO: 4911 - DNA, 15 bp, Homo sapiens
ctttcgacaggtttc

SEQ ID NO: 4912 - DNA, 15 bp, Homo sapiens
gctttcgacaggttt

SEQ ID NO: 4913 - DNA, 15 bp, Homo sapiens
agctttcgacaggtt

SEQ ID NO: 4914 - DNA, 15 bp, Homo sapiens
aagctttcgacaggt

SEQ ID NO: 4915 - DNA, 15 bp, Homo sapiens
caagctttcgacagg

SEQ ID NO: 4916 - DNA, 15 bp, Homo sapiens
gcaagctttcgacag

SEQ ID NO: 4917 - DNA, 15 bp, Homo sapiens
agcaagctttcgaca

SEQ ID NO: 4918 - DNA, 15 bp, Homo sapiens
aagcaagctttcgac

SEQ ID NO: 4919 - DNA, 15 bp, Homo sapiens
aaagcaagctttcga

SEQ ID NO: 4920 - DNA, 15 bp, Homo sapiens
caaagcaagctttcg

SEQ ID NO: 4921 - DNA, 15 bp, Homo sapiens
gcaaagcaagctttc

SEQ ID NO: 4922 - DNA, 15 bp, Homo sapiens
tgcaaagcaagcttt

SEQ ID NO: 4923 - DNA, 15 bp, Homo sapiens
atgcaaagcaagctt

SEQ ID NO: 4924 - DNA, 15 bp, Homo sapiens
catgcaaagcaagct

SEQ ID NO: 4925 - DNA, 15 bp, Homo sapiens
gcatgcaaagcaagc

SEQ ID NO: 4926 - DNA, 15 bp, Homo sapiens
ggcatgcaaagcaag

SEQ ID NO: 4927 - DNA, 15 bp, Homo sapiens
tggcatgcaaagcaa

SEQ ID NO: 4928 - DNA, 15 bp, Homo sapiens
atggcatgcaaagca

SEQ ID NO: 4929 - DNA, 15 bp, Homo sapiens
aatggcatgcaaagc

SEQ ID NO: 4930 - DNA, 15 bp, Homo sapiens
caatggcatgcaaag

SEQ ID NO: 4931 - DNA, 15 bp, Homo sapiens
gcaatggcatgcaaa

SEQ ID NO: 4932 - DNA, 15 bp, Homo sapiens
agcaatggcatgcaa

SEQ ID NO: 4933 - DNA, 15 bp, Homo sapiens
aagcaatggcatgca

SEQ ID NO: 4934 - DNA, 15 bp, Homo sapiens
taagcaatggcatgc

SEQ ID NO: 4935 - DNA, 15 bp, Homo sapiens
ttaagcaatggcatg

SEQ ID NO: 4936 - DNA, 15 bp, Homo sapiens
tttaagcaatggcat

SEQ ID NO: 4937 - DNA, 15 bp, Homo sapiens
atttaagcaatggca

SEQ ID NO: 4938 - DNA, 15 bp, Homo sapiens
tatttaagcaatggc

SEQ ID NO: 4939 - DNA, 15 bp, Homo sapiens
gtatttaagcaatgg

SEQ ID NO: 4940 - DNA, 15 bp, Homo sapiens
agtatttaagcaatg

SEQ ID NO: 4941 - DNA, 15 bp, Homo sapiens
aagtatttaagcaat

SEQ ID NO: 4942 - DNA, 15 bp, Homo sapiens
aaagtatttaagcaa

SEQ ID NO: 4943 - DNA, 15 bp, Homo sapiens
caaagtatttaagca

SEQ ID NO: 4944 - DNA, 15 bp, Homo sapiens
tcaaagtatttaagc

SEQ ID NO: 4945 - DNA, 15 bp, Homo sapiens
atcaaagtatttaag

SEQ ID NO: 4946 - DNA, 15 bp, Homo sapiens
catcaaagtatttaa

SEQ ID NO: 4947 - DNA, 15 bp, Homo sapiens
ccatcaaagtattta

SEQ ID NO: 4948 - DNA, 15 bp, Homo sapiens
accatcaaagtattt

SEQ ID NO: 4949 - DNA, 15 bp, Homo sapiens
taccatcaaagtatt

SEQ ID NO: 4950 - DNA, 15 bp, Homo sapiens
ataccatcaaagtat

SEQ ID NO: 4951 - DNA, 15 bp, Homo sapiens
cataccatcaaagta

SEQ ID NO: 4952 - DNA, 15 bp, Homo sapiens
acataccatcaaagt

SEQ ID NO: 4953 - DNA, 15 bp, Homo sapiens
tacataccatcaaag

SEQ ID NO: 4954 - DNA, 15 bp, Homo sapiens
atacataccatcaaa

SEQ ID NO: 4955 - DNA, 15 bp, Homo sapiens
catacataccatcaa

SEQ ID NO: 4956 - DNA, 15 bp, Homo sapiens
ccatacataccatca

SEQ ID NO: 4957 - DNA, 15 bp, Homo sapiens
accatacataccatc

SEQ ID NO: 4958 - DNA, 15 bp, Homo sapiens
taccatacataccat

SEQ ID NO: 4959 - DNA, 15 bp, Homo sapiens
ataccatacatacca

SEQ ID NO: 4960 - DNA, 15 bp, Homo sapiens
cataccatacatacc

SEQ ID NO: 4961 - DNA, 15 bp, Homo sapiens
acataccatacatac

SEQ ID NO: 4962 - DNA, 15 bp, Homo sapiens
cacataccatacata

SEQ ID NO: 4963 - DNA, 15 bp, Homo sapiens
ccacataccatacat

SEQ ID NO: 4964 - DNA, 15 bp, Homo sapiens
cccacataccataca

SEQ ID NO: 4965 - DNA, 15 bp, Homo sapiens
tcccacataccatac

SEQ ID NO: 4966 - DNA, 15 bp, Homo sapiens
atcccacataccata

SEQ ID NO: 4967 - DNA, 15 bp, Homo sapiens
tatcccacataccat

SEQ ID NO: 4968 - DNA, 15 bp, Homo sapiens
ttatcccacatacca

SEQ ID NO: 4969 - DNA, 15 bp, Homo sapiens
gttatcccacatacc

SEQ ID NO: 4970 - DNA, 15 bp, Homo sapiens
agttatcccacatac

SEQ ID NO: 4971 - DNA, 15 bp, Homo sapiens
cagttatcccacata

SEQ ID NO: 4972 - DNA, 15 bp, Homo sapiens
tcagttatcccacat

SEQ ID NO: 4973 - DNA, 15 bp, Homo sapiens
ctcagttatcccaca

SEQ ID NO: 4974 - DNA, 15 bp, Homo sapiens
actcagttatcccac

SEQ ID NO: 4975 - DNA, 15 bp, Homo sapiens
cactcagttatccca

SEQ ID NO: 4976 - DNA, 15 bp, Homo sapiens
ccactcagttatccc

SEQ ID NO: 4977 - DNA, 15 bp, Homo sapiens
cccactcagttatcc

SEQ ID NO: 4978 - DNA, 15 bp, Homo sapiens
tcccactcagttatc

SEQ ID NO: 4979 - DNA, 15 bp, Homo sapiens
ctcccactcagttat

SEQ ID NO: 4980 - DNA, 15 bp, Homo sapiens
gctcccactcagtta

SEQ ID NO: 4981 - DNA, 15 bp, Homo sapiens
ggctcccactcagtt

SEQ ID NO: 4982 - DNA, 15 bp, Homo sapiens
cggctcccactcagt

SEQ ID NO: 4983 - DNA, 15 bp, Homo sapiens
ccggctcccactcag

SEQ ID NO: 4984 - DNA, 15 bp, Homo sapiens
tccggctcccactca

SEQ ID NO: 4985 - DNA, 15 bp, Homo sapiens
ttccggctcccactc

SEQ ID NO: 4986 - DNA, 15 bp, Homo sapiens
attccggctcccact

SEQ ID NO: 4987 - DNA, 15 bp, Homo sapiens
aattccggctcccac

SEQ ID NO: 4988 - DNA, 15 bp, Homo sapiens
caattccggctccca

SEQ ID NO: 4989 - DNA, 15 bp, Homo sapiens
ccaattccggctccc

SEQ ID NO: 4990 - DNA, 15 bp, Homo sapiens
cccaattccggctcc

SEQ ID NO: 4991 - DNA, 15 bp, Homo sapiens
ccccaattccggctc

SEQ ID NO: 4992 - DNA, 15 bp, Homo sapiens
cccccaattccggct

SEQ ID NO: 4993 - DNA, 15 bp, Homo sapiens
ccccccaattccggc

SEQ ID NO: 4994 - DNA, 15 bp, Homo sapiens
accccccaattccgg

SEQ ID NO: 4995 - DNA, 15 bp, Homo sapiens
caccccccaattccg

SEQ ID NO: 4996 - DNA, 15 bp, Homo sapiens
ccaccccccaattcc

SEQ ID NO: 4997 - DNA, 15 bp, Homo sapiens
cccaccccccaattc

SEQ ID NO: 4998 - DNA, 15 bp, Homo sapiens
gcccaccccccaatt

SEQ ID NO: 4999 - DNA, 15 bp, Homo sapiens
tgcccaccccccaat

SEQ ID NO: 5000 - DNA, 15 bp, Homo sapiens
ctgcccaccccccaa

SEQ ID NO: 5001 - DNA, 15 bp, Homo sapiens
cctgcccacccccca

SEQ ID NO: 5002 - DNA, 15 bp, Homo sapiens
ccctgcccacccccc

SEQ ID NO: 5003 - DNA, 15 bp, Homo sapiens
gccctgcccaccccc

SEQ ID NO: 5004 - DNA, 15 bp, Homo sapiens
tgccctgcccacccc

SEQ ID NO: 5005 - DNA, 15 bp, Homo sapiens
atgccctgcccaccc

SEQ ID NO: 5006 - DNA, 15 bp, Homo sapiens
gatgccctgcccacc

SEQ ID NO: 5007 - DNA, 15 bp, Homo sapiens
ggatgccctgcccac

SEQ ID NO: 5008 - DNA, 15 bp, Homo sapiens
gggatgccctgccca

SEQ ID NO: 5009 - DNA, 15 bp, Homo sapiens
ggggatgccctgccc

SEQ ID NO: 5010 - DNA, 15 bp, Homo sapiens
tggggatgccctgcc

SEQ ID NO: 5011 - DNA, 15 bp, Homo sapiens
gtggggatgccctgc

SEQ ID NO: 5012 - DNA, 15 bp, Homo sapiens
ggtggggatgccctg

SEQ ID NO: 5013 - DNA, 15 bp, Homo sapiens
gggtggggatgccct

SEQ ID NO: 5014 - DNA, 15 bp, Homo sapiens
ggggtggggatgccc

SEQ ID NO: 5015 - DNA, 15 bp, Homo sapiens
gggggtggggatgcc

SEQ ID NO: 5016 - DNA, 15 bp, Homo sapiens
tgggggtggggatgc

SEQ ID NO: 5017 - DNA, 15 bp, Homo sapiens
gtgggggtggggatg

SEQ ID NO: 5018 - DNA, 15 bp, Homo sapiens
ggtgggggtggggat

SEQ ID NO: 5019 - DNA, 15 bp, Homo sapiens
gggtgggggtgggga

SEQ ID NO: 5020 - DNA, 15 bp, Homo sapiens
ggggtgggggtgggg

SEQ ID NO: 5021 - DNA, 15 bp, Homo sapiens
gggggtgggggtggg

SEQ ID NO: 5022 - DNA, 15 bp, Homo sapiens
tgggggtgggggtgg

SEQ ID NO: 5023 - DNA, 15 bp, Homo sapiens
gtgggggtgggggtg

SEQ ID NO: 5024 - DNA, 15 bp, Homo sapiens
tgtgggggtgggggt

SEQ ID NO: 5025 - DNA, 15 bp, Homo sapiens
atgtgggggtggggg

SEQ ID NO: 5026 - DNA, 15 bp, Homo sapiens
gatgtgggggtgggg

SEQ ID NO: 5027 - DNA, 15 bp, Homo sapiens
tgatgtgggggtggg

SEQ ID NO: 5028 - DNA, 15 bp, Homo sapiens
ttgatgtgggggtgg

SEQ ID NO: 5029 - DNA, 15 bp, Homo sapiens
tttgatgtgggggtg

SEQ ID NO: 5030 - DNA, 15 bp, Homo sapiens
ctttgatgtgggggt

SEQ ID NO: 5031 - DNA, 15 bp, Homo sapiens
cctttgatgtggggg

SEQ ID NO: 5032 - DNA, 15 bp, Homo sapiens
ccctttgatgtgggg

SEQ ID NO: 5033 - DNA, 15 bp, Homo sapiens
cccctttgatgtggg

SEQ ID NO: 5034 - DNA, 15 bp, Homo sapiens
ccccctttgatgtgg

SEQ ID NO: 5035 - DNA, 15 bp, Homo sapiens
tccccctttgatgtg

SEQ ID NO: 5036 - DNA, 15 bp, Homo sapiens
ttccccctttgatgt

SEQ ID NO: 5037 - DNA, 15 bp, Homo sapiens
attccccctttgatg

SEQ ID NO: 5038 - DNA, 15 bp, Homo sapiens
cattccccctttgat

SEQ ID NO: 5039 - DNA, 15 bp, Homo sapiens
tcattccccctttga

SEQ ID NO: 5040 - DNA, 15 bp, Homo sapiens
gtcattccccctttg

SEQ ID NO: 5041 - DNA, 15 bp, Homo sapiens
ggtcattcccccttt

SEQ ID NO: 5042 - DNA, 15 bp, Homo sapiens
tggtcattccccctt

SEQ ID NO: 5043 - DNA, 15 bp, Homo sapiens
atggtcattccccct

SEQ ID NO: 5044 - DNA, 15 bp, Homo sapiens
aatggtcattccccc

SEQ ID NO: 5045 - DNA, 15 bp, Homo sapiens
aaatggtcattcccc

SEQ ID NO: 5046 - DNA, 15 bp, Homo sapiens
gaaatggtcattccc

SEQ ID NO: 5047 - DNA, 15 bp, Homo sapiens
cgaaatggtcattcc

SEQ ID NO: 5048 - DNA, 15 bp, Homo sapiens
acgaaatggtcattc

SEQ ID NO: 5049 - DNA, 15 bp, Homo sapiens
aacgaaatggtcatt

SEQ ID NO: 5050 - DNA, 15 bp, Homo sapiens
taacgaaatggtcat

SEQ ID NO: 5051 - DNA, 15 bp, Homo sapiens
ctaacgaaatggtca

SEQ ID NO: 5052 - DNA, 15 bp, Homo sapiens
tctaacgaaatggtc

SEQ ID NO: 5053 - DNA, 15 bp, Homo sapiens
ctctaacgaaatggt

SEQ ID NO: 5054 - DNA, 15 bp, Homo sapiens
tctctaacgaaatgg

SEQ ID NO: 5055 - DNA, 15 bp, Homo sapiens
ttctctaacgaaatg

SEQ ID NO: 5056 - DNA, 15 bp, Homo sapiens
attctctaacgaaat

SEQ ID NO: 5057 - DNA, 15 bp, Homo sapiens
tattctctaacgaaa

SEQ ID NO: 5058 - DNA, 15 bp, Homo sapiens
ttattctctaacgaa

SEQ ID NO: 5059 - DNA, 15 bp, Homo sapiens
tttattctctaacga

SEQ ID NO: 5060 - DNA, 15 bp, Homo sapiens
ctttattctctaacg

SEQ ID NO: 5061 - DNA, 15 bp, Homo sapiens
gctttattctctaac

SEQ ID NO: 5062 - DNA, 15 bp, Homo sapiens
ggctttattctctaa

SEQ ID NO: 5063 - DNA, 15 bp, Homo sapiens
aggctttattctcta

SEQ ID NO: 5064 - DNA, 15 bp, Homo sapiens
caggctttattctct

SEQ ID NO: 5065 - DNA, 15 bp, Homo sapiens
tcaggctttattctc

SEQ ID NO: 5066 - DNA, 15 bp, Homo sapiens
ctcaggctttattct

SEQ ID NO: 5067 - DNA, 15 bp, Homo sapiens
actcaggctttattc

SEQ ID NO: 5068 - DNA, 15 bp, Homo sapiens
gactcaggctttatt

SEQ ID NO: 5069 - DNA, 15 bp, Homo sapiens
agactcaggctttat

SEQ ID NO: 5070 - DNA, 15 bp, Homo sapiens
aagactcaggcttta

SEQ ID NO: 5071 - DNA, 15 bp, Homo sapiens
taagactcaggcttt

SEQ ID NO: 5072 - DNA, 15 bp, Homo sapiens
ataagactcaggctt

SEQ ID NO: 5073 - DNA, 15 bp, Homo sapiens
tataagactcaggct

SEQ ID NO: 5074 - DNA, 15 bp, Homo sapiens
ttataagactcaggc

SEQ ID NO: 5075 - DNA, 15 bp, Homo sapiens
gttataagactcagg

SEQ ID NO: 5076 - DNA, 15 bp, Homo sapiens
agttataagactcag

SEQ ID NO: 5077 - DNA, 15 bp, Homo sapiens
aagttataagactca

SEQ ID NO: 5078 - DNA, 15 bp, Homo sapiens
gaagttataagactc

SEQ ID NO: 5079 - DNA, 15 bp, Homo sapiens
agaagttataagact

SEQ ID NO: 5080 - DNA, 15 bp, Homo sapiens
aagaagttataagac

SEQ ID NO: 5081 - DNA, 15 bp, Homo sapiens
gaagaagttataaga

SEQ ID NO: 5082 - DNA, 15 bp, Homo sapiens
tgaagaagttataag

SEQ ID NO: 5083 - DNA, 15 bp, Homo sapiens
ttgaagaagttataa

SEQ ID NO: 5084 - DNA, 15 bp, Homo sapiens
cttgaagaagttata

SEQ ID NO: 5085 - DNA, 15 bp, Homo sapiens
gcttgaagaagttat

SEQ ID NO: 5086 - DNA, 15 bp, Homo sapiens
tgcttgaagaagtta

SEQ ID NO: 5087 - DNA, 15 bp, Homo sapiens
gtgcttgaagaagtt

SEQ ID NO: 5088 - DNA, 15 bp, Homo sapiens
tgtgcttgaagaagt

SEQ ID NO: 5089 - DNA, 15 bp, Homo sapiens
atgtgcttgaagaag

SEQ ID NO: 5090 - DNA, 15 bp, Homo sapiens
catgtgcttgaagaa

SEQ ID NO: 5091 - DNA, 15 bp, Homo sapiens
acatgtgcttgaaga

SEQ ID NO: 5092 - DNA, 15 bp, Homo sapiens
tacatgtgcttgaag

SEQ ID NO: 5093 - DNA, 15 bp, Homo sapiens
atacatgtgcttgaa

SEQ ID NO: 5094 - DNA, 15 bp, Homo sapiens
catacatgtgcttga

SEQ ID NO: 5095 - DNA, 15 bp, Homo sapiens
gcatacatgtgcttg

SEQ ID NO: 5096 - DNA, 15 bp, Homo sapiens
agcatacatgtgctt

SEQ ID NO: 5097 - DNA, 15 bp, Homo sapiens
cagcatacatgtgct

SEQ ID NO: 5098 - DNA, 15 bp, Homo sapiens
ccagcatacatgtgc

SEQ ID NO: 5099 - DNA, 15 bp, Homo sapiens
cccagcatacatgtg

SEQ ID NO: 5100 - DNA, 15 bp, Homo sapiens
acccagcatacatgt

SEQ ID NO: 5101 - DNA, 15 bp, Homo sapiens
gacccagcatacatg

SEQ ID NO: 5102 - DNA, 15 bp, Homo sapiens
agacccagcatacat

SEQ ID NO: 5103 - DNA, 15 bp, Homo sapiens
gagacccagcataca

SEQ ID NO: 5104 - DNA, 15 bp, Homo sapiens
ggagacccagcatac

SEQ ID NO: 5105 - DNA, 15 bp, Homo sapiens
aggagacccagcata

SEQ ID NO: 5106 - DNA, 15 bp, Homo sapiens
caggagacccagcat

SEQ ID NO: 5107 - DNA, 15 bp, Homo sapiens
ccaggagacccagca

SEQ ID NO: 5108 - DNA, 15 bp, Homo sapiens
gccaggagacccagc

SEQ ID NO: 5109 - DNA, 15 bp, Homo sapiens
cgccaggagacccag

SEQ ID NO: 5110 - DNA, 15 bp, Homo sapiens
acgccaggagaccca

SEQ ID NO: 5111 - DNA, 15 bp, Homo sapiens
cacgccaggagaccc

SEQ ID NO: 5112 - DNA, 15 bp, Homo sapiens
acacgccaggagacc

SEQ ID NO: 5113 - DNA, 15 bp, Homo sapiens
cacacgccaggagac

SEQ ID NO: 5114 - DNA, 15 bp, Homo sapiens
tcacacgccaggaga

SEQ ID NO: 5115 - DNA, 15 bp, Homo sapiens
ttcacacgccaggag

SEQ ID NO: 5116 - DNA, 15 bp, Homo sapiens
attcacacgccagga

SEQ ID NO: 5117 - DNA, 15 bp, Homo sapiens
cattcacacgccagg

SEQ ID NO: 5118 - DNA, 15 bp, Homo sapiens
acattcacacgccag

SEQ ID NO: 5119 - DNA, 15 bp, Homo sapiens
cacattcacacgcca

SEQ ID NO: 5120 - DNA, 15 bp, Homo sapiens
acacattcacacgcc

SEQ ID NO: 5121 - DNA, 15 bp, Homo sapiens
aacacattcacacgc

SEQ ID NO: 5122 - DNA, 15 bp, Homo sapiens
gaacacattcacacg

SEQ ID NO: 5123 - DNA, 15 bp, Homo sapiens
ggaacacattcacac

SEQ ID NO: 5124 - DNA, 15 bp, Homo sapiens
gggaacacattcaca

SEQ ID NO: 5125 - DNA, 15 bp, Homo sapiens
cgggaacacattcac

SEQ ID NO: 5126 - DNA, 15 bp, Homo sapiens
gcgggaacacattca

SEQ ID NO: 5127 - DNA, 15 bp, Homo sapiens
agcgggaacacattc

SEQ ID NO: 5128 - DNA, 15 bp, Homo sapiens
cagcgggaacacatt

SEQ ID NO: 5129 - DNA, 15 bp, Homo sapiens
acagcgggaacacat

SEQ ID NO: 5130 - DNA, 15 bp, Homo sapiens
cacagcgggaacaca

SEQ ID NO: 5131 - DNA, 15 bp, Homo sapiens
gcacagcgggaacac

SEQ ID NO: 5132 - DNA, 15 bp, Homo sapiens
agcacagcgggaaca

SEQ ID NO: 5133 - DNA, 15 bp, Homo sapiens
cagcacagcgggaac

SEQ ID NO: 5134 - DNA, 15 bp, Homo sapiens
acagcacagcgggaa

SEQ ID NO: 5135 - DNA, 15 bp, Homo sapiens
cacagcacagcggga

SEQ ID NO: 5136 - DNA, 15 bp, Homo sapiens
acacagcacagcggg

SEQ ID NO: 5137 - DNA, 15 bp, Homo sapiens
cacacagcacagcgg

SEQ ID NO: 5138 - DNA, 15 bp, Homo sapiens
ccacacagcacagcg

SEQ ID NO: 5139 - DNA, 15 bp, Homo sapiens
gccacacagcacagc

SEQ ID NO: 5140 - DNA, 15 bp, Homo sapiens
agccacacagcacag

SEQ ID NO: 5141 - DNA, 15 bp, Homo sapiens
cagccacacagcaca

SEQ ID NO: 5142 - DNA, 15 bp, Homo sapiens
acagccacacagcac

SEQ ID NO: 5143 - DNA, 15 bp, Homo sapiens
aacagccacacagca

SEQ ID NO: 5144 - DNA, 15 bp, Homo sapiens
aaacagccacacagc

SEQ ID NO: 5145 - DNA, 15 bp, Homo sapiens
aaaacagccacacag

SEQ ID NO: 5146 - DNA, 15 bp, Homo sapiens
caaaacagccacaca

SEQ ID NO: 5147 - DNA, 15 bp, Homo sapiens
gcaaaacagccacac

SEQ ID NO: 5148 - DNA, 15 bp, Homo sapiens
tgcaaaacagccaca

SEQ ID NO: 5149 - DNA, 15 bp, Homo sapiens
ctgcaaaacagccac

SEQ ID NO: 5150 - DNA, 15 bp, Homo sapiens
actgcaaaacagcca

SEQ ID NO: 5151 - DNA, 15 bp, Homo sapiens
aactgcaaaacagcc

SEQ ID NO: 5152 - DNA, 15 bp, Homo sapiens
taactgcaaaacagc

SEQ ID NO: 5153 - DNA, 15 bp, Homo sapiens
gtaactgcaaaacag

SEQ ID NO: 5154 - DNA, 15 bp, Homo sapiens
agtaactgcaaaaca

SEQ ID NO: 5155 - DNA, 15 bp, Homo sapiens
cagtaactgcaaaac

SEQ ID NO: 5156 - DNA, 15 bp, Homo sapiens
acagtaactgcaaaa

SEQ ID NO: 5157 - DNA, 15 bp, Homo sapiens
tacagtaactgcaaa

SEQ ID NO: 5158 - DNA, 15 bp, Homo sapiens
ctacagtaactgcaa

SEQ ID NO: 5159 - DNA, 15 bp, Homo sapiens
tctacagtaactgca

SEQ ID NO: 5160 - DNA, 15 bp, Homo sapiens
gtctacagtaactgc

SEQ ID NO: 5161 - DNA, 15 bp, Homo sapiens
tgtctacagtaactg

SEQ ID NO: 5162 - DNA, 15 bp, Homo sapiens
gtgtctacagtaact

SEQ ID NO: 5163 - DNA, 15 bp, Homo sapiens
agtgtctacagtaac

SEQ ID NO: 5164 - DNA, 15 bp, Homo sapiens
cagtgtctacagtaa

SEQ ID NO: 5165 - DNA, 15 bp, Homo sapiens
acagtgtctacagta

SEQ ID NO: 5166 - DNA, 15 bp, Homo sapiens
tacagtgtctacagt

SEQ ID NO: 5167 - DNA, 15 bp, Homo sapiens
ctacagtgtctacag

SEQ ID NO: 5168 - DNA, 15 bp, Homo sapiens
actacagtgtctaca

SEQ ID NO: 5169 - DNA, 15 bp, Homo sapiens
gactacagtgtctac

SEQ ID NO: 5170 - DNA, 15 bp, Homo sapiens
agactacagtgtcta

SEQ ID NO: 5171 - DNA, 15 bp, Homo sapiens
cagactacagtgtct

SEQ ID NO: 5172 - DNA, 15 bp, Homo sapiens
ccagactacagtgtc

SEQ ID NO: 5173 - DNA, 15 bp, Homo sapiens
cccagactacagtgt

SEQ ID NO: 5174 - DNA, 15 bp, Homo sapiens
gcccagactacagtg

SEQ ID NO: 5175 - DNA, 15 bp, Homo sapiens
agcccagactacagt

SEQ ID NO: 5176 - DNA, 15 bp, Homo sapiens
gagcccagactacag

SEQ ID NO: 5177 - DNA, 15 bp, Homo sapiens
agagcccagactaca

SEQ ID NO: 5178 - DNA, 15 bp, Homo sapiens
gagagcccagactac

SEQ ID NO: 5179 - DNA, 15 bp, Homo sapiens
tgagagcccagacta

SEQ ID NO: 5180 - DNA, 15 bp, Homo sapiens
atgagagcccagact

SEQ ID NO: 5181 - DNA, 15 bp, Homo sapiens
aatgagagcccagac

SEQ ID NO: 5182 - DNA, 15 bp, Homo sapiens
taatgagagcccaga

SEQ ID NO: 5183 - DNA, 15 bp, Homo sapiens
ataatgagagcccag

SEQ ID NO: 5184 - DNA, 15 bp, Homo sapiens
aataatgagagccca

SEQ ID NO: 5185 - DNA, 15 bp, Homo sapiens
caataatgagagccc

SEQ ID NO: 5186 - DNA, 15 bp, Homo sapiens
gcaataatgagagcc

SEQ ID NO: 5187 - DNA, 15 bp, Homo sapiens
ggcaataatgagagc

SEQ ID NO: 5188 - DNA, 15 bp, Homo sapiens
aggcaataatgagag

SEQ ID NO: 5189 - DNA, 15 bp, Homo sapiens
gaggcaataatgaga

SEQ ID NO: 5190 - DNA, 15 bp, Homo sapiens
agaggcaataatgag

SEQ ID NO: 5191 - DNA, 15 bp, Homo sapiens
cagaggcaataatga

SEQ ID NO: 5192 - DNA, 15 bp, Homo sapiens
tcagaggcaataatg

SEQ ID NO: 5193 - DNA, 15 bp, Homo sapiens
ttcagaggcaataat

SEQ ID NO: 5194 - DNA, 15 bp, Homo sapiens
cttcagaggcaataa

SEQ ID NO: 5195 - DNA, 15 bp, Homo sapiens
acttcagaggcaata

SEQ ID NO: 5196 - DNA, 15 bp, Homo sapiens
aacttcagaggcaat

SEQ ID NO: 5197 - DNA, 15 bp, Homo sapiens
caacttcagaggcaa

SEQ ID NO: 5198 - DNA, 15 bp, Homo sapiens
tcaacttcagaggca

SEQ ID NO: 5199 - DNA, 15 bp, Homo sapiens
gtcaacttcagaggc

SEQ ID NO: 5200 - DNA, 15 bp, Homo sapiens
tgtcaacttcagagg

SEQ ID NO: 5201 - DNA, 15 bp, Homo sapiens
ctgtcaacttcagag

SEQ ID NO: 5202 - DNA, 15 bp, Homo sapiens
cctgtcaacttcaga

SEQ ID NO: 5203 - DNA, 15 bp, Homo sapiens
tcctgtcaacttcag

SEQ ID NO: 5204 - DNA, 15 bp, Homo sapiens
gtcctgtcaacttca

SEQ ID NO: 5205 - DNA, 15 bp, Homo sapiens
ggtcctgtcaacttc

SEQ ID NO: 5206 - DNA, 15 bp, Homo sapiens
tggtcctgtcaactt

SEQ ID NO: 5207 - DNA, 15 bp, Homo sapiens
ttggtcctgtcaact

SEQ ID NO: 5208 - DNA, 15 bp, Homo sapiens
cttggtcctgtcaac

SEQ ID NO: 5209 - DNA, 15 bp, Homo sapiens
gcttggtcctgtcaa

SEQ ID NO: 5210 - DNA, 15 bp, Homo sapiens
ggcttggtcctgtca

SEQ ID NO: 5211 - DNA, 15 bp, Homo sapiens
aggcttggtcctgtc

SEQ ID NO: 5212 - DNA, 15 bp, Homo sapiens
aaggcttggtcctgt

SEQ ID NO: 5213 - DNA, 15 bp, Homo sapiens
taaggcttggtcctg

SEQ ID NO: 5214 - DNA, 15 bp, Homo sapiens
ctaaggcttggtcct

SEQ ID NO: 5215 - DNA, 15 bp, Homo sapiens
actaaggcttggtcc

SEQ ID NO: 5216 - DNA, 15 bp, Homo sapiens
tactaaggcttggtc

SEQ ID NO: 5217 - DNA, 15 bp, Homo sapiens
ttactaaggcttggt

SEQ ID NO: 5218 - DNA, 15 bp, Homo sapiens
cttactaaggcttgg

SEQ ID NO: 5219 - DNA, 15 bp, Homo sapiens
ccttactaaggcttg

SEQ ID NO: 5220 - DNA, 15 bp, Homo sapiens
tccttactaaggctt

SEQ ID NO: 5221 - DNA, 15 bp, Homo sapiens
atccttactaaggct

SEQ ID NO: 5222 - DNA, 15 bp, Homo sapiens
catccttactaaggc

SEQ ID NO: 5223 - DNA, 15 bp, Homo sapiens
gcatccttactaagg

SEQ ID NO: 5224 - DNA, 15 bp, Homo sapiens
tgcatccttactaag

SEQ ID NO: 5225 - DNA, 15 bp, Homo sapiens
gtgcatccttactaa

SEQ ID NO: 5226 - DNA, 15 bp, Homo sapiens
agtgcatccttacta

SEQ ID NO: 5227 - DNA, 15 bp, Homo sapiens
aagtgcatccttact

SEQ ID NO: 5228 - DNA, 15 bp, Homo sapiens
caagtgcatccttac

SEQ ID NO: 5229 - DNA, 15 bp, Homo sapiens
acaagtgcatcctta

SEQ ID NO: 5230 - DNA, 15 bp, Homo sapiens
gacaagtgcatcctt

SEQ ID NO: 5231 - DNA, 15 bp, Homo sapiens
agacaagtgcatcct

SEQ ID NO: 5232 - DNA, 15 bp, Homo sapiens
aagacaagtgcatcc

SEQ ID NO: 5233 - DNA, 15 bp, Homo sapiens
gaagacaagtgcatc

SEQ ID NO: 5234 - DNA, 15 bp, Homo sapiens
ggaagacaagtgcat

SEQ ID NO: 5235 - DNA, 15 bp, Homo sapiens
aggaagacaagtgca

SEQ ID NO: 5236 - DNA, 15 bp, Homo sapiens
taggaagacaagtgc

SEQ ID NO: 5237 - DNA, 15 bp, Homo sapiens
ctaggaagacaagtg

SEQ ID NO: 5238 - DNA, 15 bp, Homo sapiens
gctaggaagacaagt

SEQ ID NO: 5239 - DNA, 15 bp, Homo sapiens
ggctaggaagacaag

SEQ ID NO: 5240 - DNA, 15 bp, Homo sapiens
gggctaggaagacaa

SEQ ID NO: 5241 - DNA, 15 bp, Homo sapiens
tgggctaggaagaca

SEQ ID NO: 5242 - DNA, 15 bp, Homo sapiens
ttgggctaggaagac

SEQ ID NO: 5243 - DNA, 15 bp, Homo sapiens
cttgggctaggaaga

SEQ ID NO: 5244 - DNA, 15 bp, Homo sapiens
tcttgggctaggaag

SEQ ID NO: 5245 - DNA, 15 bp, Homo sapiens
ctcttgggctaggaa

SEQ ID NO: 5246 - DNA, 15 bp, Homo sapiens
gctcttgggctagga

SEQ ID NO: 5247 - DNA, 15 bp, Homo sapiens
agctcttgggctagg

SEQ ID NO: 5248 - DNA, 15 bp, Homo sapiens
tagctcttgggctag

SEQ ID NO: 5249 - DNA, 15 bp, Homo sapiens
ctagctcttgggcta

SEQ ID NO: 5250 - DNA, 15 bp, Homo sapiens
cctagctcttgggct

SEQ ID NO: 5251 - DNA, 15 bp, Homo sapiens
ccctagctcttgggc

SEQ ID NO: 5252 - DNA, 15 bp, Homo sapiens
cccctagctcttggg

SEQ ID NO: 5253 - DNA, 15 bp, Homo sapiens
acccctagctcttgg

SEQ ID NO: 5254 - DNA, 15 bp, Homo sapiens
cacccctagctcttg

SEQ ID NO: 5255 - DNA, 15 bp, Homo sapiens
acacccctagctctt

SEQ ID NO: 5256 - DNA, 15 bp, Homo sapiens
aacacccctagctct

SEQ ID NO: 5257 - DNA, 15 bp, Homo sapiens
aaacacccctagctc

SEQ ID NO: 5258 - DNA, 15 bp, Homo sapiens
aaaacacccctagct

SEQ ID NO: 5259 - DNA, 15 bp, Homo sapiens
taaaacacccctagc

SEQ ID NO: 5260 - DNA, 15 bp, Homo sapiens
ataaaacacccctag

SEQ ID NO: 5261 - DNA, 15 bp, Homo sapiens
tataaaacaccccta

SEQ ID NO: 5262 - DNA, 15 bp, Homo sapiens
atataaaacacccct

SEQ ID NO: 5263 - DNA, 15 bp, Homo sapiens
tatataaaacacccc

SEQ ID NO: 5264 - DNA, 15 bp, Homo sapiens
atatataaaacaccc

SEQ ID NO: 5265 - DNA, 15 bp, Homo sapiens
tatatataaaacacc

SEQ ID NO: 5266 - DNA, 15 bp, Homo sapiens
atatatataaaacac

SEQ ID NO: 5267 - DNA, 15 bp, Homo sapiens
tatatatataaaaca

SEQ ID NO: 5268 - DNA, 15 bp, Homo sapiens
atatatatataaaac

SEQ ID NO: 5269 - DNA, 15 bp, Homo sapiens
aatatatatataaaa

SEQ ID NO: 5270 - DNA, 15 bp, Homo sapiens
taatatatatataaa

SEQ ID NO: 5271 - DNA, 15 bp, Homo sapiens
ttaatatatatataa

SEQ ID NO: 5272 - DNA, 15 bp, Homo sapiens
gttaatatatatata

SEQ ID NO: 5273 - DNA, 15 bp, Homo sapiens
agttaatatatatat

SEQ ID NO: 5274 - DNA, 15 bp, Homo sapiens
aagttaatatatata

SEQ ID NO: 5275 - DNA, 15 bp, Homo sapiens
aaagttaatatatat

SEQ ID NO: 5276 - DNA, 15 bp, Homo sapiens
gaaagttaatatata

SEQ ID NO: 5277 - DNA, 15 bp, Homo sapiens
agaaagttaatatat

SEQ ID NO: 5278 - DNA, 15 bp, Homo sapiens
aagaaagttaatata

SEQ ID NO: 5279 - DNA, 15 bp, Homo sapiens
aaagaaagttaatat

SEQ ID NO: 5280 - DNA, 15 bp, Homo sapiens
aaaagaaagttaata

SEQ ID NO: 5281 - DNA, 15 bp, Homo sapiens
aaaaagaaagttaat

SEQ ID NO: 5282 - DNA, 15 bp, Homo sapiens
aaaaaagaaagttaa

SEQ ID NO: 5283 - DNA, 15 bp, Homo sapiens
taaaaaagaaagtta

SEQ ID NO: 5284 - DNA, 15 bp, Homo sapiens
ctaaaaaagaaagtt

SEQ ID NO: 5285 - DNA, 15 bp, Homo sapiens
tctaaaaaagaaagt

SEQ ID NO: 5286 - DNA, 15 bp, Homo sapiens
atctaaaaaagaaag

SEQ ID NO: 5287 - DNA, 15 bp, Homo sapiens
aatctaaaaaagaaa

SEQ ID NO: 5288 - DNA, 15 bp, Homo sapiens
aaatctaaaaaagaa

SEQ ID NO: 5289 - DNA, 15 bp, Homo sapiens
gaaatctaaaaaaga

SEQ ID NO: 5290 - DNA, 15 bp, Homo sapiens
tgaaatctaaaaaag

SEQ ID NO: 5291 - DNA, 15 bp, Homo sapiens
atgaaatctaaaaaa

SEQ ID NO: 5292 - DNA, 15 bp, Homo sapiens
tatgaaatctaaaaa

SEQ ID NO: 5293 - DNA, 15 bp, Homo sapiens
ttatgaaatctaaaa

SEQ ID NO: 5294 - DNA, 15 bp, Homo sapiens
tttatgaaatctaaa

SEQ ID NO: 5295 - DNA, 15 bp, Homo sapiens
gtttatgaaatctaa

SEQ ID NO: 5296 - DNA, 15 bp, Homo sapiens
agtttatgaaatcta

SEQ ID NO: 5297 - DNA, 15 bp, Homo sapiens
cagtttatgaaatct

SEQ ID NO: 5298 - DNA, 15 bp, Homo sapiens
gcagtttatgaaatc

SEQ ID NO: 5299 - DNA, 15 bp, Homo sapiens
agcagtttatgaaat

SEQ ID NO: 5300 - DNA, 15 bp, Homo sapiens
gagcagtttatgaaa

SEQ ID NO: 5301 - DNA, 15 bp, Homo sapiens
agagcagtttatgaa

SEQ ID NO: 5302 - DNA, 15 bp, Homo sapiens
gagagcagtttatga

SEQ ID NO: 5303 - DNA, 15 bp, Homo sapiens
tgagagcagtttatg

SEQ ID NO: 5304 - DNA, 15 bp, Homo sapiens
atgagagcagtttat

SEQ ID NO: 5305 - DNA, 15 bp, Homo sapiens
aatgagagcagttta

SEQ ID NO: 5306 - DNA, 15 bp, Homo sapiens
aaatgagagcagttt

SEQ ID NO: 5307 - DNA, 15 bp, Homo sapiens
aaaatgagagcagtt

SEQ ID NO: 5308 - DNA, 15 bp, Homo sapiens
gaaaatgagagcagt

SEQ ID NO: 5309 - DNA, 15 bp, Homo sapiens
agaaaatgagagcag

SEQ ID NO: 5310 - DNA, 15 bp, Homo sapiens
gagaaaatgagagca

SEQ ID NO: 5311 - DNA, 15 bp, Homo sapiens
agagaaaatgagagc

SEQ ID NO: 5312 - DNA, 15 bp, Homo sapiens
aagagaaaatgagag

SEQ ID NO: 5313 - DNA, 15 bp, Homo sapiens
aaagagaaaatgaga

SEQ ID NO: 5314 - DNA, 15 bp, Homo sapiens
aaaagagaaaatgag

SEQ ID NO: 5315 - DNA, 15 bp, Homo sapiens
gaaaagagaaaatga

SEQ ID NO: 5316 - DNA, 15 bp, Homo sapiens
agaaaagagaaaatg

SEQ ID NO: 5317 - DNA, 15 bp, Homo sapiens
aagaaaagagaaaat

SEQ ID NO: 5318 - DNA, 15 bp, Homo sapiens
aaagaaaagagaaaa

SEQ ID NO: 5319 - DNA, 15 bp, Homo sapiens
gaaagaaaagagaaa

SEQ ID NO: 5320 - DNA, 15 bp, Homo sapiens
agaaagaaaagagaa

SEQ ID NO: 5321 - DNA, 15 bp, Homo sapiens
aagaaagaaaagaga

SEQ ID NO: 5322 - DNA, 15 bp, Homo sapiens
aaagaaagaaaagag

SEQ ID NO: 5323 - DNA, 15 bp, Homo sapiens
gaaagaaagaaaaga

SEQ ID NO: 5324 - DNA, 15 bp, Homo sapiens
agaaagaaagaaaag

SEQ ID NO: 5325 - DNA, 15 bp, Homo sapiens
aagaaagaaagaaaa

SEQ ID NO: 5326 - DNA, 15 bp, Homo sapiens
aaagaaagaaagaaa

SEQ ID NO: 5327 - DNA, 15 bp, Homo sapiens
aaaagaaagaaagaa

SEQ ID NO: 5328 - DNA, 15 bp, Homo sapiens
aaaaagaaagaaaga

SEQ ID NO: 5329 - DNA, 15 bp, Homo sapiens
aaaaaagaaagaaag

SEQ ID NO: 5330 - DNA, 15 bp, Homo sapiens
aaaaaaagaaagaaa

SEQ ID NO: 5331 - DNA, 15 bp, Homo sapiens
aaaaaaaagaaagaa

SEQ ID NO: 5332 - DNA, 15 bp, Homo sapiens
aaaaaaaaagaaaga

SEQ ID NO: 5333 - DNA, 15 bp, Homo sapiens
actgtctcaaaaaaa

SEQ ID NO: 5334 - DNA, 15 bp, Homo sapiens
gactgtctcaaaaaa

SEQ ID NO: 5335 - DNA, 15 bp, Homo sapiens
agactgtctcaaaaa

SEQ ID NO: 5336 - DNA, 15 bp, Homo sapiens
gagactgtctcaaaa

SEQ ID NO: 5337 - DNA, 15 bp, Homo sapiens
tgagactgtctcaaa

SEQ ID NO: 5338 - DNA, 15 bp, Homo sapiens
gtgagactgtctcaa

SEQ ID NO: 5339 - DNA, 15 bp, Homo sapiens
agtgagactgtctca

SEQ ID NO: 5340 - DNA, 15 bp, Homo sapiens
gagtgagactgtctc

SEQ ID NO: 5341 - DNA, 15 bp, Homo sapiens
agagtgagactgtct

SEQ ID NO: 5342 - DNA, 15 bp, Homo sapiens
cagagtgagactgtc

SEQ ID NO: 5343 - DNA, 15 bp, Homo sapiens
acagagtgagactgt

SEQ ID NO: 5344 - DNA, 15 bp, Homo sapiens
gacagagtgagactg

SEQ ID NO: 5345 - DNA, 15 bp, Homo sapiens
tgacagagtgagact

SEQ ID NO: 5346 - DNA, 15 bp, Homo sapiens
atgggtgacagagtg

SEQ ID NO: 5347 - DNA, 15 bp, Homo sapiens
catgggtgacagagt

SEQ ID NO: 5348 - DNA, 15 bp, Homo sapiens
tccagcatgggtgac

SEQ ID NO: 5349 - DNA, 15 bp, Homo sapiens
ctccagcatgggtga

SEQ ID NO: 5350 - DNA, 15 bp, Homo sapiens
actccagcatgggtg

SEQ ID NO: 5351 - DNA, 15 bp, Homo sapiens
cactccagcatgggt

SEQ ID NO: 5352 - DNA, 15 bp, Homo sapiens
gcactccagcatggg

SEQ ID NO: 5353 - DNA, 15 bp, Homo sapiens
tgcactccagcatgg

SEQ ID NO: 5354 - DNA, 15 bp, Homo sapiens
ctgcactccagcatg

SEQ ID NO: 5355 - DNA, 15 bp, Homo sapiens
actgcactccagcat

SEQ ID NO: 5356 - DNA, 15 bp, Homo sapiens
cactgcactccagca

SEQ ID NO: 5357 - DNA, 15 bp, Homo sapiens
tgagatcgtgccact

SEQ ID NO: 5358 - DNA, 15 bp, Homo sapiens
ctgagatcgtgccac

SEQ ID NO: 5359 - DNA, 15 bp, Homo sapiens
gctgagatcgtgcca

SEQ ID NO: 5360 - DNA, 15 bp, Homo sapiens
agctgagatcgtgcc

SEQ ID NO: 5361 - DNA, 15 bp, Homo sapiens
gagctgagatcgtgc

SEQ ID NO: 5362 - DNA, 15 bp, Homo sapiens
tgagctgagatcgtg

SEQ ID NO: 5363 - DNA, 15 bp, Homo sapiens
gtgagctgagatcgt

SEQ ID NO: 5364 - DNA, 15 bp, Homo sapiens
agtgagctgagatcg

SEQ ID NO: 5365 - DNA, 15 bp, Homo sapiens
cagtgagctgagatc

SEQ ID NO: 5366 - DNA, 15 bp, Homo sapiens
gcagtgagctgagat

SEQ ID NO: 5367 - DNA, 15 bp, Homo sapiens
tgcagtgagctgaga

SEQ ID NO: 5368 - DNA, 15 bp, Homo sapiens
ttgcagtgagctgag

SEQ ID NO: 5369 - DNA, 15 bp, Homo sapiens
gttgcagtgagctga

SEQ ID NO: 5370 - DNA, 15 bp, Homo sapiens
ggttgcagtgagctg

SEQ ID NO: 5371 - DNA, 15 bp, Homo sapiens
aggttgcagtgagct

SEQ ID NO: 5372 - DNA, 15 bp, Homo sapiens
cgggaggcagaggtt

SEQ ID NO: 5373 - DNA, 15 bp, Homo sapiens
ccgggaggcagaggt

SEQ ID NO: 5374 - DNA, 15 bp, Homo sapiens
cccgggaggcagagg

SEQ ID NO: 5375 - DNA, 15 bp, Homo sapiens
gcccgggaggcagag

SEQ ID NO: 5376 - DNA, 15 bp, Homo sapiens
agcccgggaggcaga

SEQ ID NO: 5377 - DNA, 15 bp, Homo sapiens
gagcccgggaggcag

SEQ ID NO: 5378 - DNA, 15 bp, Homo sapiens
tgagcccgggaggca

SEQ ID NO: 5379 - DNA, 15 bp, Homo sapiens
ttgagcccgggaggc

SEQ ID NO: 5380 - DNA, 15 bp, Homo sapiens
cttgagcccgggagg

SEQ ID NO: 5381 - DNA, 15 bp, Homo sapiens
gcttgagcccgggag

SEQ ID NO: 5382 - DNA, 15 bp, Homo sapiens
tgcttgagcccggga

SEQ ID NO: 5383 - DNA, 15 bp, Homo sapiens
ctgcttgagcccggg

SEQ ID NO: 5384 - DNA, 15 bp, Homo sapiens
actgcttgagcccgg

SEQ ID NO: 5385 - DNA, 15 bp, Homo sapiens
aactgcttgagcccg

SEQ ID NO: 5386 - DNA, 15 bp, Homo sapiens
gaactgcttgagccc

SEQ ID NO: 5387 - DNA, 15 bp, Homo sapiens
agaactgcttgagcc

SEQ ID NO: 5388 - DNA, 15 bp, Homo sapiens
gagaactgcttgagc

SEQ ID NO: 5389 - DNA, 15 bp, Homo sapiens
agagaactgcttgag

SEQ ID NO: 5390 - DNA, 15 bp, Homo sapiens
cagagaactgcttga

SEQ ID NO: 5391 - DNA, 15 bp, Homo sapiens
gcagagaactgcttg

SEQ ID NO: 5392 - DNA, 15 bp, Homo sapiens
ggcagagaactgctt

SEQ ID NO: 5393 - DNA, 15 bp, Homo sapiens
aggcagagaactgct

SEQ ID NO: 5394 - DNA, 15 bp, Homo sapiens
gaggcagagaactgc

SEQ ID NO: 5395 - DNA, 15 bp, Homo sapiens
tgaggcagagaactg

SEQ ID NO: 5396 - DNA, 15 bp, Homo sapiens
ctgaggcagagaact

SEQ ID NO: 5397 - DNA, 15 bp, Homo sapiens
gctgaggcagagaac

SEQ ID NO: 5398 - DNA, 15 bp, Homo sapiens
ggctgaggcagagaa

SEQ ID NO: 5399 - DNA, 15 bp, Homo sapiens
aggctgaggcagaga

SEQ ID NO: 5400 - DNA, 15 bp, Homo sapiens
gaggctgaggcagag

SEQ ID NO: 5401 - DNA, 15 bp, Homo sapiens
ggaggctgaggcaga

SEQ ID NO: 5402 - DNA, 15 bp, Homo sapiens
acttgggaggctgag

SEQ ID NO: 5403 - DNA, 15 bp, Homo sapiens
tacttgggaggctga

SEQ ID NO: 5404 - DNA, 15 bp, Homo sapiens
ctacttgggaggctg

SEQ ID NO: 5405 - DNA, 15 bp, Homo sapiens
gctacttgggaggct

SEQ ID NO: 5406 - DNA, 15 bp, Homo sapiens
aggtgcctgtaatcc

SEQ ID NO: 5407 - DNA, 15 bp, Homo sapiens
caggtgcctgtaatc

SEQ ID NO: 5408 - DNA, 15 bp, Homo sapiens
gcaggtgcctgtaat

SEQ ID NO: 5409 - DNA, 15 bp, Homo sapiens
ggcaggtgcctgtaa

SEQ ID NO: 5410 - DNA, 15 bp, Homo sapiens
tggcaggtgcctgta

SEQ ID NO: 5411 - DNA, 15 bp, Homo sapiens
gtggcaggtgcctgt

SEQ ID NO: 5412 - DNA, 15 bp, Homo sapiens
ggtggcaggtgcctg

SEQ ID NO: 5413 - DNA, 15 bp, Homo sapiens
tggtggcaggtgcct

SEQ ID NO: 5414 - DNA, 15 bp, Homo sapiens
gtggtggcaggtgcc

SEQ ID NO: 5415 - DNA, 15 bp, Homo sapiens
cgtggtggcaggtgc

SEQ ID NO: 5416 - DNA, 15 bp, Homo sapiens
gcgtggtggcaggtg

SEQ ID NO: 5417 - DNA, 15 bp, Homo sapiens
ggcgtggtggcaggt

SEQ ID NO: 5418 - DNA, 15 bp, Homo sapiens
aggcgtggtggcagg

SEQ ID NO: 5419 - DNA, 15 bp, Homo sapiens
caggcgtggtggcag

SEQ ID NO: 5420 - DNA, 15 bp, Homo sapiens
ccaggcgtggtggca

SEQ ID NO: 5421 - DNA, 15 bp, Homo sapiens
gccaggcgtggtggc

SEQ ID NO: 5422 - DNA, 15 bp, Homo sapiens
agccaggcgtggtgg

SEQ ID NO: 5423 - DNA, 15 bp, Homo sapiens
tagccaggcgtggtg

SEQ ID NO: 5424 - DNA, 15 bp, Homo sapiens
ttagccaggcgtggt

SEQ ID NO: 5425 - DNA, 15 bp, Homo sapiens
attagccaggcgtgg

SEQ ID NO: 5426 - DNA, 15 bp, Homo sapiens
aattagccaggcgtg

SEQ ID NO: 5427 - DNA, 15 bp, Homo sapiens
aaattagccaggcgt

SEQ ID NO: 5428 - DNA, 15 bp, Homo sapiens
aaaattagccaggcg

SEQ ID NO: 5429 - DNA, 15 bp, Homo sapiens
caaaaattagccagg

SEQ ID NO: 5430 - DNA, 15 bp, Homo sapiens
acaaaaattagccag

SEQ ID NO: 5431 - DNA, 15 bp, Homo sapiens
tacaaaaattagcca

SEQ ID NO: 5432 - DNA, 15 bp, Homo sapiens
aaaaaatacaaaaat

SEQ ID NO: 5433 - DNA, 15 bp, Homo sapiens
aaaaaaatacaaaaa

SEQ ID NO: 5434 - DNA, 15 bp, Homo sapiens
aaaaaaaatacaaaa

SEQ ID NO: 5435 - DNA, 15 bp, Homo sapiens
aaaaaaaaatacaaa

SEQ ID NO: 5436 - DNA, 15 bp, Homo sapiens
aaaaaaaaaatacaa

SEQ ID NO: 5437 - DNA, 15 bp, Homo sapiens
aaaaaaaaaaataca

SEQ ID NO: 5438 - DNA, 15 bp, Homo sapiens
aaaaaaaaaaaatac

SEQ ID NO: 5439 - DNA, 15 bp, Homo sapiens
aaaaaaaaaaaaata

SEQ ID NO: 5440 - DNA, 15 bp, Homo sapiens
ctaaaaaaaaaaaaa

SEQ ID NO: 5441 - DNA, 15 bp, Homo sapiens
actaaaaaaaaaaaa

SEQ ID NO: 5442 - DNA, 15 bp, Homo sapiens
gactaaaaaaaaaaa

SEQ ID NO: 5443 - DNA, 15 bp, Homo sapiens
cgactaaaaaaaaaa

SEQ ID NO: 5444 - DNA, 15 bp, Homo sapiens
tcgactaaaaaaaaa

SEQ ID NO: 5445 - DNA, 15 bp, Homo sapiens
ctcgactaaaaaaaa

SEQ ID NO: 5446 - DNA, 15 bp, Homo sapiens
tctcgactaaaaaaa

SEQ ID NO: 5447 - DNA, 15 bp, Homo sapiens
gtctcgactaaaaaa

SEQ ID NO: 5448 - DNA, 15 bp, Homo sapiens
cgtctcgactaaaaa

SEQ ID NO: 5449 - DNA, 15 bp, Homo sapiens
ccgtctcgactaaaa

SEQ ID NO: 5450 - DNA, 15 bp, Homo sapiens
cccgtctcgactaaa

SEQ ID NO: 5451 - DNA, 15 bp, Homo sapiens
ccccgtctcgactaa

SEQ ID NO: 5452 - DNA, 15 bp, Homo sapiens
accccgtctcgacta

SEQ ID NO: 5453 - DNA, 15 bp, Homo sapiens
aaccccgtctcgact

SEQ ID NO: 5454 - DNA, 15 bp, Homo sapiens
aaaccccgtctcgac

SEQ ID NO: 5455 - DNA, 15 bp, Homo sapiens
gaaaccccgtctcga

SEQ ID NO: 5456 - DNA, 15 bp, Homo sapiens
tgaaaccccgtctcg

SEQ ID NO: 5457 - DNA, 15 bp, Homo sapiens
aagatggtgaaaccc

SEQ ID NO: 5458 - DNA, 15 bp, Homo sapiens
caagatggtgaaacc

SEQ ID NO: 5459 - DNA, 15 bp, Homo sapiens
ccaagatggtgaaac

SEQ ID NO: 5460 - DNA, 15 bp, Homo sapiens
gccaagatggtgaaa

SEQ ID NO: 5461 - DNA, 15 bp, Homo sapiens
ggccaagatggtgaa

SEQ ID NO: 5462 - DNA, 15 bp, Homo sapiens
tggccaagatggtga

SEQ ID NO: 5463 - DNA, 15 bp, Homo sapiens
gtggccaagatggtg

SEQ ID NO: 5464 - DNA, 15 bp, Homo sapiens
cgtggccaagatggt

SEQ ID NO: 5465 - DNA, 15 bp, Homo sapiens
gcgtggccaagatgg

SEQ ID NO: 5466 - DNA, 15 bp, Homo sapiens
agcgtggccaagatg

SEQ ID NO: 5467 - DNA, 15 bp, Homo sapiens
cagcgtggccaagat

SEQ ID NO: 5468 - DNA, 15 bp, Homo sapiens
ccagcgtggccaaga

SEQ ID NO: 5469 - DNA, 15 bp, Homo sapiens
accagcgtggccaag

SEQ ID NO: 5470 - DNA, 15 bp, Homo sapiens
gaccagcgtggccaa

SEQ ID NO: 5471 - DNA, 15 bp, Homo sapiens
agaccagcgtggcca

SEQ ID NO: 5472 - DNA, 15 bp, Homo sapiens
aagaccagcgtggcc

SEQ ID NO: 5473 - DNA, 15 bp, Homo sapiens
caagaccagcgtggc

SEQ ID NO: 5474 - DNA, 15 bp, Homo sapiens
tcaagaccagcgtgg

SEQ ID NO: 5475 - DNA, 15 bp, Homo sapiens
ttcaagaccagcgtg

SEQ ID NO: 5476 - DNA, 15 bp, Homo sapiens
gttcaagaccagcgt

SEQ ID NO: 5477 - DNA, 15 bp, Homo sapiens
agttcaagaccagcg

SEQ ID NO: 5478 - DNA, 15 bp, Homo sapiens
cgggtggatcacgag

SEQ ID NO: 5479 - DNA, 15 bp, Homo sapiens
gcgggtggatcacga

SEQ ID NO: 5480 - DNA, 15 bp, Homo sapiens
agcgggtggatcacg

SEQ ID NO: 5481 - DNA, 15 bp, Homo sapiens
aagcgggtggatcac

SEQ ID NO: 5482 - DNA, 15 bp, Homo sapiens
gaagcgggtggatca

SEQ ID NO: 5483 - DNA, 15 bp, Homo sapiens
tgaagcgggtggatc

SEQ ID NO: 5484 - DNA, 15 bp, Homo sapiens
ctgaagcgggtggat

SEQ ID NO: 5485 - DNA, 15 bp, Homo sapiens
gctgaagcgggtgga

SEQ ID NO: 5486 - DNA, 15 bp, Homo sapiens
ggctgaagcgggtgg

SEQ ID NO: 5487 - DNA, 15 bp, Homo sapiens
aggctgaagcgggtg

SEQ ID NO: 5488 - DNA, 15 bp, Homo sapiens
gaggctgaagcgggt

SEQ ID NO: 5489 - DNA, 15 bp, Homo sapiens
ggaggctgaagcggg

SEQ ID NO: 5490 - DNA, 15 bp, Homo sapiens
gggaggctgaagcgg

SEQ ID NO: 5491 - DNA, 15 bp, Homo sapiens
tgggaggctgaagcg

SEQ ID NO: 5492 - DNA, 15 bp, Homo sapiens
ttgggaggctgaagc

SEQ ID NO: 5493 - DNA, 15 bp, Homo sapiens
tttgggaggctgaag

SEQ ID NO: 5494 - DNA, 15 bp, Homo sapiens
ctttgggaggctgaa

SEQ ID NO: 5495 - DNA, 15 bp, Homo sapiens
actttgggaggctga

SEQ ID NO: 5496 - DNA, 15 bp, Homo sapiens
cactttgggaggctg

SEQ ID NO: 5497 - DNA, 15 bp, Homo sapiens
gcactttgggaggct

SEQ ID NO: 5498 - DNA, 15 bp, Homo sapiens
tgcactttgggaggc

SEQ ID NO: 5499 - DNA, 15 bp, Homo sapiens
ctgcactttgggagg

SEQ ID NO: 5500 - DNA, 15 bp, Homo sapiens
cctgcactttgggag

SEQ ID NO: 5501 - DNA, 15 bp, Homo sapiens
ccctgcactttggga

SEQ ID NO: 5502 - DNA, 15 bp, Homo sapiens
tccctgcactttggg

SEQ ID NO: 5503 - DNA, 15 bp, Homo sapiens
atccctgcactttgg

SEQ ID NO: 5504 - DNA, 15 bp, Homo sapiens
aatccctgcactttg

SEQ ID NO: 5505 - DNA, 15 bp, Homo sapiens
taatccctgcacttt

SEQ ID NO: 5506 - DNA, 15 bp, Homo sapiens
gtaatccctgcactt

SEQ ID NO: 5507 - DNA, 15 bp, Homo sapiens
tgtaatccctgcact

SEQ ID NO: 5508 - DNA, 15 bp, Homo sapiens
ctgtaatccctgcac

SEQ ID NO: 5509 - DNA, 15 bp, Homo sapiens
cctgtaatccctgca

SEQ ID NO: 5510 - DNA, 15 bp, Homo sapiens
gcctgtaatccctgc

SEQ ID NO: 5511 - DNA, 15 bp, Homo sapiens
cgcctgtaatccctg

SEQ ID NO: 5512 - DNA, 15 bp, Homo sapiens
acgcctgtaatccct

SEQ ID NO: 5513 - DNA, 15 bp, Homo sapiens
cggtggctcacgcct

SEQ ID NO: 5514 - DNA, 15 bp, Homo sapiens
gcggtggctcacgcc

SEQ ID NO: 5515 - DNA, 15 bp, Homo sapiens
tgcggtggctcacgc

SEQ ID NO: 5516 - DNA, 15 bp, Homo sapiens
gtgcggtggctcacg

SEQ ID NO: 5517 - DNA, 15 bp, Homo sapiens
ggtgcggtggctcac

SEQ ID NO: 5518 - DNA, 15 bp, Homo sapiens
gggtgcggtggctca

SEQ ID NO: 5519 - DNA, 15 bp, Homo sapiens
tgggtgcggtggctc

SEQ ID NO: 5520 - DNA, 15 bp, Homo sapiens
ctgggtgcggtggct

SEQ ID NO: 5521 - DNA, 15 bp, Homo sapiens
gctgggtgcggtggc

SEQ ID NO: 5522 - DNA, 15 bp, Homo sapiens
ggctgggtgcggtgg

SEQ ID NO: 5523 - DNA, 15 bp, Homo sapiens
aggctgggtgcggtg

SEQ ID NO: 5524 - DNA, 15 bp, Homo sapiens
gaggctgggtgcggt

SEQ ID NO: 5525 - DNA, 15 bp, Homo sapiens
agaggctgggtgcgg

SEQ ID NO: 5526 - DNA, 15 bp, Homo sapiens
cagaggctgggtgcg

SEQ ID NO: 5527 - DNA, 15 bp, Homo sapiens
ccagaggctgggtgc

SEQ ID NO: 5528 - DNA, 15 bp, Homo sapiens
gccagaggctgggtg

SEQ ID NO: 5529 - DNA, 15 bp, Homo sapiens
agccagaggctgggt

SEQ ID NO: 5530 - DNA, 15 bp, Homo sapiens
gagccagaggctggg

SEQ ID NO: 5531 - DNA, 15 bp, Homo sapiens
agagccagaggctgg

SEQ ID NO: 5532 - DNA, 15 bp, Homo sapiens
aagagccagaggctg

SEQ ID NO: 5533 - DNA, 15 bp, Homo sapiens
aaagagccagaggct

SEQ ID NO: 5534 - DNA, 15 bp, Homo sapiens
aaaagagccagaggc

SEQ ID NO: 5535 - DNA, 15 bp, Homo sapiens
gaaaagagccagagg

SEQ ID NO: 5536 - DNA, 15 bp, Homo sapiens
agaaaagagccagag

SEQ ID NO: 5537 - DNA, 15 bp, Homo sapiens
aagaaaagagccaga

SEQ ID NO: 5538 - DNA, 15 bp, Homo sapiens
aaagaaaagagccag

SEQ ID NO: 5539 - DNA, 15 bp, Homo sapiens
aaaagaaaagagcca

SEQ ID NO: 5540 - DNA, 15 bp, Homo sapiens
aaaaagaaaagagcc

SEQ ID NO: 5541 - DNA, 15 bp, Homo sapiens
caaaaagaaaagagc

SEQ ID NO: 5542 - DNA, 15 bp, Homo sapiens
tcaaaaagaaaagag

SEQ ID NO: 5543 - DNA, 15 bp, Homo sapiens
gtcaaaaagaaaaga

SEQ ID NO: 5544 - DNA, 15 bp, Homo sapiens
tgtcaaaaagaaaag

SEQ ID NO: 5545 - DNA, 15 bp, Homo sapiens
atgtcaaaaagaaaa

SEQ ID NO: 5546 - DNA, 15 bp, Homo sapiens
catgtcaaaaagaaa

SEQ ID NO: 5547 - DNA, 15 bp, Homo sapiens
tcatgtcaaaaagaa

SEQ ID NO: 5548 - DNA, 15 bp, Homo sapiens
ttcatgtcaaaaaga

SEQ ID NO: 5549 - DNA, 15 bp, Homo sapiens
tttcatgtcaaaaag

SEQ ID NO: 5550 - DNA, 15 bp, Homo sapiens
atttcatgtcaaaaa

SEQ ID NO: 5551 - DNA, 15 bp, Homo sapiens
gatttcatgtcaaaa

SEQ ID NO: 5552 - DNA, 15 bp, Homo sapiens
agatttcatgtcaaa

SEQ ID NO: 5553 - DNA, 15 bp, Homo sapiens
aagatttcatgtcaa

SEQ ID NO: 5554 - DNA, 15 bp, Homo sapiens
taagatttcatgtca

SEQ ID NO: 5555 - DNA, 15 bp, Homo sapiens
ttaagatttcatgtc

SEQ ID NO: 5556 - DNA, 15 bp, Homo sapiens
cttaagatttcatgt

SEQ ID NO: 5557 - DNA, 15 bp, Homo sapiens
acttaagatttcatg

SEQ ID NO: 5558 - DNA, 15 bp, Homo sapiens
aacttaagatttcat

SEQ ID NO: 5559 - DNA, 15 bp, Homo sapiens
taacttaagatttca

SEQ ID NO: 5560 - DNA, 15 bp, Homo sapiens
ttaacttaagatttc

SEQ ID NO: 5561 - DNA, 15 bp, Homo sapiens
attaacttaagattt

SEQ ID NO: 5562 - DNA, 15 bp, Homo sapiens
aattaacttaagatt

SEQ ID NO: 5563 - DNA, 15 bp, Homo sapiens
taattaacttaagat

SEQ ID NO: 5564 - DNA, 15 bp, Homo sapiens
ataattaacttaaga

SEQ ID NO: 5565 - DNA, 15 bp, Homo sapiens
gataattaacttaag

SEQ ID NO: 5566 - DNA, 15 bp, Homo sapiens
agataattaacttaa

SEQ ID NO: 5567 - DNA, 15 bp, Homo sapiens
aagataattaactta

SEQ ID NO: 5568 - DNA, 15 bp, Homo sapiens
taagataattaactt

SEQ ID NO: 5569 - DNA, 15 bp, Homo sapiens
ttaagataattaact

SEQ ID NO: 5570 - DNA, 15 bp, Homo sapiens
tttaagataattaac

SEQ ID NO: 5571 - DNA, 15 bp, Homo sapiens
gtttaagataattaa

SEQ ID NO: 5572 - DNA, 15 bp, Homo sapiens
agtttaagataatta

SEQ ID NO: 5573 - DNA, 15 bp, Homo sapiens
aagtttaagataatt

SEQ ID NO: 5574 - DNA, 15 bp, Homo sapiens
aaagtttaagataat

SEQ ID NO: 5575 - DNA, 15 bp, Homo sapiens
taaagtttaagataa

SEQ ID NO: 5576 - DNA, 15 bp, Homo sapiens
ttaaagtttaagata

SEQ ID NO: 5577 - DNA, 15 bp, Homo sapiens
cttaaagtttaagat

SEQ ID NO: 5578 - DNA, 15 bp, Homo sapiens
tcttaaagtttaaga

SEQ ID NO: 5579 - DNA, 15 bp, Homo sapiens
ttcttaaagtttaag

SEQ ID NO: 5580 - DNA, 15 bp, Homo sapiens
gttcttaaagtttaa

SEQ ID NO: 5581 - DNA, 15 bp, Homo sapiens
agttcttaaagttta

SEQ ID NO: 5582 - DNA, 15 bp, Homo sapiens
tagttcttaaagttt

SEQ ID NO: 5583 - DNA, 15 bp, Homo sapiens
ctagttcttaaagtt

SEQ ID NO: 5584 - DNA, 15 bp, Homo sapiens
tctagttcttaaagt

SEQ ID NO: 5585 - DNA, 15 bp, Homo sapiens
ttctagttcttaaag

SEQ ID NO: 5586 - DNA, 15 bp, Homo sapiens
cttctagttcttaaa

SEQ ID NO: 5587 - DNA, 15 bp, Homo sapiens
ccttctagttcttaa

SEQ ID NO: 5588 - DNA, 15 bp, Homo sapiens
tccttctagttctta

SEQ ID NO: 5589 - DNA, 15 bp, Homo sapiens
atccttctagttctt

SEQ ID NO: 5590 - DNA, 15 bp, Homo sapiens
aatccttctagttct

SEQ ID NO: 5591 - DNA, 15 bp, Homo sapiens
gaatccttctagttc

SEQ ID NO: 5592 - DNA, 15 bp, Homo sapiens
agaatccttctagtt

SEQ ID NO: 5593 - DNA, 15 bp, Homo sapiens
aagaatccttctagt

SEQ ID NO: 5594 - DNA, 15 bp, Homo sapiens
taagaatccttctag

SEQ ID NO: 5595 - DNA, 15 bp, Homo sapiens
ctaagaatccttcta

SEQ ID NO: 5596 - DNA, 15 bp, Homo sapiens
actaagaatccttct

SEQ ID NO: 5597 - DNA, 15 bp, Homo sapiens
gactaagaatccttc

SEQ ID NO: 5598 - DNA, 15 bp, Homo sapiens
ggactaagaatcctt

SEQ ID NO: 5599 - DNA, 15 bp, Homo sapiens
tggactaagaatcct

SEQ ID NO: 5600 - DNA, 15 bp, Homo sapiens
ctggactaagaatcc

SEQ ID NO: 5601 - DNA, 15 bp, Homo sapiens
gctggactaagaatc

SEQ ID NO: 5602 - DNA, 15 bp, Homo sapiens
tgctggactaagaat

SEQ ID NO: 5603 - DNA, 15 bp, Homo sapiens
gtgctggactaagaa

SEQ ID NO: 5604 - DNA, 15 bp, Homo sapiens
ggtgctggactaaga

SEQ ID NO: 5605 - DNA, 15 bp, Homo sapiens
tggtgctggactaag

SEQ ID NO: 5606 - DNA, 15 bp, Homo sapiens
atggtgctggactaa

SEQ ID NO: 5607 - DNA, 15 bp, Homo sapiens
gatggtgctggacta

SEQ ID NO: 5608 - DNA, 15 bp, Homo sapiens
tgatggtgctggact

SEQ ID NO: 5609 - DNA, 15 bp, Homo sapiens
ctgatggtgctggac

SEQ ID NO: 5610 - DNA, 15 bp, Homo sapiens
actgatggtgctgga

SEQ ID NO: 5611 - DNA, 15 bp, Homo sapiens
aactgatggtgctgg

SEQ ID NO: 5612 - DNA, 15 bp, Homo sapiens
aaactgatggtgctg

SEQ ID NO: 5613 - DNA, 15 bp, Homo sapiens
taaactgatggtgct

SEQ ID NO: 5614 - DNA, 15 bp, Homo sapiens
gtaaactgatggtgc

SEQ ID NO: 5615 - DNA, 15 bp, Homo sapiens
tgtaaactgatggtg

SEQ ID NO: 5616 - DNA, 15 bp, Homo sapiens
ttgtaaactgatggt

SEQ ID NO: 5617 - DNA, 15 bp, Homo sapiens
tttgtaaactgatgg

SEQ ID NO: 5618 - DNA, 15 bp, Homo sapiens
gtttgtaaactgatg

SEQ ID NO: 5619 - DNA, 15 bp, Homo sapiens
tgtttgtaaactgat

SEQ ID NO: 5620 - DNA, 15 bp, Homo sapiens
ttgtttgtaaactga

SEQ ID NO: 5621 - DNA, 15 bp, Homo sapiens
tttgtttgtaaactg

SEQ ID NO: 5622 - DNA, 15 bp, Homo sapiens
ttttgtttgtaaact

SEQ ID NO: 5623 - DNA, 15 bp, Homo sapiens
tttttgtttgtaaac

SEQ ID NO: 5624 - DNA, 15 bp, Homo sapiens
ttttttgtttgtaaa

SEQ ID NO: 5625 - DNA, 15 bp, Homo sapiens
tttttttgtttgtaa

SEQ ID NO: 5626 - DNA, 15 bp, Homo sapiens
ttttttttgtttgta

SEQ ID NO: 5627 - DNA, 15 bp, Homo sapiens
gttttttttgtttgt

SEQ ID NO: 5628 - DNA, 15 bp, Homo sapiens
agttttttttgtttg

SEQ ID NO: 5629 - DNA, 15 bp, Homo sapiens
aagttttttttgttt

SEQ ID NO: 5630 - DNA, 15 bp, Homo sapiens
caagttttttttgtt

SEQ ID NO: 5631 - DNA, 15 bp, Homo sapiens
acaagttttttttgt

SEQ ID NO: 5632 - DNA, 15 bp, Homo sapiens
cacaagttttttttg

SEQ ID NO: 5633 - DNA, 15 bp, Homo sapiens
acacaagtttttttt

SEQ ID NO: 5634 - DNA, 15 bp, Homo sapiens
gacacaagttttttt

SEQ ID NO: 5635 - DNA, 15 bp, Homo sapiens
ggacacaagtttttt

SEQ ID NO: 5636 - DNA, 15 bp, Homo sapiens
gggacacaagttttt

SEQ ID NO: 5637 - DNA, 15 bp, Homo sapiens
agggacacaagtttt

SEQ ID NO: 5638 - DNA, 15 bp, Homo sapiens
cagggacacaagttt

SEQ ID NO: 5639 - DNA, 15 bp, Homo sapiens
tcagggacacaagtt

SEQ ID NO: 5640 - DNA, 15 bp, Homo sapiens
ctcagggacacaagt

SEQ ID NO: 5641 - DNA, 15 bp, Homo sapiens
tctcagggacacaag

SEQ ID NO: 5642 - DNA, 15 bp, Homo sapiens
ttctcagggacacaa

SEQ ID NO: 5643 - DNA, 15 bp, Homo sapiens
cttctcagggacaca

SEQ ID NO: 5644 - DNA, 15 bp, Homo sapiens
acttctcagggacac

SEQ ID NO: 5645 - DNA, 15 bp, Homo sapiens
aacttctcagggaca

SEQ ID NO: 5646 - DNA, 15 bp, Homo sapiens
caacttctcagggac

SEQ ID NO: 5647 - DNA, 15 bp, Homo sapiens
acaacttctcaggga

SEQ ID NO: 5648 - DNA, 15 bp, Homo sapiens
cacaacttctcaggg

SEQ ID NO: 5649 - DNA, 15 bp, Homo sapiens
tcacaacttctcagg

SEQ ID NO: 5650 - DNA, 15 bp, Homo sapiens
gtcacaacttctcag

SEQ ID NO: 5651 - DNA, 15 bp, Homo sapiens
agtcacaacttctca

SEQ ID NO: 5652 - DNA, 15 bp, Homo sapiens
aagtcacaacttctc

SEQ ID NO: 5653 - DNA, 15 bp, Homo sapiens
aaagtcacaacttct

SEQ ID NO: 5654 - DNA, 15 bp, Homo sapiens
aaaagtcacaacttc

SEQ ID NO: 5655 - DNA, 15 bp, Homo sapiens
gaaaagtcacaactt

SEQ ID NO: 5656 - DNA, 15 bp, Homo sapiens
ggaaaagtcacaact

SEQ ID NO: 5657 - DNA, 15 bp, Homo sapiens
tggaaaagtcacaac

SEQ ID NO: 5658 - DNA, 15 bp, Homo sapiens
ctggaaaagtcacaa

SEQ ID NO: 5659 - DNA, 15 bp, Homo sapiens
cctggaaaagtcaca

SEQ ID NO: 5660 - DNA, 15 bp, Homo sapiens
ccctggaaaagtcac

SEQ ID NO: 5661 - DNA, 15 bp, Homo sapiens
gccctggaaaagtca

SEQ ID NO: 5662 - DNA, 15 bp, Homo sapiens
ggccctggaaaagtc

SEQ ID NO: 5663 - DNA, 15 bp, Homo sapiens
aggccctggaaaagt

SEQ ID NO: 5664 - DNA, 15 bp, Homo sapiens
gaggccctggaaaag

SEQ ID NO: 5665 - DNA, 15 bp, Homo sapiens
ggaggccctggaaaa

SEQ ID NO: 5666 - DNA, 15 bp, Homo sapiens
aggaggccctggaaa

SEQ ID NO: 5667 - DNA, 15 bp, Homo sapiens
taggaggccctggaa

SEQ ID NO: 5668 - DNA, 15 bp, Homo sapiens
ctaggaggccctgga

SEQ ID NO: 5669 - DNA, 15 bp, Homo sapiens
gctaggaggccctgg

SEQ ID NO: 5670 - DNA, 15 bp, Homo sapiens
ggctaggaggccctg

SEQ ID NO: 5671 - DNA, 15 bp, Homo sapiens
tggctaggaggccct

SEQ ID NO: 5672 - DNA, 15 bp, Homo sapiens
ctggctaggaggccc

SEQ ID NO: 5673 - DNA, 15 bp, Homo sapiens
cctggctaggaggcc

SEQ ID NO: 5674 - DNA, 15 bp, Homo sapiens
tcctggctaggaggc

SEQ ID NO: 5675 - DNA, 15 bp, Homo sapiens
atcctggctaggagg

SEQ ID NO: 5676 - DNA, 15 bp, Homo sapiens
tatcctggctaggag

SEQ ID NO: 5677 - DNA, 15 bp, Homo sapiens
gtatcctggctagga

SEQ ID NO: 5678 - DNA, 15 bp, Homo sapiens
ggtatcctggctagg

SEQ ID NO: 5679 - DNA, 15 bp, Homo sapiens
tggtatcctggctag

SEQ ID NO: 5680 - DNA, 15 bp, Homo sapiens
ctggtatcctggcta

SEQ ID NO: 5681 - DNA, 15 bp, Homo sapiens
actggtatcctggct

SEQ ID NO: 5682 - DNA, 15 bp, Homo sapiens
aactggtatcctggc

SEQ ID NO: 5683 - DNA, 15 bp, Homo sapiens
aaactggtatcctgg

SEQ ID NO: 5684 - DNA, 15 bp, Homo sapiens
caaactggtatcctg

SEQ ID NO: 5685 - DNA, 15 bp, Homo sapiens
ccaaactggtatcct

SEQ ID NO: 5686 - DNA, 15 bp, Homo sapiens
accaaactggtatcc

SEQ ID NO: 5687 - DNA, 15 bp, Homo sapiens
aaccaaactggtatc

SEQ ID NO: 5688 - DNA, 15 bp, Homo sapiens
aaaccaaactggtat

SEQ ID NO: 5689 - DNA, 15 bp, Homo sapiens
aaaaccaaactggta

SEQ ID NO: 5690 - DNA, 15 bp, Homo sapiens
aaaaaccaaactggt

SEQ ID NO: 5691 - DNA, 15 bp, Homo sapiens
taaaaaccaaactgg

SEQ ID NO: 5692 - DNA, 15 bp, Homo sapiens
ataaaaaccaaactg

SEQ ID NO: 5693 - DNA, 15 bp, Homo sapiens
aataaaaaccaaact

SEQ ID NO: 5694 - DNA, 15 bp, Homo sapiens
taataaaaaccaaac

SEQ ID NO: 5695 - DNA, 15 bp, Homo sapiens
ataataaaaaccaaa

SEQ ID NO: 5696 - DNA, 15 bp, Homo sapiens
tataataaaaaccaa

SEQ ID NO: 5697 - DNA, 15 bp, Homo sapiens
atataataaaaacca

SEQ ID NO: 5698 - DNA, 15 bp, Homo sapiens
tatataataaaaacc

SEQ ID NO: 5699 - DNA, 15 bp, Homo sapiens
ctatataataaaaac

SEQ ID NO: 5700 - DNA, 15 bp, Homo sapiens
gctatataataaaaa

SEQ ID NO: 5701 - DNA, 15 bp, Homo sapiens
agctatataataaaa

SEQ ID NO: 5702 - DNA, 15 bp, Homo sapiens
tagctatataataaa

SEQ ID NO: 5703 - DNA, 15 bp, Homo sapiens
ctagctatataataa

SEQ ID NO: 5704 - DNA, 15 bp, Homo sapiens
gctagctatataata

SEQ ID NO: 5705 - DNA, 15 bp, Homo sapiens
ggctagctatataat

SEQ ID NO: 5706 - DNA, 15 bp, Homo sapiens
cggctagctatataa

SEQ ID NO: 5707 - DNA, 15 bp, Homo sapiens
tcggctagctatata

SEQ ID NO: 5708 - DNA, 15 bp, Homo sapiens
ctcggctagctatat

SEQ ID NO: 5709 - DNA, 15 bp, Homo sapiens
actcggctagctata

SEQ ID NO: 5710 - DNA, 15 bp, Homo sapiens
tactcggctagctat

SEQ ID NO: 5711 - DNA, 15 bp, Homo sapiens
ttactcggctagcta

SEQ ID NO: 5712 - DNA, 15 bp, Homo sapiens
attactcggctagct

SEQ ID NO: 5713 - DNA, 15 bp, Homo sapiens
tattactcggctagc

SEQ ID NO: 5714 - DNA, 15 bp, Homo sapiens
gtattactcggctag

SEQ ID NO: 5715 - DNA, 15 bp, Homo sapiens
agtattactcggcta

SEQ ID NO: 5716 - DNA, 15 bp, Homo sapiens
tagtattactcggct

SEQ ID NO: 5717 - DNA, 15 bp, Homo sapiens
atagtattactcggc

SEQ ID NO: 5718 - DNA, 15 bp, Homo sapiens
aatagtattactcgg

SEQ ID NO: 5719 - DNA, 15 bp, Homo sapiens
taatagtattactcg

SEQ ID NO: 5720 - DNA, 15 bp, Homo sapiens
ttaatagtattactc

SEQ ID NO: 5721 - DNA, 15 bp, Homo sapiens
gttaatagtattact

SEQ ID NO: 5722 - DNA, 15 bp, Homo sapiens
agttaatagtattac

SEQ ID NO: 5723 - DNA, 15 bp, Homo sapiens
aagttaatagtatta

SEQ ID NO: 5724 - DNA, 15 bp, Homo sapiens
caagttaatagtatt

SEQ ID NO: 5725 - DNA, 15 bp, Homo sapiens
tcaagttaatagtat

SEQ ID NO: 5726 - DNA, 15 bp, Homo sapiens
gtcaagttaatagta

SEQ ID NO: 5727 - DNA, 15 bp, Homo sapiens
agtcaagttaatagt

SEQ ID NO: 5728 - DNA, 15 bp, Homo sapiens
aagtcaagttaatag

SEQ ID NO: 5729 - DNA, 15 bp, Homo sapiens
gaagtcaagttaata

SEQ ID NO: 5730 - DNA, 15 bp, Homo sapiens
agaagtcaagttaat

SEQ ID NO: 5731 - DNA, 15 bp, Homo sapiens
cagaagtcaagttaa

SEQ ID NO: 5732 - DNA, 15 bp, Homo sapiens
ccagaagtcaagtta

SEQ ID NO: 5733 - DNA, 15 bp, Homo sapiens
cccagaagtcaagtt

SEQ ID NO: 5734 - DNA, 15 bp, Homo sapiens
tcccagaagtcaagt

SEQ ID NO: 5735 - DNA, 15 bp, Homo sapiens
atcccagaagtcaag

SEQ ID NO: 5736 - DNA, 15 bp, Homo sapiens
aatcccagaagtcaa

SEQ ID NO: 5737 - DNA, 15 bp, Homo sapiens
aaatcccagaagtca

SEQ ID NO: 5738 - DNA, 15 bp, Homo sapiens
gaaatcccagaagtc

SEQ ID NO: 5739 - DNA, 15 bp, Homo sapiens
tgaaatcccagaagt

SEQ ID NO: 5740 - DNA, 15 bp, Homo sapiens
ttgaaatcccagaag

SEQ ID NO: 5741 - DNA, 15 bp, Homo sapiens
tttgaaatcccagaa

SEQ ID NO: 5742 - DNA, 15 bp, Homo sapiens
ctttgaaatcccaga

SEQ ID NO: 5743 - DNA, 15 bp, Homo sapiens
actttgaaatcccag

SEQ ID NO: 5744 - DNA, 15 bp, Homo sapiens
tactttgaaatccca

SEQ ID NO: 5745 - DNA, 15 bp, Homo sapiens
atactttgaaatccc

SEQ ID NO: 5746 - DNA, 15 bp, Homo sapiens
aatactttgaaatcc

SEQ ID NO: 5747 - DNA, 15 bp, Homo sapiens
gaatactttgaaatc

SEQ ID NO: 5748 - DNA, 15 bp, Homo sapiens
agaatactttgaaat

SEQ ID NO: 5749 - DNA, 15 bp, Homo sapiens
tagaatactttgaaa

SEQ ID NO: 5750 - DNA, 15 bp, Homo sapiens
atagaatactttgaa

SEQ ID NO: 5751 - DNA, 15 bp, Homo sapiens
catagaatactttga

SEQ ID NO: 5752 - DNA, 15 bp, Homo sapiens
tcatagaatactttg

SEQ ID NO: 5753 - DNA, 15 bp, Homo sapiens
gtcatagaatacttt

SEQ ID NO: 5754 - DNA, 15 bp, Homo sapiens
agtcatagaatactt

SEQ ID NO: 5755 - DNA, 15 bp, Homo sapiens
aagtcatagaatact

SEQ ID NO: 5756 - DNA, 15 bp, Homo sapiens
caagtcatagaatac

SEQ ID NO: 5757 - DNA, 15 bp, Homo sapiens
tcaagtcatagaata

SEQ ID NO: 5758 - DNA, 15 bp, Homo sapiens
gtcaagtcatagaat

SEQ ID NO: 5759 - DNA, 15 bp, Homo sapiens
agtcaagtcatagaa

SEQ ID NO: 5760 - DNA, 15 bp, Homo sapiens
cagtcaagtcataga

SEQ ID NO: 5761 - DNA, 15 bp, Homo sapiens
acagtcaagtcatag

SEQ ID NO: 5762 - DNA, 15 bp, Homo sapiens
aacagtcaagtcata

SEQ ID NO: 5763 - DNA, 15 bp, Homo sapiens
aaacagtcaagtcat

SEQ ID NO: 5764 - DNA, 15 bp, Homo sapiens
taaacagtcaagtca

SEQ ID NO: 5765 - DNA, 15 bp, Homo sapiens
ttaaacagtcaagtc

SEQ ID NO: 5766 - DNA, 15 bp, Homo sapiens
cttaaacagtcaagt

SEQ ID NO: 5767 - DNA, 15 bp, Homo sapiens
ccttaaacagtcaag

SEQ ID NO: 5768 - DNA, 15 bp, Homo sapiens
cccttaaacagtcaa

SEQ ID NO: 5769 - DNA, 15 bp, Homo sapiens
tcccttaaacagtca

SEQ ID NO: 5770 - DNA, 15 bp, Homo sapiens
ttcccttaaacagtc

SEQ ID NO: 5771 - DNA, 15 bp, Homo sapiens
attcccttaaacagt

SEQ ID NO: 5772 - DNA, 15 bp, Homo sapiens
aattcccttaaacag

SEQ ID NO: 5773 - DNA, 15 bp, Homo sapiens
taattcccttaaaca

SEQ ID NO: 5774 - DNA, 15 bp, Homo sapiens
ataattcccttaaac

SEQ ID NO: 5775 - DNA, 15 bp, Homo sapiens
cataattcccttaaa

SEQ ID NO: 5776 - DNA, 15 bp, Homo sapiens
tcataattcccttaa

SEQ ID NO: 5777 - DNA, 15 bp, Homo sapiens
ctcataattccctta

SEQ ID NO: 5778 - DNA, 15 bp, Homo sapiens
cctcataattccctt

SEQ ID NO: 5779 - DNA, 15 bp, Homo sapiens
gcctcataattccct

SEQ ID NO: 5780 - DNA, 15 bp, Homo sapiens
ggcctcataattccc

SEQ ID NO: 5781 - DNA, 15 bp, Homo sapiens
aggcctcataattcc

SEQ ID NO: 5782 - DNA, 15 bp, Homo sapiens
gaggcctcataattc

SEQ ID NO: 5783 - DNA, 15 bp, Homo sapiens
tgaggcctcataatt

SEQ ID NO: 5784 - DNA, 15 bp, Homo sapiens
gtgaggcctcataat

SEQ ID NO: 5785 - DNA, 15 bp, Homo sapiens
agtgaggcctcataa

SEQ ID NO: 5786 - DNA, 15 bp, Homo sapiens
cagtgaggcctcata

SEQ ID NO: 5787 - DNA, 15 bp, Homo sapiens
tcagtgaggcctcat

SEQ ID NO: 5788 - DNA, 15 bp, Homo sapiens
ttcagtgaggcctca

SEQ ID NO: 5789 - DNA, 15 bp, Homo sapiens
gttcagtgaggcctc

SEQ ID NO: 5790 - DNA, 15 bp, Homo sapiens
ggttcagtgaggcct

SEQ ID NO: 5791 - DNA, 15 bp, Homo sapiens
aggttcagtgaggcc

SEQ ID NO: 5792 - DNA, 15 bp, Homo sapiens
gaggttcagtgaggc

SEQ ID NO: 5793 - DNA, 15 bp, Homo sapiens
tgaggttcagtgagg

SEQ ID NO: 5794 - DNA, 15 bp, Homo sapiens
ttgaggttcagtgag

SEQ ID NO: 5795 - DNA, 15 bp, Homo sapiens
tttgaggttcagtga

SEQ ID NO: 5796 - DNA, 15 bp, Homo sapiens
ttttgaggttcagtg

SEQ ID NO: 5797 - DNA, 15 bp, Homo sapiens
cttttgaggttcagt

SEQ ID NO: 5798 - DNA, 15 bp, Homo sapiens
tcttttgaggttcag

SEQ ID NO: 5799 - DNA, 15 bp, Homo sapiens
atcttttgaggttca

SEQ ID NO: 5800 - DNA, 15 bp, Homo sapiens
tatcttttgaggttc

SEQ ID NO: 5801 - DNA, 15 bp, Homo sapiens
ttatcttttgaggtt

SEQ ID NO: 5802 - DNA, 15 bp, Homo sapiens
attatcttttgaggt

SEQ ID NO: 5803 - DNA, 15 bp, Homo sapiens
aattatcttttgagg

SEQ ID NO: 5804 - DNA, 15 bp, Homo sapiens
aaattatcttttgag

SEQ ID NO: 5805 - DNA, 15 bp, Homo sapiens
aaaattatcttttga

SEQ ID NO: 5806 - DNA, 15 bp, Homo sapiens
taaaattatcttttg

SEQ ID NO: 5807 - DNA, 15 bp, Homo sapiens
ctaaaattatctttt

SEQ ID NO: 5808 - DNA, 15 bp, Homo sapiens
cctaaaattatcttt

SEQ ID NO: 5809 - DNA, 15 bp, Homo sapiens
acctaaaattatctt

SEQ ID NO: 5810 - DNA, 15 bp, Homo sapiens
tacctaaaattatct

SEQ ID NO: 5811 - DNA, 15 bp, Homo sapiens
gtacctaaaattatc

SEQ ID NO: 5812 - DNA, 15 bp, Homo sapiens
ggtacctaaaattat

SEQ ID NO: 5813 - DNA, 15 bp, Homo sapiens
tggtacctaaaatta

SEQ ID NO: 5814 - DNA, 15 bp, Homo sapiens
atggtacctaaaatt

SEQ ID NO: 5815 - DNA, 15 bp, Homo sapiens
gatggtacctaaaat

SEQ ID NO: 5816 - DNA, 15 bp, Homo sapiens
ggatggtacctaaaa

SEQ ID NO: 5817 - DNA, 15 bp, Homo sapiens
aggatggtacctaaa

SEQ ID NO: 5818 - DNA, 15 bp, Homo sapiens
caggatggtacctaa

SEQ ID NO: 5819 - DNA, 15 bp, Homo sapiens
ccaggatggtaccta

SEQ ID NO: 5820 - DNA, 15 bp, Homo sapiens
accaggatggtacct

SEQ ID NO: 5821 - DNA, 15 bp, Homo sapiens
taccaggatggtacc

SEQ ID NO: 5822 - DNA, 15 bp, Homo sapiens
ctaccaggatggtac

SEQ ID NO: 5823 - DNA, 15 bp, Homo sapiens
gctaccaggatggta

SEQ ID NO: 5824 - DNA, 15 bp, Homo sapiens
agctaccaggatggt

SEQ ID NO: 5825 - DNA, 15 bp, Homo sapiens
cagctaccaggatgg

SEQ ID NO: 5826 - DNA, 15 bp, Homo sapiens
acagctaccaggatg

SEQ ID NO: 5827 - DNA, 15 bp, Homo sapiens
tacagctaccaggat

SEQ ID NO: 5828 - DNA, 15 bp, Homo sapiens
ctacagctaccagga

SEQ ID NO: 5829 - DNA, 15 bp, Homo sapiens
tctacagctaccagg

SEQ ID NO: 5830 - DNA, 15 bp, Homo sapiens
ctctacagctaccag

SEQ ID NO: 5831 - DNA, 15 bp, Homo sapiens
gctctacagctacca

SEQ ID NO: 5832 - DNA, 15 bp, Homo sapiens
tgctctacagctacc

SEQ ID NO: 5833 - DNA, 15 bp, Homo sapiens
ctgctctacagctac

SEQ ID NO: 5834 - DNA, 15 bp, Homo sapiens
gctgctctacagcta

SEQ ID NO: 5835 - DNA, 15 bp, Homo sapiens
tgctgctctacagct

SEQ ID NO: 5836 - DNA, 15 bp, Homo sapiens
ttgctgctctacagc

SEQ ID NO: 5837 - DNA, 15 bp, Homo sapiens
gttgctgctctacag

SEQ ID NO: 5838 - DNA, 15 bp, Homo sapiens
tgttgctgctctaca

SEQ ID NO: 5839 - DNA, 15 bp, Homo sapiens
ctgttgctgctctac

SEQ ID NO: 5840 - DNA, 15 bp, Homo sapiens
tctgttgctgctcta

SEQ ID NO: 5841 - DNA, 15 bp, Homo sapiens
gtctgttgctgctct

SEQ ID NO: 5842 - DNA, 15 bp, Homo sapiens
ggtctgttgctgctc

SEQ ID NO: 5843 - DNA, 15 bp, Homo sapiens
tggtctgttgctgct

SEQ ID NO: 5844 - DNA, 15 bp, Homo sapiens
ctggtctgttgctgc

SEQ ID NO: 5845 - DNA, 15 bp, Homo sapiens
actggtctgttgctg

SEQ ID NO: 5846 - DNA, 15 bp, Homo sapiens
tactggtctgttgct

SEQ ID NO: 5847 - DNA, 15 bp, Homo sapiens
ttactggtctgttgc

SEQ ID NO: 5848 - DNA, 15 bp, Homo sapiens
tttactggtctgttg

SEQ ID NO: 5849 - DNA, 15 bp, Homo sapiens
ttttactggtctgtt

SEQ ID NO: 5850 - DNA, 15 bp, Homo sapiens
cttttactggtctgt

SEQ ID NO: 5851 - DNA, 15 bp, Homo sapiens
tcttttactggtctg

SEQ ID NO: 5852 - DNA, 15 bp, Homo sapiens
gtcttttactggtct

SEQ ID NO: 5853 - DNA, 15 bp, Homo sapiens
agtcttttactggtc

SEQ ID NO: 5854 - DNA, 15 bp, Homo sapiens
aagtcttttactggt

SEQ ID NO: 5855 - DNA, 15 bp, Homo sapiens
caagtcttttactgg

SEQ ID NO: 5856 - DNA, 15 bp, Homo sapiens
ccaagtcttttactg

SEQ ID NO: 5857 - DNA, 15 bp, Homo sapiens
accaagtcttttact

SEQ ID NO: 5858 - DNA, 15 bp, Homo sapiens
aaccaagtcttttac

SEQ ID NO: 5859 - DNA, 15 bp, Homo sapiens
caaccaagtctttta

SEQ ID NO: 5860 - DNA, 15 bp, Homo sapiens
ccaaccaagtctttt

SEQ ID NO: 5861 - DNA, 15 bp, Homo sapiens
accaaccaagtcttt

SEQ ID NO: 5862 - DNA, 15 bp, Homo sapiens
caccaaccaagtctt

SEQ ID NO: 5863 - DNA, 15 bp, Homo sapiens
acaccaaccaagtct

SEQ ID NO: 5864 - DNA, 15 bp, Homo sapiens
aacaccaaccaagtc

SEQ ID NO: 5865 - DNA, 15 bp, Homo sapiens
caacaccaaccaagt

SEQ ID NO: 5866 - DNA, 15 bp, Homo sapiens
gcaacaccaaccaag

SEQ ID NO: 5867 - DNA, 15 bp, Homo sapiens
ggcaacaccaaccaa

SEQ ID NO: 5868 - DNA, 15 bp, Homo sapiens
gggcaacaccaacca

SEQ ID NO: 5869 - DNA, 15 bp, Homo sapiens
agggcaacaccaacc

SEQ ID NO: 5870 - DNA, 15 bp, Homo sapiens
aagggcaacaccaac

SEQ ID NO: 5871 - DNA, 15 bp, Homo sapiens
gaagggcaacaccaa

SEQ ID NO: 5872 - DNA, 15 bp, Homo sapiens
agaagggcaacacca

SEQ ID NO: 5873 - DNA, 15 bp, Homo sapiens
aagaagggcaacacc

SEQ ID NO: 5874 - DNA, 15 bp, Homo sapiens
gaagaagggcaacac

SEQ ID NO: 5875 - DNA, 15 bp, Homo sapiens
agaagaagggcaaca

SEQ ID NO: 5876 - DNA, 15 bp, Homo sapiens
cagaagaagggcaac

SEQ ID NO: 5877 - DNA, 15 bp, Homo sapiens
ccagaagaagggcaa

SEQ ID NO: 5878 - DNA, 15 bp, Homo sapiens
cccagaagaagggca

SEQ ID NO: 5879 - DNA, 15 bp, Homo sapiens
acccagaagaagggc

SEQ ID NO: 5880 - DNA, 15 bp, Homo sapiens
aacccagaagaaggg

SEQ ID NO: 5881 - DNA, 15 bp, Homo sapiens
aaacccagaagaagg

SEQ ID NO: 5882 - DNA, 15 bp, Homo sapiens
caaacccagaagaag

SEQ ID NO: 5883 - DNA, 15 bp, Homo sapiens
tcaaacccagaagaa

SEQ ID NO: 5884 - DNA, 15 bp, Homo sapiens
atcaaacccagaaga

SEQ ID NO: 5885 - DNA, 15 bp, Homo sapiens
aatcaaacccagaag

SEQ ID NO: 5886 - DNA, 15 bp, Homo sapiens
taatcaaacccagaa

SEQ ID NO: 5887 - DNA, 15 bp, Homo sapiens
gtaatcaaacccaga

SEQ ID NO: 5888 - DNA, 15 bp, Homo sapiens
tgtaatcaaacccag

SEQ ID NO: 5889 - DNA, 15 bp, Homo sapiens
atgtaatcaaaccca

SEQ ID NO: 5890 - DNA, 15 bp, Homo sapiens
catgtaatcaaaccc

SEQ ID NO: 5891 - DNA, 15 bp, Homo sapiens
tcatgtaatcaaacc

SEQ ID NO: 5892 - DNA, 15 bp, Homo sapiens
ctcatgtaatcaaac

SEQ ID NO: 5893 - DNA, 15 bp, Homo sapiens
actcatgtaatcaaa

SEQ ID NO: 5894 - DNA, 15 bp, Homo sapiens
tactcatgtaatcaa

SEQ ID NO: 5895 - DNA, 15 bp, Homo sapiens
ttactcatgtaatca

SEQ ID NO: 5896 - DNA, 15 bp, Homo sapiens
attactcatgtaatc

SEQ ID NO: 5897 - DNA, 15 bp, Homo sapiens
aattactcatgtaat

SEQ ID NO: 5898 - DNA, 15 bp, Homo sapiens
caattactcatgtaa

SEQ ID NO: 5899 - DNA, 15 bp, Homo sapiens
acaattactcatgta

SEQ ID NO: 5900 - DNA, 15 bp, Homo sapiens
cacaattactcatgt

SEQ ID NO: 5901 - DNA, 15 bp, Homo sapiens
acacaattactcatg

SEQ ID NO: 5902 - DNA, 15 bp, Homo sapiens
cacacaattactcat

SEQ ID NO: 5903 - DNA, 15 bp, Homo sapiens
tcacacaattactca

SEQ ID NO: 5904 - DNA, 15 bp, Homo sapiens
ttcacacaattactc

SEQ ID NO: 5905 - DNA, 15 bp, Homo sapiens
attcacacaattact

SEQ ID NO: 5906 - DNA, 15 bp, Homo sapiens
tattcacacaattac

SEQ ID NO: 5907 - DNA, 15 bp, Homo sapiens
ctattcacacaatta

SEQ ID NO: 5908 - DNA, 15 bp, Homo sapiens
actattcacacaatt

SEQ ID NO: 5909 - DNA, 15 bp, Homo sapiens
gactattcacacaat

SEQ ID NO: 5910 - DNA, 15 bp, Homo sapiens
agactattcacacaa

SEQ ID NO: 5911 - DNA, 15 bp, Homo sapiens
gagactattcacaca

SEQ ID NO: 5912 - DNA, 15 bp, Homo sapiens
agagactattcacac

SEQ ID NO: 5913 - DNA, 15 bp, Homo sapiens
tagagactattcaca

SEQ ID NO: 5914 - DNA, 15 bp, Homo sapiens
ttagagactattcac

SEQ ID NO: 5915 - DNA, 15 bp, Homo sapiens
cttagagactattca

SEQ ID NO: 5916 - DNA, 15 bp, Homo sapiens
acttagagactattc

SEQ ID NO: 5917 - DNA, 15 bp, Homo sapiens
aacttagagactatt

SEQ ID NO: 5918 - DNA, 15 bp, Homo sapiens
caacttagagactat

SEQ ID NO: 5919 - DNA, 15 bp, Homo sapiens
acaacttagagacta

SEQ ID NO: 5920 - DNA, 15 bp, Homo sapiens
tacaacttagagact

SEQ ID NO: 5921 - DNA, 15 bp, Homo sapiens
atacaacttagagac

SEQ ID NO: 5922 - DNA, 15 bp, Homo sapiens
catacaacttagaga

SEQ ID NO: 5923 - DNA, 15 bp, Homo sapiens
gcatacaacttagag

SEQ ID NO: 5924 - DNA, 15 bp, Homo sapiens
agcatacaacttaga

SEQ ID NO: 5925 - DNA, 15 bp, Homo sapiens
gagcatacaacttag

SEQ ID NO: 5926 - DNA, 15 bp, Homo sapiens
agagcatacaactta

SEQ ID NO: 5927 - DNA, 15 bp, Homo sapiens
cagagcatacaactt

SEQ ID NO: 5928 - DNA, 15 bp, Homo sapiens
tcagagcatacaact

SEQ ID NO: 5929 - DNA, 15 bp, Homo sapiens
ctcagagcatacaac

SEQ ID NO: 5930 - DNA, 15 bp, Homo sapiens
gctcagagcatacaa

SEQ ID NO: 5931 - DNA, 15 bp, Homo sapiens
agctcagagcataca

SEQ ID NO: 5932 - DNA, 15 bp, Homo sapiens
aagctcagagcatac

SEQ ID NO: 5933 - DNA, 15 bp, Homo sapiens
aaagctcagagcata

SEQ ID NO: 5934 - DNA, 15 bp, Homo sapiens
gaaagctcagagcat

SEQ ID NO: 5935 - DNA, 15 bp, Homo sapiens
cgaaagctcagagca

SEQ ID NO: 5936 - DNA, 15 bp, Homo sapiens
acgaaagctcagagc

SEQ ID NO: 5937 - DNA, 15 bp, Homo sapiens
aacgaaagctcagag

SEQ ID NO: 5938 - DNA, 15 bp, Homo sapiens
aaacgaaagctcaga

SEQ ID NO: 5939 - DNA, 15 bp, Homo sapiens
aaaacgaaagctcag

SEQ ID NO: 5940 - DNA, 15 bp, Homo sapiens
aaaaacgaaagctca

SEQ ID NO: 5941 - DNA, 15 bp, Homo sapiens
taaaaacgaaagctc

SEQ ID NO: 5942 - DNA, 15 bp, Homo sapiens
ctaaaaacgaaagct

SEQ ID NO: 5943 - DNA, 15 bp, Homo sapiens
gctaaaaacgaaagc

SEQ ID NO: 5944 - DNA, 15 bp, Homo sapiens
agctaaaaacgaaag

SEQ ID NO: 5945 - DNA, 15 bp, Homo sapiens
aagctaaaaacgaaa

SEQ ID NO: 5946 - DNA, 15 bp, Homo sapiens
taagctaaaaacgaa

SEQ ID NO: 5947 - DNA, 15 bp, Homo sapiens
ataagctaaaaacga

SEQ ID NO: 5948 - DNA, 15 bp, Homo sapiens
tataagctaaaaacg

SEQ ID NO: 5949 - DNA, 15 bp, Homo sapiens
ttataagctaaaaac

SEQ ID NO: 5950 - DNA, 15 bp, Homo sapiens
tttataagctaaaaa

SEQ ID NO: 5951 - DNA, 15 bp, Homo sapiens
ttttataagctaaaa

SEQ ID NO: 5952 - DNA, 15 bp, Homo sapiens
cttttataagctaaa

SEQ ID NO: 5953 - DNA, 15 bp, Homo sapiens
acttttataagctaa

SEQ ID NO: 5954 - DNA, 15 bp, Homo sapiens
cacttttataagcta

SEQ ID NO: 5955 - DNA, 15 bp, Homo sapiens
gcacttttataagct

SEQ ID NO: 5956 - DNA, 15 bp, Homo sapiens
agcacttttataagc

SEQ ID NO: 5957 - DNA, 15 bp, Homo sapiens
tagcacttttataag

SEQ ID NO: 5958 - DNA, 15 bp, Homo sapiens
gtagcacttttataa

SEQ ID NO: 5959 - DNA, 15 bp, Homo sapiens
agtagcacttttata

SEQ ID NO: 5960 - DNA, 15 bp, Homo sapiens
gagtagcacttttat

SEQ ID NO: 5961 - DNA, 15 bp, Homo sapiens
agagtagcactttta

SEQ ID NO: 5962 - DNA, 15 bp, Homo sapiens
aagagtagcactttt

SEQ ID NO: 5963 - DNA, 15 bp, Homo sapiens
caagagtagcacttt

SEQ ID NO: 5964 - DNA, 15 bp, Homo sapiens
ccaagagtagcactt

SEQ ID NO: 5965 - DNA, 15 bp, Homo sapiens
cccaagagtagcact

SEQ ID NO: 5966 - DNA, 15 bp, Homo sapiens
gcccaagagtagcac

SEQ ID NO: 5967 - DNA, 15 bp, Homo sapiens
ggcccaagagtagca

SEQ ID NO: 5968 - DNA, 15 bp, Homo sapiens
tggcccaagagtagc

SEQ ID NO: 5969 - DNA, 15 bp, Homo sapiens
ctggcccaagagtag

SEQ ID NO: 5970 - DNA, 15 bp, Homo sapiens
gctggcccaagagta

SEQ ID NO: 5971 - DNA, 15 bp, Homo sapiens
tgctggcccaagagt

SEQ ID NO: 5972 - DNA, 15 bp, Homo sapiens
atgctggcccaagag

SEQ ID NO: 5973 - DNA, 15 bp, Homo sapiens
tatgctggcccaaga

SEQ ID NO: 5974 - DNA, 15 bp, Homo sapiens
ctatgctggcccaag

SEQ ID NO: 5975 - DNA, 15 bp, Homo sapiens
actatgctggcccaa

SEQ ID NO: 5976 - DNA, 15 bp, Homo sapiens
tactatgctggccca

SEQ ID NO: 5977 - DNA, 15 bp, Homo sapiens
atactatgctggccc

SEQ ID NO: 5978 - DNA, 15 bp, Homo sapiens
gatactatgctggcc

SEQ ID NO: 5979 - DNA, 15 bp, Homo sapiens
tgatactatgctggc

SEQ ID NO: 5980 - DNA, 15 bp, Homo sapiens
ctgatactatgctgg

SEQ ID NO: 5981 - DNA, 15 bp, Homo sapiens
tctgatactatgctg

SEQ ID NO: 5982 - DNA, 15 bp, Homo sapiens
ttctgatactatgct

SEQ ID NO: 5983 - DNA, 15 bp, Homo sapiens
tttctgatactatgc

SEQ ID NO: 5984 - DNA, 15 bp, Homo sapiens
atttctgatactatg

SEQ ID NO: 5985 - DNA, 15 bp, Homo sapiens
aatttctgatactat

SEQ ID NO: 5986 - DNA, 15 bp, Homo sapiens
taatttctgatacta

SEQ ID NO: 5987 - DNA, 15 bp, Homo sapiens
ctaatttctgatact

SEQ ID NO: 5988 - DNA, 15 bp, Homo sapiens
gctaatttctgatac

SEQ ID NO: 5989 - DNA, 15 bp, Homo sapiens
agctaatttctgata

SEQ ID NO: 5990 - DNA, 15 bp, Homo sapiens
tagctaatttctgat

SEQ ID NO: 5991 - DNA, 15 bp, Homo sapiens
ttagctaatttctga

SEQ ID NO: 5992 - DNA, 15 bp, Homo sapiens
attagctaatttctg

SEQ ID NO: 5993 - DNA, 15 bp, Homo sapiens
aattagctaatttct

SEQ ID NO: 5994 - DNA, 15 bp, Homo sapiens
gaattagctaatttc

SEQ ID NO: 5995 - DNA, 15 bp, Homo sapiens
tgaattagctaattt

SEQ ID NO: 5996 - DNA, 15 bp, Homo sapiens
atgaattagctaatt

SEQ ID NO: 5997 - DNA, 15 bp, Homo sapiens
tatgaattagctaat

SEQ ID NO: 5998 - DNA, 15 bp, Homo sapiens
atatgaattagctaa

SEQ ID NO: 5999 - DNA, 15 bp, Homo sapiens
catatgaattagcta

SEQ ID NO: 6000 - DNA, 15 bp, Homo sapiens
ccatatgaattagct

SEQ ID NO: 6001 - DNA, 15 bp, Homo sapiens
cccatatgaattagc

SEQ ID NO: 6002 - DNA, 15 bp, Homo sapiens
ccccatatgaattag

SEQ ID NO: 6003 - DNA, 15 bp, Homo sapiens
gccccatatgaatta

SEQ ID NO: 6004 - DNA, 15 bp, Homo sapiens
tgccccatatgaatt

SEQ ID NO: 6005 - DNA, 15 bp, Homo sapiens
ctgccccatatgaat

SEQ ID NO: 6006 - DNA, 15 bp, Homo sapiens
actgccccatatgaa

SEQ ID NO: 6007 - DNA, 15 bp, Homo sapiens
aactgccccatatga

SEQ ID NO: 6008 - DNA, 15 bp, Homo sapiens
aaactgccccatatg

SEQ ID NO: 6009 - DNA, 15 bp, Homo sapiens
taaactgccccatat

SEQ ID NO: 6010 - DNA, 15 bp, Homo sapiens
ctaaactgccccata

SEQ ID NO: 6011 - DNA, 15 bp, Homo sapiens
cctaaactgccccat

SEQ ID NO: 6012 - DNA, 15 bp, Homo sapiens
gcctaaactgcccca

SEQ ID NO: 6013 - DNA, 15 bp, Homo sapiens
agcctaaactgcccc

SEQ ID NO: 6014 - DNA, 15 bp, Homo sapiens
aagcctaaactgccc

SEQ ID NO: 6015 - DNA, 15 bp, Homo sapiens
aaagcctaaactgcc

SEQ ID NO: 6016 - DNA, 15 bp, Homo sapiens
taaagcctaaactgc

SEQ ID NO: 6017 - DNA, 15 bp, Homo sapiens
ttaaagcctaaactg

SEQ ID NO: 6018 - DNA, 15 bp, Homo sapiens
gttaaagcctaaact

SEQ ID NO: 6019 - DNA, 15 bp, Homo sapiens
agttaaagcctaaac

SEQ ID NO: 6020 - DNA, 15 bp, Homo sapiens
tagttaaagcctaaa

SEQ ID NO: 6021 - DNA, 15 bp, Homo sapiens
ctagttaaagcctaa

SEQ ID NO: 6022 - DNA, 15 bp, Homo sapiens
cctagttaaagccta

SEQ ID NO: 6023 - DNA, 15 bp, Homo sapiens
tcctagttaaagcct

SEQ ID NO: 6024 - DNA, 15 bp, Homo sapiens
ttcctagttaaagcc

SEQ ID NO: 6025 - DNA, 15 bp, Homo sapiens
tttcctagttaaagc

SEQ ID NO: 6026 - DNA, 15 bp, Homo sapiens
atttcctagttaaag

SEQ ID NO: 6027 - DNA, 15 bp, Homo sapiens
catttcctagttaaa

SEQ ID NO: 6028 - DNA, 15 bp, Homo sapiens
tcatttcctagttaa

SEQ ID NO: 6029 - DNA, 15 bp, Homo sapiens
atcatttcctagtta

SEQ ID NO: 6030 - DNA, 15 bp, Homo sapiens
catcatttcctagtt

SEQ ID NO: 6031 - DNA, 15 bp, Homo sapiens
ccatcatttcctagt

SEQ ID NO: 6032 - DNA, 15 bp, Homo sapiens
accatcatttcctag

SEQ ID NO: 6033 - DNA, 15 bp, Homo sapiens
aaccatcatttccta

SEQ ID NO: 6034 - DNA, 15 bp, Homo sapiens
taaccatcatttcct

SEQ ID NO: 6035 - DNA, 15 bp, Homo sapiens
ataaccatcatttcc

SEQ ID NO: 6036 - DNA, 15 bp, Homo sapiens
gataaccatcatttc

SEQ ID NO: 6037 - DNA, 15 bp, Homo sapiens
agataaccatcattt

SEQ ID NO: 6038 - DNA, 15 bp, Homo sapiens
aagataaccatcatt

SEQ ID NO: 6039 - DNA, 15 bp, Homo sapiens
taagataaccatcat

SEQ ID NO: 6040 - DNA, 15 bp, Homo sapiens
ttaagataaccatca

SEQ ID NO: 6041 - DNA, 15 bp, Homo sapiens
attaagataaccatc

SEQ ID NO: 6042 - DNA, 15 bp, Homo sapiens
cattaagataaccat

SEQ ID NO: 6043 - DNA, 15 bp, Homo sapiens
tcattaagataacca

SEQ ID NO: 6044 - DNA, 15 bp, Homo sapiens
gtcattaagataacc

SEQ ID NO: 6045 - DNA, 15 bp, Homo sapiens
tgtcattaagataac

SEQ ID NO: 6046 - DNA, 15 bp, Homo sapiens
ttgtcattaagataa

SEQ ID NO: 6047 - DNA, 15 bp, Homo sapiens
tttgtcattaagata

SEQ ID NO: 6048 - DNA, 15 bp, Homo sapiens
ttttgtcattaagat

SEQ ID NO: 6049 - DNA, 15 bp, Homo sapiens
tttttgtcattaaga

SEQ ID NO: 6050 - DNA, 15 bp, Homo sapiens
ttttttgtcattaag

SEQ ID NO: 6051 - DNA, 15 bp, Homo sapiens
cttttttgtcattaa

SEQ ID NO: 6052 - DNA, 15 bp, Homo sapiens
ccttttttgtcatta

SEQ ID NO: 6053 - DNA, 15 bp, Homo sapiens
accttttttgtcatt

SEQ ID NO: 6054 - DNA, 15 bp, Homo sapiens
taccttttttgtcat

SEQ ID NO: 6055 - DNA, 15 bp, Homo sapiens
gtaccttttttgtca

SEQ ID NO: 6056 - DNA, 15 bp, Homo sapiens
agtaccttttttgtc

SEQ ID NO: 6057 - DNA, 15 bp, Homo sapiens
cagtaccttttttgt

SEQ ID NO: 6058 - DNA, 15 bp, Homo sapiens
tcagtaccttttttg

SEQ ID NO: 6059 - DNA, 15 bp, Homo sapiens
gtcagtacctttttt

SEQ ID NO: 6060 - DNA, 15 bp, Homo sapiens
tgtcagtaccttttt

SEQ ID NO: 6061 - DNA, 15 bp, Homo sapiens
ttgtcagtacctttt

SEQ ID NO: 6062 - DNA, 15 bp, Homo sapiens
tttgtcagtaccttt

SEQ ID NO: 6063 - DNA, 15 bp, Homo sapiens
ttttgtcagtacctt

SEQ ID NO: 6064 - DNA, 15 bp, Homo sapiens
cttttgtcagtacct

SEQ ID NO: 6065 - DNA, 15 bp, Homo sapiens
acttttgtcagtacc

SEQ ID NO: 6066 - DNA, 15 bp, Homo sapiens
gacttttgtcagtac

SEQ ID NO: 6067 - DNA, 15 bp, Homo sapiens
ggacttttgtcagta

SEQ ID NO: 6068 - DNA, 15 bp, Homo sapiens
aggacttttgtcagt

SEQ ID NO: 6069 - DNA, 15 bp, Homo sapiens
aaggacttttgtcag

SEQ ID NO: 6070 - DNA, 15 bp, Homo sapiens
aaaggacttttgtca

SEQ ID NO: 6071 - DNA, 15 bp, Homo sapiens
aaaaggacttttgtc

SEQ ID NO: 6072 - DNA, 15 bp, Homo sapiens
aaaaaggacttttgt

SEQ ID NO: 6073 - DNA, 15 bp, Homo sapiens
aaaaaaggacttttg

SEQ ID NO: 6074 - DNA, 15 bp, Homo sapiens
caaaaaaggactttt

SEQ ID NO: 6075 - DNA, 15 bp, Homo sapiens
tcaaaaaaggacttt

SEQ ID NO: 6076 - DNA, 15 bp, Homo sapiens
ttcaaaaaaggactt

SEQ ID NO: 6077 - DNA, 15 bp, Homo sapiens
gttcaaaaaaggact

SEQ ID NO: 6078 - DNA, 15 bp, Homo sapiens
tgttcaaaaaaggac

SEQ ID NO: 6079 - DNA, 15 bp, Homo sapiens
atgttcaaaaaagga

SEQ ID NO: 6080 - DNA, 15 bp, Homo sapiens
catgttcaaaaaagg

SEQ ID NO: 6081 - DNA, 15 bp, Homo sapiens
acatgttcaaaaaag

SEQ ID NO: 6082 - DNA, 15 bp, Homo sapiens
cacatgttcaaaaaa

SEQ ID NO: 6083 - DNA, 15 bp, Homo sapiens
acacatgttcaaaaa

SEQ ID NO: 6084 - DNA, 15 bp, Homo sapiens
aacacatgttcaaaa

SEQ ID NO: 6085 - DNA, 15 bp, Homo sapiens
gaacacatgttcaaa

SEQ ID NO: 6086 - DNA, 15 bp, Homo sapiens
tgaacacatgttcaa

SEQ ID NO: 6087 - DNA, 15 bp, Homo sapiens
ttgaacacatgttca

SEQ ID NO: 6088 - DNA, 15 bp, Homo sapiens
tttgaacacatgttc

SEQ ID NO: 6089 - DNA, 15 bp, Homo sapiens
ttttgaacacatgtt

SEQ ID NO: 6090 - DNA, 15 bp, Homo sapiens
cttttgaacacatgt

SEQ ID NO: 6091 - DNA, 15 bp, Homo sapiens
tcttttgaacacatg

SEQ ID NO: 6092 - DNA, 15 bp, Homo sapiens
ttcttttgaacacat

SEQ ID NO: 6093 - DNA, 15 bp, Homo sapiens
tttcttttgaacaca

SEQ ID NO: 6094 - DNA, 15 bp, Homo sapiens
ttttcttttgaacac

SEQ ID NO: 6095 - DNA, 15 bp, Homo sapiens
tttttcttttgaaca

SEQ ID NO: 6096 - DNA, 15 bp, Homo sapiens
ctttttcttttgaac

SEQ ID NO: 6097 - DNA, 15 bp, Homo sapiens
tctttttcttttgaa

SEQ ID NO: 6098 - DNA, 15 bp, Homo sapiens
ctctttttcttttga

SEQ ID NO: 6099 - DNA, 15 bp, Homo sapiens
tctctttttcttttg

SEQ ID NO: 6100 - DNA, 15 bp, Homo sapiens
ttctctttttctttt

SEQ ID NO: 6101 - DNA, 15 bp, Homo sapiens
tttctctttttcttt

SEQ ID NO: 6102 - DNA, 15 bp, Homo sapiens
gtttctctttttctt

SEQ ID NO: 6103 - DNA, 15 bp, Homo sapiens
agtttctctttttct

SEQ ID NO: 6104 - DNA, 15 bp, Homo sapiens
tagtttctctttttc

SEQ ID NO: 6105 - DNA, 15 bp, Homo sapiens
atagtttctcttttt

SEQ ID NO: 6106 - DNA, 15 bp, Homo sapiens
gatagtttctctttt

SEQ ID NO: 6107 - DNA, 15 bp, Homo sapiens
tgatagtttctcttt

SEQ ID NO: 6108 - DNA, 15 bp, Homo sapiens
ttgatagtttctctt

SEQ ID NO: 6109 - DNA, 15 bp, Homo sapiens
tttgatagtttctct

SEQ ID NO: 6110 - DNA, 15 bp, Homo sapiens
gtttgatagtttctc

SEQ ID NO: 6111 - DNA, 15 bp, Homo sapiens
agtttgatagtttct

SEQ ID NO: 6112 - DNA, 15 bp, Homo sapiens
tagtttgatagtttc

SEQ ID NO: 6113 - DNA, 15 bp, Homo sapiens
ttagtttgatagttt

SEQ ID NO: 6114 - DNA, 15 bp, Homo sapiens
attagtttgatagtt

SEQ ID NO: 6115 - DNA, 15 bp, Homo sapiens
tattagtttgatagt

SEQ ID NO: 6116 - DNA, 15 bp, Homo sapiens
ttattagtttgatag

SEQ ID NO: 6117 - DNA, 15 bp, Homo sapiens
gttattagtttgata

SEQ ID NO: 6118 - DNA, 15 bp, Homo sapiens
agttattagtttgat

SEQ ID NO: 6119 - DNA, 15 bp, Homo sapiens
cagttattagtttga

SEQ ID NO: 6120 - DNA, 15 bp, Homo sapiens
tcagttattagtttg

SEQ ID NO: 6121 - DNA, 15 bp, Homo sapiens
ctcagttattagttt

SEQ ID NO: 6122 - DNA, 15 bp, Homo sapiens
actcagttattagtt

SEQ ID NO: 6123 - DNA, 15 bp, Homo sapiens
aactcagttattagt

SEQ ID NO: 6124 - DNA, 15 bp, Homo sapiens
aaactcagttattag

SEQ ID NO: 6125 - DNA, 15 bp, Homo sapiens
caaactcagttatta

SEQ ID NO: 6126 - DNA, 15 bp, Homo sapiens
acaaactcagttatt

SEQ ID NO: 6127 - DNA, 15 bp, Homo sapiens
aacaaactcagttat

SEQ ID NO: 6128 - DNA, 15 bp, Homo sapiens
caacaaactcagtta

SEQ ID NO: 6129 - DNA, 15 bp, Homo sapiens
tcaacaaactcagtt

SEQ ID NO: 6130 - DNA, 15 bp, Homo sapiens
ttcaacaaactcagt

SEQ ID NO: 6131 - DNA, 15 bp, Homo sapiens
gttcaacaaactcag

SEQ ID NO: 6132 - DNA, 15 bp, Homo sapiens
tgttcaacaaactca

SEQ ID NO: 6133 - DNA, 15 bp, Homo sapiens
atgttcaacaaactc

SEQ ID NO: 6134 - DNA, 15 bp, Homo sapiens
gatgttcaacaaact

SEQ ID NO: 6135 - DNA, 15 bp, Homo sapiens
cgatgttcaacaaac

SEQ ID NO: 6136 - DNA, 15 bp, Homo sapiens
tcgatgttcaacaaa

SEQ ID NO: 6137 - DNA, 15 bp, Homo sapiens
ctcgatgttcaacaa

SEQ ID NO: 6138 - DNA, 15 bp, Homo sapiens
tctcgatgttcaaca

SEQ ID NO: 6139 - DNA, 15 bp, Homo sapiens
atctcgatgttcaac

SEQ ID NO: 6140 - DNA, 15 bp, Homo sapiens
aatctcgatgttcaa

SEQ ID NO: 6141 - DNA, 15 bp, Homo sapiens
caatctcgatgttca

SEQ ID NO: 6142 - DNA, 15 bp, Homo sapiens
tcaatctcgatgttc

SEQ ID NO: 6143 - DNA, 15 bp, Homo sapiens
gtcaatctcgatgtt

SEQ ID NO: 6144 - DNA, 15 bp, Homo sapiens
agtcaatctcgatgt

SEQ ID NO: 6145 - DNA, 15 bp, Homo sapiens
cagtcaatctcgatg

SEQ ID NO: 6146 - DNA, 15 bp, Homo sapiens
tcagtcaatctcgat

SEQ ID NO: 6147 - DNA, 15 bp, Homo sapiens
atcagtcaatctcga

SEQ ID NO: 6148 - DNA, 15 bp, Homo sapiens
gatcagtcaatctcg

SEQ ID NO: 6149 - DNA, 15 bp, Homo sapiens
agatcagtcaatctc

SEQ ID NO: 6150 - DNA, 15 bp, Homo sapiens
cagatcagtcaatct

SEQ ID NO: 6151 - DNA, 15 bp, Homo sapiens
tcagatcagtcaatc

SEQ ID NO: 6152 - DNA, 15 bp, Homo sapiens
ctcagatcagtcaat

SEQ ID NO: 6153 - DNA, 15 bp, Homo sapiens
tctcagatcagtcaa

SEQ ID NO: 6154 - DNA, 15 bp, Homo sapiens
ctctcagatcagtca

SEQ ID NO: 6155 - DNA, 15 bp, Homo sapiens
cctctcagatcagtc

SEQ ID NO: 6156 - DNA, 15 bp, Homo sapiens
gcctctcagatcagt

SEQ ID NO: 6157 - DNA, 15 bp, Homo sapiens
agcctctcagatcag

SEQ ID NO: 6158 - DNA, 15 bp, Homo sapiens
aagcctctcagatca

SEQ ID NO: 6159 - DNA, 15 bp, Homo sapiens
taagcctctcagatc

SEQ ID NO: 6160 - DNA, 15 bp, Homo sapiens
ttaagcctctcagat

SEQ ID NO: 6161 - DNA, 15 bp, Homo sapiens
tttaagcctctcaga

SEQ ID NO: 6162 - DNA, 15 bp, Homo sapiens
ttttaagcctctcag

SEQ ID NO: 6163 - DNA, 15 bp, Homo sapiens
gttttaagcctctca

SEQ ID NO: 6164 - DNA, 15 bp, Homo sapiens
agttttaagcctctc

SEQ ID NO: 6165 - DNA, 15 bp, Homo sapiens
cagttttaagcctct

SEQ ID NO: 6166 - DNA, 15 bp, Homo sapiens
tcagttttaagcctc

SEQ ID NO: 6167 - DNA, 15 bp, Homo sapiens
atcagttttaagcct

SEQ ID NO: 6168 - DNA, 15 bp, Homo sapiens
aatcagttttaagcc

SEQ ID NO: 6169 - DNA, 15 bp, Homo sapiens
caatcagttttaagc

SEQ ID NO: 6170 - DNA, 15 bp, Homo sapiens
gcaatcagttttaag

SEQ ID NO: 6171 - DNA, 15 bp, Homo sapiens
ggcaatcagttttaa

SEQ ID NO: 6172 - DNA, 15 bp, Homo sapiens
gggcaatcagtttta

SEQ ID NO: 6173 - DNA, 15 bp, Homo sapiens
agggcaatcagtttt

SEQ ID NO: 6174 - DNA, 15 bp, Homo sapiens
cagggcaatcagttt

SEQ ID NO: 6175 - DNA, 15 bp, Homo sapiens
tcagggcaatcagtt

SEQ ID NO: 6176 - DNA, 15 bp, Homo sapiens
ttcagggcaatcagt

SEQ ID NO: 6177 - DNA, 15 bp, Homo sapiens
tttcagggcaatcag

SEQ ID NO: 6178 - DNA, 15 bp, Homo sapiens
atttcagggcaatca

SEQ ID NO: 6179 - DNA, 15 bp, Homo sapiens
tatttcagggcaatc

SEQ ID NO: 6180 - DNA, 15 bp, Homo sapiens
ctatttcagggcaat

SEQ ID NO: 6181 - DNA, 15 bp, Homo sapiens
tctatttcagggcaa

SEQ ID NO: 6182 - DNA, 15 bp, Homo sapiens
gtctatttcagggca

SEQ ID NO: 6183 - DNA, 15 bp, Homo sapiens
agtctatttcagggc

SEQ ID NO: 6184 - DNA, 15 bp, Homo sapiens
aagtctatttcaggg

SEQ ID NO: 6185 - DNA, 15 bp, Homo sapiens
caagtctatttcagg

SEQ ID NO: 6186 - DNA, 15 bp, Homo sapiens
gcaagtctatttcag

SEQ ID NO: 6187 - DNA, 15 bp, Homo sapiens
tgcaagtctatttca

SEQ ID NO: 6188 - DNA, 15 bp, Homo sapiens
atgcaagtctatttc

SEQ ID NO: 6189 - DNA, 15 bp, Homo sapiens
catgcaagtctattt

SEQ ID NO: 6190 - DNA, 15 bp, Homo sapiens
acatgcaagtctatt

SEQ ID NO: 6191 - DNA, 15 bp, Homo sapiens
aacatgcaagtctat

SEQ ID NO: 6192 - DNA, 15 bp, Homo sapiens
aaacatgcaagtcta

SEQ ID NO: 6193 - DNA, 15 bp, Homo sapiens
aaaacatgcaagtct

SEQ ID NO: 6194 - DNA, 15 bp, Homo sapiens
caaaacatgcaagtc

SEQ ID NO: 6195 - DNA, 15 bp, Homo sapiens
ccaaaacatgcaagt

SEQ ID NO: 6196 - DNA, 15 bp, Homo sapiens
tccaaaacatgcaag

SEQ ID NO: 6197 - DNA, 15 bp, Homo sapiens
atccaaaacatgcaa

SEQ ID NO: 6198 - DNA, 15 bp, Homo sapiens
catccaaaacatgca

SEQ ID NO: 6199 - DNA, 15 bp, Homo sapiens
tcatccaaaacatgc

SEQ ID NO: 6200 - DNA, 15 bp, Homo sapiens
atcatccaaaacatg

SEQ ID NO: 6201 - DNA, 15 bp, Homo sapiens
catcatccaaaacat

SEQ ID NO: 6202 - DNA, 15 bp, Homo sapiens
ccatcatccaaaaca

SEQ ID NO: 6203 - DNA, 15 bp, Homo sapiens
gccatcatccaaaac

SEQ ID NO: 6204 - DNA, 15 bp, Homo sapiens
agccatcatccaaaa

SEQ ID NO: 6205 - DNA, 15 bp, Homo sapiens
aagccatcatccaaa

SEQ ID NO: 6206 - DNA, 15 bp, Homo sapiens
aaagccatcatccaa

SEQ ID NO: 6207 - DNA, 15 bp, Homo sapiens
caaagccatcatcca

SEQ ID NO: 6208 - DNA, 15 bp, Homo sapiens
ccaaagccatcatcc

SEQ ID NO: 6209 - DNA, 15 bp, Homo sapiens
cccaaagccatcatc

SEQ ID NO: 6210 - DNA, 15 bp, Homo sapiens
acccaaagccatcat

SEQ ID NO: 6211 - DNA, 15 bp, Homo sapiens
gacccaaagccatca

SEQ ID NO: 6212 - DNA, 15 bp, Homo sapiens
agacccaaagccatc

SEQ ID NO: 6213 - DNA, 15 bp, Homo sapiens
gagacccaaagccat

SEQ ID NO: 6214 - DNA, 15 bp, Homo sapiens
ggagacccaaagcca

SEQ ID NO: 6215 - DNA, 15 bp, Homo sapiens
gggagacccaaagcc

SEQ ID NO: 6216 - DNA, 15 bp, Homo sapiens
tgggagacccaaagc

SEQ ID NO: 6217 - DNA, 15 bp, Homo sapiens
ctgggagacccaaag

SEQ ID NO: 6218 - DNA, 15 bp, Homo sapiens
tctgggagacccaaa

SEQ ID NO: 6219 - DNA, 15 bp, Homo sapiens
ctctgggagacccaa

SEQ ID NO: 6220 - DNA, 15 bp, Homo sapiens
gctctgggagaccca

SEQ ID NO: 6221 - DNA, 15 bp, Homo sapiens
tgctctgggagaccc

SEQ ID NO: 6222 - DNA, 15 bp, Homo sapiens
gtgctctgggagacc

SEQ ID NO: 6223 - DNA, 15 bp, Homo sapiens
agtgctctgggagac

SEQ ID NO: 6224 - DNA, 15 bp, Homo sapiens
aagtgctctgggaga

SEQ ID NO: 6225 - DNA, 15 bp, Homo sapiens
caagtgctctgggag

SEQ ID NO: 6226 - DNA, 15 bp, Homo sapiens
ccaagtgctctggga

SEQ ID NO: 6227 - DNA, 15 bp, Homo sapiens
accaagtgctctggg

SEQ ID NO: 6228 - DNA, 15 bp, Homo sapiens
aaccaagtgctctgg

SEQ ID NO: 6229 - DNA, 15 bp, Homo sapiens
aaaccaagtgctctg

SEQ ID NO: 6230 - DNA, 15 bp, Homo sapiens
gaaaccaagtgctct

SEQ ID NO: 6231 - DNA, 15 bp, Homo sapiens
ggaaaccaagtgctc

SEQ ID NO: 6232 - DNA, 15 bp, Homo sapiens
gggaaaccaagtgct

SEQ ID NO: 6233 - DNA, 15 bp, Homo sapiens
agggaaaccaagtgc

SEQ ID NO: 6234 - DNA, 15 bp, Homo sapiens
aagggaaaccaagtg

SEQ ID NO: 6235 - DNA, 15 bp, Homo sapiens
caagggaaaccaagt

SEQ ID NO: 6236 - DNA, 15 bp, Homo sapiens
ccaagggaaaccaag

SEQ ID NO: 6237 - DNA, 15 bp, Homo sapiens
accaagggaaaccaa

SEQ ID NO: 6238 - DNA, 15 bp, Homo sapiens
caccaagggaaacca

SEQ ID NO: 6239 - DNA, 15 bp, Homo sapiens
gcaccaagggaaacc

SEQ ID NO: 6240 - DNA, 15 bp, Homo sapiens
agcaccaagggaaac

SEQ ID NO: 6241 - DNA, 15 bp, Homo sapiens
cagcaccaagggaaa

SEQ ID NO: 6242 - DNA, 15 bp, Homo sapiens
tcagcaccaagggaa

SEQ ID NO: 6243 - DNA, 15 bp, Homo sapiens
atcagcaccaaggga

SEQ ID NO: 6244 - DNA, 15 bp, Homo sapiens
aatcagcaccaaggg

SEQ ID NO: 6245 - DNA, 15 bp, Homo sapiens
aaatcagcaccaagg

SEQ ID NO: 6246 - DNA, 15 bp, Homo sapiens
aaaatcagcaccaag

SEQ ID NO: 6247 - DNA, 15 bp, Homo sapiens
aaaaatcagcaccaa

SEQ ID NO: 6248 - DNA, 15 bp, Homo sapiens
aaaaaatcagcacca

SEQ ID NO: 6249 - DNA, 15 bp, Homo sapiens
gaaaaaatcagcacc

SEQ ID NO: 6250 - DNA, 15 bp, Homo sapiens
agaaaaaatcagcac

SEQ ID NO: 6251 - DNA, 15 bp, Homo sapiens
gagaaaaaatcagca

SEQ ID NO: 6252 - DNA, 15 bp, Homo sapiens
agagaaaaaatcagc

SEQ ID NO: 6253 - DNA, 15 bp, Homo sapiens
gagagaaaaaatcag

SEQ ID NO: 6254 - DNA, 15 bp, Homo sapiens
tgagagaaaaaatca

SEQ ID NO: 6255 - DNA, 15 bp, Homo sapiens
ctgagagaaaaaatc

SEQ ID NO: 6256 - DNA, 15 bp, Homo sapiens
cctgagagaaaaaat

SEQ ID NO: 6257 - DNA, 15 bp, Homo sapiens
tcctgagagaaaaaa

SEQ ID NO: 6258 - DNA, 15 bp, Homo sapiens
atcctgagagaaaaa

SEQ ID NO: 6259 - DNA, 15 bp, Homo sapiens
aatcctgagagaaaa

SEQ ID NO: 6260 - DNA, 15 bp, Homo sapiens
taatcctgagagaaa

SEQ ID NO: 6261 - DNA, 15 bp, Homo sapiens
ttaatcctgagagaa

SEQ ID NO: 6262 - DNA, 15 bp, Homo sapiens
tttaatcctgagaga

SEQ ID NO: 6263 - DNA, 15 bp, Homo sapiens
ctttaatcctgagag

SEQ ID NO: 6264 - DNA, 15 bp, Homo sapiens
gctttaatcctgaga

SEQ ID NO: 6265 - DNA, 15 bp, Homo sapiens
ggctttaatcctgag

SEQ ID NO: 6266 - DNA, 15 bp, Homo sapiens
gggctttaatcctga

SEQ ID NO: 6267 - DNA, 15 bp, Homo sapiens
ggggctttaatcctg

SEQ ID NO: 6268 - DNA, 15 bp, Homo sapiens
aggggctttaatcct

SEQ ID NO: 6269 - DNA, 15 bp, Homo sapiens
aaggggctttaatcc

SEQ ID NO: 6270 - DNA, 15 bp, Homo sapiens
aaaggggctttaatc

SEQ ID NO: 6271 - DNA, 15 bp, Homo sapiens
taaaggggctttaat

SEQ ID NO: 6272 - DNA, 15 bp, Homo sapiens
ataaaggggctttaa

SEQ ID NO: 6273 - DNA, 15 bp, Homo sapiens
cataaaggggcttta

SEQ ID NO: 6274 - DNA, 15 bp, Homo sapiens
acataaaggggcttt

SEQ ID NO: 6275 - DNA, 15 bp, Homo sapiens
cacataaaggggctt

SEQ ID NO: 6276 - DNA, 15 bp, Homo sapiens
tcacataaaggggct

SEQ ID NO: 6277 - DNA, 15 bp, Homo sapiens
atcacataaaggggc

SEQ ID NO: 6278 - DNA, 15 bp, Homo sapiens
catcacataaagggg

SEQ ID NO: 6279 - DNA, 15 bp, Homo sapiens
acatcacataaaggg

SEQ ID NO: 6280 - DNA, 15 bp, Homo sapiens
aacatcacataaagg

SEQ ID NO: 6281 - DNA, 15 bp, Homo sapiens
caacatcacataaag

SEQ ID NO: 6282 - DNA, 15 bp, Homo sapiens
acaacatcacataaa

SEQ ID NO: 6283 - DNA, 15 bp, Homo sapiens
aacaacatcacataa

SEQ ID NO: 6284 - DNA, 15 bp, Homo sapiens
taacaacatcacata

SEQ ID NO: 6285 - DNA, 15 bp, Homo sapiens
gtaacaacatcacat

SEQ ID NO: 6286 - DNA, 15 bp, Homo sapiens
tgtaacaacatcaca

SEQ ID NO: 6287 - DNA, 15 bp, Homo sapiens
ctgtaacaacatcac

SEQ ID NO: 6288 - DNA, 15 bp, Homo sapiens
gctgtaacaacatca

SEQ ID NO: 6289 - DNA, 15 bp, Homo sapiens
tgctgtaacaacatc

SEQ ID NO: 6290 - DNA, 15 bp, Homo sapiens
ctgctgtaacaacat

SEQ ID NO: 6291 - DNA, 15 bp, Homo sapiens
gctgctgtaacaaca

SEQ ID NO: 6292 - DNA, 15 bp, Homo sapiens
agctgctgtaacaac

SEQ ID NO: 6293 - DNA, 15 bp, Homo sapiens
aagctgctgtaacaa

SEQ ID NO: 6294 - DNA, 15 bp, Homo sapiens
taagctgctgtaaca

SEQ ID NO: 6295 - DNA, 15 bp, Homo sapiens
ataagctgctgtaac

SEQ ID NO: 6296 - DNA, 15 bp, Homo sapiens
aataagctgctgtaa

SEQ ID NO: 6297 - DNA, 15 bp, Homo sapiens
caataagctgctgta

SEQ ID NO: 6298 - DNA, 15 bp, Homo sapiens
gcaataagctgctgt

SEQ ID NO: 6299 - DNA, 15 bp, Homo sapiens
tgcaataagctgctg

SEQ ID NO: 6300 - DNA, 15 bp, Homo sapiens
ttgcaataagctgct

SEQ ID NO: 6301 - DNA, 15 bp, Homo sapiens
gttgcaataagctgc

SEQ ID NO: 6302 - DNA, 15 bp, Homo sapiens
agttgcaataagctg

SEQ ID NO: 6303 - DNA, 15 bp, Homo sapiens
aagttgcaataagct

SEQ ID NO: 6304 - DNA, 15 bp, Homo sapiens
gaagttgcaataagc

SEQ ID NO: 6305 - DNA, 15 bp, Homo sapiens
tgaagttgcaataag

SEQ ID NO: 6306 - DNA, 15 bp, Homo sapiens
atgaagttgcaataa

SEQ ID NO: 6307 - DNA, 15 bp, Homo sapiens
aatgaagttgcaata

SEQ ID NO: 6308 - DNA, 15 bp, Homo sapiens
gaatgaagttgcaat

SEQ ID NO: 6309 - DNA, 15 bp, Homo sapiens
tgaatgaagttgcaa

SEQ ID NO: 6310 - DNA, 15 bp, Homo sapiens
ctgaatgaagttgca

SEQ ID NO: 6311 - DNA, 15 bp, Homo sapiens
gctgaatgaagttgc

SEQ ID NO: 6312 - DNA, 15 bp, Homo sapiens
agctgaatgaagttg

SEQ ID NO: 6313 - DNA, 15 bp, Homo sapiens
cagctgaatgaagtt

SEQ ID NO: 6314 - DNA, 15 bp, Homo sapiens
gcagctgaatgaagt

SEQ ID NO: 6315 - DNA, 15 bp, Homo sapiens
agcagctgaatgaag

SEQ ID NO: 6316 - DNA, 15 bp, Homo sapiens
aagcagctgaatgaa

SEQ ID NO: 6317 - DNA, 15 bp, Homo sapiens
caagcagctgaatga

SEQ ID NO: 6318 - DNA, 15 bp, Homo sapiens
tcaagcagctgaatg

SEQ ID NO: 6319 - DNA, 15 bp, Homo sapiens
ttcaagcagctgaat

SEQ ID NO: 6320 - DNA, 15 bp, Homo sapiens
tttcaagcagctgaa

SEQ ID NO: 6321 - DNA, 15 bp, Homo sapiens
ttttcaagcagctga

SEQ ID NO: 6322 - DNA, 15 bp, Homo sapiens
tttttcaagcagctg

SEQ ID NO: 6323 - DNA, 15 bp, Homo sapiens
ctttttcaagcagct

SEQ ID NO: 6324 - DNA, 15 bp, Homo sapiens
tctttttcaagcagc

SEQ ID NO: 6325 - DNA, 15 bp, Homo sapiens
ttctttttcaagcag

SEQ ID NO: 6326 - DNA, 15 bp, Homo sapiens
cttctttttcaagca

SEQ ID NO: 6327 - DNA, 15 bp, Homo sapiens
ccttctttttcaagc

SEQ ID NO: 6328 - DNA, 15 bp, Homo sapiens
cccttctttttcaag

SEQ ID NO: 6329 - DNA, 15 bp, Homo sapiens
tcccttctttttcaa

SEQ ID NO: 6330 - DNA, 15 bp, Homo sapiens
ctcccttctttttca

SEQ ID NO: 6331 - DNA, 15 bp, Homo sapiens
tctcccttctttttc

SEQ ID NO: 6332 - DNA, 15 bp, Homo sapiens
gtctcccttcttttt

SEQ ID NO: 6333 - DNA, 15 bp, Homo sapiens
agtctcccttctttt

SEQ ID NO: 6334 - DNA, 15 bp, Homo sapiens
cagtctcccttcttt

SEQ ID NO: 6335 - DNA, 15 bp, Homo sapiens
gcagtctcccttctt

SEQ ID NO: 6336 - DNA, 15 bp, Homo sapiens
ggcagtctcccttct

SEQ ID NO: 6337 - DNA, 15 bp, Homo sapiens
aggcagtctcccttc

SEQ ID NO: 6338 - DNA, 15 bp, Homo sapiens
gaggcagtctccctt

SEQ ID NO: 6339 - DNA, 15 bp, Homo sapiens
agaggcagtctccct

SEQ ID NO: 6340 - DNA, 15 bp, Homo sapiens
tagaggcagtctccc

SEQ ID NO: 6341 - DNA, 15 bp, Homo sapiens
ctagaggcagtctcc

SEQ ID NO: 6342 - DNA, 15 bp, Homo sapiens
cctagaggcagtctc

SEQ ID NO: 6343 - DNA, 15 bp, Homo sapiens
acctagaggcagtct

SEQ ID NO: 6344 - DNA, 15 bp, Homo sapiens
aacctagaggcagtc

SEQ ID NO: 6345 - DNA, 15 bp, Homo sapiens
gaacctagaggcagt

SEQ ID NO: 6346 - DNA, 15 bp, Homo sapiens
ggaacctagaggcag

SEQ ID NO: 6347 - DNA, 15 bp, Homo sapiens
tggaacctagaggca

SEQ ID NO: 6348 - DNA, 15 bp, Homo sapiens
atggaacctagaggc

SEQ ID NO: 6349 - DNA, 15 bp, Homo sapiens
catggaacctagagg

SEQ ID NO: 6350 - DNA, 15 bp, Homo sapiens
acatggaacctagag

SEQ ID NO: 6351 - DNA, 15 bp, Homo sapiens
cacatggaacctaga

SEQ ID NO: 6352 - DNA, 15 bp, Homo sapiens
acacatggaacctag

SEQ ID NO: 6353 - DNA, 15 bp, Homo sapiens
aacacatggaaccta

SEQ ID NO: 6354 - DNA, 15 bp, Homo sapiens
gaacacatggaacct

SEQ ID NO: 6355 - DNA, 15 bp, Homo sapiens
agaacacatggaacc

SEQ ID NO: 6356 - DNA, 15 bp, Homo sapiens
aagaacacatggaac

SEQ ID NO: 6357 - DNA, 15 bp, Homo sapiens
aaagaacacatggaa

SEQ ID NO: 6358 - DNA, 15 bp, Homo sapiens
gaaagaacacatgga

SEQ ID NO: 6359 - DNA, 15 bp, Homo sapiens
tgaaagaacacatgg

SEQ ID NO: 6360 - DNA, 15 bp, Homo sapiens
ctgaaagaacacatg

SEQ ID NO: 6361 - DNA, 15 bp, Homo sapiens
cctgaaagaacacat

SEQ ID NO: 6362 - DNA, 15 bp, Homo sapiens
ccctgaaagaacaca

SEQ ID NO: 6363 - DNA, 15 bp, Homo sapiens
tccctgaaagaacac

SEQ ID NO: 6364 - DNA, 15 bp, Homo sapiens
atccctgaaagaaca

SEQ ID NO: 6365 - DNA, 15 bp, Homo sapiens
catccctgaaagaac

SEQ ID NO: 6366 - DNA, 15 bp, Homo sapiens
ccatccctgaaagaa

SEQ ID NO: 6367 - DNA, 15 bp, Homo sapiens
accatccctgaaaga

SEQ ID NO: 6368 - DNA, 15 bp, Homo sapiens
taccatccctgaaag

SEQ ID NO: 6369 - DNA, 15 bp, Homo sapiens
ataccatccctgaaa

SEQ ID NO: 6370 - DNA, 15 bp, Homo sapiens
aataccatccctgaa

SEQ ID NO: 6371 - DNA, 15 bp, Homo sapiens
aaataccatccctga

SEQ ID NO: 6372 - DNA, 15 bp, Homo sapiens
aaaataccatccctg

SEQ ID NO: 6373 - DNA, 15 bp, Homo sapiens
caaaataccatccct

SEQ ID NO: 6374 - DNA, 15 bp, Homo sapiens
tcaaaataccatccc

SEQ ID NO: 6375 - DNA, 15 bp, Homo sapiens
atcaaaataccatcc

SEQ ID NO: 6376 - DNA, 15 bp, Homo sapiens
catcaaaataccatc

SEQ ID NO: 6377 - DNA, 15 bp, Homo sapiens
acatcaaaataccat

SEQ ID NO: 6378 - DNA, 15 bp, Homo sapiens
aacatcaaaatacca

SEQ ID NO: 6379 - DNA, 15 bp, Homo sapiens
caacatcaaaatacc

SEQ ID NO: 6380 - DNA, 15 bp, Homo sapiens
gcaacatcaaaatac

SEQ ID NO: 6381 - DNA, 15 bp, Homo sapiens
cgcaacatcaaaata

SEQ ID NO: 6382 - DNA, 15 bp, Homo sapiens
acgcaacatcaaaat

SEQ ID NO: 6383 - DNA, 15 bp, Homo sapiens
tacgcaacatcaaaa

SEQ ID NO: 6384 - DNA, 15 bp, Homo sapiens
atacgcaacatcaaa

SEQ ID NO: 6385 - DNA, 15 bp, Homo sapiens
aatacgcaacatcaa

SEQ ID NO: 6386 - DNA, 15 bp, Homo sapiens
gaatacgcaacatca

SEQ ID NO: 6387 - DNA, 15 bp, Homo sapiens
agaatacgcaacatc

SEQ ID NO: 6388 - DNA, 15 bp, Homo sapiens
gagaatacgcaacat

SEQ ID NO: 6389 - DNA, 15 bp, Homo sapiens
agagaatacgcaaca

SEQ ID NO: 6390 - DNA, 15 bp, Homo sapiens
aagagaatacgcaac

SEQ ID NO: 6391 - DNA, 15 bp, Homo sapiens
caagagaatacgcaa

SEQ ID NO: 6392 - DNA, 15 bp, Homo sapiens
tcaagagaatacgca

SEQ ID NO: 6393 - DNA, 15 bp, Homo sapiens
ttcaagagaatacgc

SEQ ID NO: 6394 - DNA, 15 bp, Homo sapiens
gttcaagagaatacg

SEQ ID NO: 6395 - DNA, 15 bp, Homo sapiens
tgttcaagagaatac

SEQ ID NO: 6396 - DNA, 15 bp, Homo sapiens
atgttcaagagaata

SEQ ID NO: 6397 - DNA, 15 bp, Homo sapiens
catgttcaagagaat

SEQ ID NO: 6398 - DNA, 15 bp, Homo sapiens
acatgttcaagagaa

SEQ ID NO: 6399 - DNA, 15 bp, Homo sapiens
tacatgttcaagaga

SEQ ID NO: 6400 - DNA, 15 bp, Homo sapiens
atacatgttcaagag

SEQ ID NO: 6401 - DNA, 15 bp, Homo sapiens
aatacatgttcaaga

SEQ ID NO: 6402 - DNA, 15 bp, Homo sapiens
gaatacatgttcaag

SEQ ID NO: 6403 - DNA, 15 bp, Homo sapiens
agaatacatgttcaa

SEQ ID NO: 6404 - DNA, 15 bp, Homo sapiens
aagaatacatgttca

SEQ ID NO: 6405 - DNA, 15 bp, Homo sapiens
gaagaatacatgttc

SEQ ID NO: 6406 - DNA, 15 bp, Homo sapiens
ggaagaatacatgtt

SEQ ID NO: 6407 - DNA, 15 bp, Homo sapiens
gggaagaatacatgt

SEQ ID NO: 6408 - DNA, 15 bp, Homo sapiens
agggaagaatacatg

SEQ ID NO: 6409 - DNA, 15 bp, Homo sapiens
cagggaagaatacat

SEQ ID NO: 6410 - DNA, 15 bp, Homo sapiens
tcagggaagaataca

SEQ ID NO: 6411 - DNA, 15 bp, Homo sapiens
ctcagggaagaatac

SEQ ID NO: 6412 - DNA, 15 bp, Homo sapiens
tctcagggaagaata

SEQ ID NO: 6413 - DNA, 15 bp, Homo sapiens
ttctcagggaagaat

SEQ ID NO: 6414 - DNA, 15 bp, Homo sapiens
attctcagggaagaa

SEQ ID NO: 6415 - DNA, 15 bp, Homo sapiens
aattctcagggaaga

SEQ ID NO: 6416 - DNA, 15 bp, Homo sapiens
aaattctcagggaag

SEQ ID NO: 6417 - DNA, 15 bp, Homo sapiens
gaaattctcagggaa

SEQ ID NO: 6418 - DNA, 15 bp, Homo sapiens
agaaattctcaggga

SEQ ID NO: 6419 - DNA, 15 bp, Homo sapiens
cagaaattctcaggg

SEQ ID NO: 6420 - DNA, 15 bp, Homo sapiens
acagaaattctcagg

SEQ ID NO: 6421 - DNA, 15 bp, Homo sapiens
cacagaaattctcag

SEQ ID NO: 6422 - DNA, 15 bp, Homo sapiens
acacagaaattctca

SEQ ID NO: 6423 - DNA, 15 bp, Homo sapiens
cacacagaaattctc

SEQ ID NO: 6424 - DNA, 15 bp, Homo sapiens
gcacacagaaattct

SEQ ID NO: 6425 - DNA, 15 bp, Homo sapiens
ggcacacagaaattc

SEQ ID NO: 6426 - DNA, 15 bp, Homo sapiens
cggcacacagaaatt

SEQ ID NO: 6427 - DNA, 15 bp, Homo sapiens
acggcacacagaaat

SEQ ID NO: 6428 - DNA, 15 bp, Homo sapiens
cacggcacacagaaa

SEQ ID NO: 6429 - DNA, 15 bp, Homo sapiens
ccacggcacacagaa

SEQ ID NO: 6430 - DNA, 15 bp, Homo sapiens
accacggcacacaga

SEQ ID NO: 6431 - DNA, 15 bp, Homo sapiens
taccacggcacacag

SEQ ID NO: 6432 - DNA, 15 bp, Homo sapiens
ctaccacggcacaca

SEQ ID NO: 6433 - DNA, 15 bp, Homo sapiens
tctaccacggcacac

SEQ ID NO: 6434 - DNA, 15 bp, Homo sapiens
ttctaccacggcaca

SEQ ID NO: 6435 - DNA, 15 bp, Homo sapiens
cttctaccacggcac

SEQ ID NO: 6436 - DNA, 15 bp, Homo sapiens
tcttctaccacggca

SEQ ID NO: 6437 - DNA, 15 bp, Homo sapiens
ttcttctaccacggc

SEQ ID NO: 6438 - DNA, 15 bp, Homo sapiens
tttcttctaccacgg

SEQ ID NO: 6439 - DNA, 15 bp, Homo sapiens
atttcttctaccacg

SEQ ID NO: 6440 - DNA, 15 bp, Homo sapiens
tatttcttctaccac

SEQ ID NO: 6441 - DNA, 15 bp, Homo sapiens
gtatttcttctacca

SEQ ID NO: 6442 - DNA, 15 bp, Homo sapiens
agtatttcttctacc

SEQ ID NO: 6443 - DNA, 15 bp, Homo sapiens
aagtatttcttctac

SEQ ID NO: 6444 - DNA, 15 bp, Homo sapiens
caagtatttcttcta

SEQ ID NO: 6445 - DNA, 15 bp, Homo sapiens
gcaagtatttcttct

SEQ ID NO: 6446 - DNA, 15 bp, Homo sapiens
ggcaagtatttcttc

SEQ ID NO: 6447 - DNA, 15 bp, Homo sapiens
tggcaagtatttctt

SEQ ID NO: 6448 - DNA, 15 bp, Homo sapiens
ctggcaagtatttct

SEQ ID NO: 6449 - DNA, 15 bp, Homo sapiens
tctggcaagtatttc

SEQ ID NO: 6450 - DNA, 15 bp, Homo sapiens
ttctggcaagtattt

SEQ ID NO: 6451 - DNA, 15 bp, Homo sapiens
tttctggcaagtatt

SEQ ID NO: 6452 - DNA, 15 bp, Homo sapiens
atttctggcaagtat

SEQ ID NO: 6453 - DNA, 15 bp, Homo sapiens
gatttctggcaagta

SEQ ID NO: 6454 - DNA, 15 bp, Homo sapiens
cgatttctggcaagt

SEQ ID NO: 6455 - DNA, 15 bp, Homo sapiens
gcgatttctggcaag

SEQ ID NO: 6456 - DNA, 15 bp, Homo sapiens
ggcgatttctggcaa

SEQ ID NO: 6457 - DNA, 15 bp, Homo sapiens
tggcgatttctggca

SEQ ID NO: 6458 - DNA, 15 bp, Homo sapiens
gtggcgatttctggc

SEQ ID NO: 6459 - DNA, 15 bp, Homo sapiens
agtggcgatttctgg

SEQ ID NO: 6460 - DNA, 15 bp, Homo sapiens
gagtggcgatttctg

SEQ ID NO: 6461 - DNA, 15 bp, Homo sapiens
tgagtggcgatttct

SEQ ID NO: 6462 - DNA, 15 bp, Homo sapiens
atgagtggcgatttc

SEQ ID NO: 6463 - DNA, 15 bp, Homo sapiens
catgagtggcgattt

SEQ ID NO: 6464 - DNA, 15 bp, Homo sapiens
ccatgagtggcgatt

SEQ ID NO: 6465 - DNA, 15 bp, Homo sapiens
accatgagtggcgat

SEQ ID NO: 6466 - DNA, 15 bp, Homo sapiens
taccatgagtggcga

SEQ ID NO: 6467 - DNA, 15 bp, Homo sapiens
ataccatgagtggcg

SEQ ID NO: 6468 - DNA, 15 bp, Homo sapiens
cataccatgagtggc

SEQ ID NO: 6469 - DNA, 15 bp, Homo sapiens
gcataccatgagtgg

SEQ ID NO: 6470 - DNA, 15 bp, Homo sapiens
agcataccatgagtg

SEQ ID NO: 6471 - DNA, 15 bp, Homo sapiens
aagcataccatgagt

SEQ ID NO: 6472 - DNA, 15 bp, Homo sapiens
aaagcataccatgag

SEQ ID NO: 6473 - DNA, 15 bp, Homo sapiens
aaaagcataccatga

SEQ ID NO: 6474 - DNA, 15 bp, Homo sapiens
caaaagcataccatg

SEQ ID NO: 6475 - DNA, 15 bp, Homo sapiens
acaaaagcataccat

SEQ ID NO: 6476 - DNA, 15 bp, Homo sapiens
tacaaaagcatacca

SEQ ID NO: 6477 - DNA, 15 bp, Homo sapiens
ctacaaaagcatacc

SEQ ID NO: 6478 - DNA, 15 bp, Homo sapiens
actacaaaagcatac

SEQ ID NO: 6479 - DNA, 15 bp, Homo sapiens
cactacaaaagcata

SEQ ID NO: 6480 - DNA, 15 bp, Homo sapiens
acactacaaaagcat

SEQ ID NO: 6481 - DNA, 15 bp, Homo sapiens
gacactacaaaagca

SEQ ID NO: 6482 - DNA, 15 bp, Homo sapiens
cgacactacaaaagc

SEQ ID NO: 6483 - DNA, 15 bp, Homo sapiens
tcgacactacaaaag

SEQ ID NO: 6484 - DNA, 15 bp, Homo sapiens
ttcgacactacaaaa

SEQ ID NO: 6485 - DNA, 15 bp, Homo sapiens
cttcgacactacaaa

SEQ ID NO: 6486 - DNA, 15 bp, Homo sapiens
acttcgacactacaa

SEQ ID NO: 6487 - DNA, 15 bp, Homo sapiens
cacttcgacactaca

SEQ ID NO: 6488 - DNA, 15 bp, Homo sapiens
acacttcgacactac

SEQ ID NO: 6489 - DNA, 15 bp, Homo sapiens
gacacttcgacacta

SEQ ID NO: 6490 - DNA, 15 bp, Homo sapiens
ggacacttcgacact

SEQ ID NO: 6491 - DNA, 15 bp, Homo sapiens
gggacacttcgacac

SEQ ID NO: 6492 - DNA, 15 bp, Homo sapiens
ggggacacttcgaca

SEQ ID NO: 6493 - DNA, 15 bp, Homo sapiens
aggggacacttcgac

SEQ ID NO: 6494 - DNA, 15 bp, Homo sapiens
taggggacacttcga

SEQ ID NO: 6495 - DNA, 15 bp, Homo sapiens
ctaggggacacttcg

SEQ ID NO: 6496 - DNA, 15 bp, Homo sapiens
tctaggggacacttc

SEQ ID NO: 6497 - DNA, 15 bp, Homo sapiens
ctctaggggacactt

SEQ ID NO: 6498 - DNA, 15 bp, Homo sapiens
cctctaggggacact

SEQ ID NO: 6499 - DNA, 15 bp, Homo sapiens
acctctaggggacac

SEQ ID NO: 6500 - DNA, 15 bp, Homo sapiens
cacctctaggggaca

SEQ ID NO: 6501 - DNA, 15 bp, Homo sapiens
tcacctctaggggac

SEQ ID NO: 6502 - DNA, 15 bp, Homo sapiens
gtcacctctagggga

SEQ ID NO: 6503 - DNA, 15 bp, Homo sapiens
tgtcacctctagggg

SEQ ID NO: 6504 - DNA, 15 bp, Homo sapiens
ttgtcacctctaggg

SEQ ID NO: 6505 - DNA, 15 bp, Homo sapiens
cttgtcacctctagg

SEQ ID NO: 6506 - DNA, 15 bp, Homo sapiens
ccttgtcacctctag

SEQ ID NO: 6507 - DNA, 15 bp, Homo sapiens
gccttgtcacctcta

SEQ ID NO: 6508 - DNA, 15 bp, Homo sapiens
agccttgtcacctct

SEQ ID NO: 6509 - DNA, 15 bp, Homo sapiens
aagccttgtcacctc

SEQ ID NO: 6510 - DNA, 15 bp, Homo sapiens
caagccttgtcacct

SEQ ID NO: 6511 - DNA, 15 bp, Homo sapiens
acaagccttgtcacc

SEQ ID NO: 6512 - DNA, 15 bp, Homo sapiens
cacaagccttgtcac

SEQ ID NO: 6513 - DNA, 15 bp, Homo sapiens
tcacaagccttgtca

SEQ ID NO: 6514 - DNA, 15 bp, Homo sapiens
atcacaagccttgtc

SEQ ID NO: 6515 - DNA, 15 bp, Homo sapiens
tatcacaagccttgt

SEQ ID NO: 6516 - DNA, 15 bp, Homo sapiens
ctatcacaagccttg

SEQ ID NO: 6517 - DNA, 15 bp, Homo sapiens
actatcacaagcctt

SEQ ID NO: 6518 - DNA, 15 bp, Homo sapiens
cactatcacaagcct

SEQ ID NO: 6519 - DNA, 15 bp, Homo sapiens
acactatcacaagcc

SEQ ID NO: 6520 - DNA, 15 bp, Homo sapiens
aacactatcacaagc

SEQ ID NO: 6521 - DNA, 15 bp, Homo sapiens
caacactatcacaag

SEQ ID NO: 6522 - DNA, 15 bp, Homo sapiens
tcaacactatcacaa

SEQ ID NO: 6523 - DNA, 15 bp, Homo sapiens
atcaacactatcaca

SEQ ID NO: 6524 - DNA, 15 bp, Homo sapiens
aatcaacactatcac

SEQ ID NO: 6525 - DNA, 15 bp, Homo sapiens
gaatcaacactatca

SEQ ID NO: 6526 - DNA, 15 bp, Homo sapiens
agaatcaacactatc

SEQ ID NO: 6527 - DNA, 15 bp, Homo sapiens
tagaatcaacactat

SEQ ID NO: 6528 - DNA, 15 bp, Homo sapiens
ttagaatcaacacta

SEQ ID NO: 6529 - DNA, 15 bp, Homo sapiens
gttagaatcaacact

SEQ ID NO: 6530 - DNA, 15 bp, Homo sapiens
tgttagaatcaacac

SEQ ID NO: 6531 - DNA, 15 bp, Homo sapiens
ttgttagaatcaaca

SEQ ID NO: 6532 - DNA, 15 bp, Homo sapiens
cttgttagaatcaac

SEQ ID NO: 6533 - DNA, 15 bp, Homo sapiens
gcttgttagaatcaa

SEQ ID NO: 6534 - DNA, 15 bp, Homo sapiens
tgcttgttagaatca

SEQ ID NO: 6535 - DNA, 15 bp, Homo sapiens
atgcttgttagaatc

SEQ ID NO: 6536 - DNA, 15 bp, Homo sapiens
catgcttgttagaat

SEQ ID NO: 6537 - DNA, 15 bp, Homo sapiens
tcatgcttgttagaa

SEQ ID NO: 6538 - DNA, 15 bp, Homo sapiens
ttcatgcttgttaga

SEQ ID NO: 6539 - DNA, 15 bp, Homo sapiens
attcatgcttgttag

SEQ ID NO: 6540 - DNA, 15 bp, Homo sapiens
gattcatgcttgtta

SEQ ID NO: 6541 - DNA, 15 bp, Homo sapiens
agattcatgcttgtt

SEQ ID NO: 6542 - DNA, 15 bp, Homo sapiens
aagattcatgcttgt

SEQ ID NO: 6543 - DNA, 15 bp, Homo sapiens
aaagattcatgcttg

SEQ ID NO: 6544 - DNA, 15 bp, Homo sapiens
gaaagattcatgctt

SEQ ID NO: 6545 - DNA, 15 bp, Homo sapiens
ggaaagattcatgct

SEQ ID NO: 6546 - DNA, 15 bp, Homo sapiens
aggaaagattcatgc

SEQ ID NO: 6547 - DNA, 15 bp, Homo sapiens
aaggaaagattcatg

SEQ ID NO: 6548 - DNA, 15 bp, Homo sapiens
aaaggaaagattcat

SEQ ID NO: 6549 - DNA, 15 bp, Homo sapiens
taaaggaaagattca

SEQ ID NO: 6550 - DNA, 15 bp, Homo sapiens
ataaaggaaagattc

SEQ ID NO: 6551 - DNA, 15 bp, Homo sapiens
aataaaggaaagatt

SEQ ID NO: 6552 - DNA, 15 bp, Homo sapiens
aaataaaggaaagat

SEQ ID NO: 6553 - DNA, 15 bp, Homo sapiens
aaaataaaggaaaga

SEQ ID NO: 6554 - DNA, 15 bp, Homo sapiens
taaaataaaggaaag

SEQ ID NO: 6555 - DNA, 15 bp, Homo sapiens
ctaaaataaaggaaa

SEQ ID NO: 6556 - DNA, 15 bp, Homo sapiens
gctaaaataaaggaa

SEQ ID NO: 6557 - DNA, 15 bp, Homo sapiens
tgctaaaataaagga

SEQ ID NO: 6558 - DNA, 15 bp, Homo sapiens
gtgctaaaataaagg

SEQ ID NO: 6559 - DNA, 15 bp, Homo sapiens
agtgctaaaataaag

SEQ ID NO: 6560 - DNA, 15 bp, Homo sapiens
cagtgctaaaataaa

SEQ ID NO: 6561 - DNA, 15 bp, Homo sapiens
acagtgctaaaataa

SEQ ID NO: 6562 - DNA, 15 bp, Homo sapiens
cacagtgctaaaata

SEQ ID NO: 6563 - DNA, 15 bp, Homo sapiens
acacagtgctaaaat

SEQ ID NO: 6564 - DNA, 15 bp, Homo sapiens
cacacagtgctaaaa

SEQ ID NO: 6565 - DNA, 15 bp, Homo sapiens
acacacagtgctaaa

SEQ ID NO: 6566 - DNA, 15 bp, Homo sapiens
aacacacagtgctaa

SEQ ID NO: 6567 - DNA, 15 bp, Homo sapiens
taacacacagtgcta

SEQ ID NO: 6568 - DNA, 15 bp, Homo sapiens
gtaacacacagtgct

SEQ ID NO: 6569 - DNA, 15 bp, Homo sapiens
cgtaacacacagtgc

SEQ ID NO: 6570 - DNA, 15 bp, Homo sapiens
acgtaacacacagtg

SEQ ID NO: 6571 - DNA, 15 bp, Homo sapiens
cacgtaacacacagt

SEQ ID NO: 6572 - DNA, 15 bp, Homo sapiens
gcacgtaacacacag

SEQ ID NO: 6573 - DNA, 15 bp, Homo sapiens
ggcacgtaacacaca

SEQ ID NO: 6574 - DNA, 15 bp, Homo sapiens
tggcacgtaacacac

SEQ ID NO: 6575 - DNA, 15 bp, Homo sapiens
ctggcacgtaacaca

SEQ ID NO: 6576 - DNA, 15 bp, Homo sapiens
actggcacgtaacac

SEQ ID NO: 6577 - DNA, 15 bp, Homo sapiens
tactggcacgtaaca

SEQ ID NO: 6578 - DNA, 15 bp, Homo sapiens
ttactggcacgtaac

SEQ ID NO: 6579 - DNA, 15 bp, Homo sapiens
attactggcacgtaa

SEQ ID NO: 6580 - DNA, 15 bp, Homo sapiens
aattactggcacgta

SEQ ID NO: 6581 - DNA, 15 bp, Homo sapiens
aaattactggcacgt

SEQ ID NO: 6582 - DNA, 15 bp, Homo sapiens
caaattactggcacg

SEQ ID NO: 6583 - DNA, 15 bp, Homo sapiens
gcaaattactggcac

SEQ ID NO: 6584 - DNA, 15 bp, Homo sapiens
tgcaaattactggca

SEQ ID NO: 6585 - DNA, 15 bp, Homo sapiens
ctgcaaattactggc

SEQ ID NO: 6586 - DNA, 15 bp, Homo sapiens
gctgcaaattactgg

SEQ ID NO: 6587 - DNA, 15 bp, Homo sapiens
agctgcaaattactg

SEQ ID NO: 6588 - DNA, 15 bp, Homo sapiens
aagctgcaaattact

SEQ ID NO: 6589 - DNA, 15 bp, Homo sapiens
taagctgcaaattac

SEQ ID NO: 6590 - DNA, 15 bp, Homo sapiens
ataagctgcaaatta

SEQ ID NO: 6591 - DNA, 15 bp, Homo sapiens
gataagctgcaaatt

SEQ ID NO: 6592 - DNA, 15 bp, Homo sapiens
ggataagctgcaaat

SEQ ID NO: 6593 - DNA, 15 bp, Homo sapiens
aggataagctgcaaa

SEQ ID NO: 6594 - DNA, 15 bp, Homo sapiens
aaggataagctgcaa

SEQ ID NO: 6595 - DNA, 15 bp, Homo sapiens
aaaggataagctgca

SEQ ID NO: 6596 - DNA, 15 bp, Homo sapiens
caaaggataagctgc

SEQ ID NO: 6597 - DNA, 15 bp, Homo sapiens
acaaaggataagctg

SEQ ID NO: 6598 - DNA, 15 bp, Homo sapiens
aacaaaggataagct

SEQ ID NO: 6599 - DNA, 15 bp, Homo sapiens
aaacaaaggataagc

SEQ ID NO: 6600 - DNA, 15 bp, Homo sapiens
gaaacaaaggataag

SEQ ID NO: 6601 - DNA, 15 bp, Homo sapiens
agaaacaaaggataa

SEQ ID NO: 6602 - DNA, 15 bp, Homo sapiens
tagaaacaaaggata

SEQ ID NO: 6603 - DNA, 15 bp, Homo sapiens
ctagaaacaaaggat

SEQ ID NO: 6604 - DNA, 15 bp, Homo sapiens
gctagaaacaaagga

SEQ ID NO: 6605 - DNA, 15 bp, Homo sapiens
agctagaaacaaagg

SEQ ID NO: 6606 - DNA, 15 bp, Homo sapiens
tagctagaaacaaag

SEQ ID NO: 6607 - DNA, 15 bp, Homo sapiens
ctagctagaaacaaa

SEQ ID NO: 6608 - DNA, 15 bp, Homo sapiens
cctagctagaaacaa

SEQ ID NO: 6609 - DNA, 15 bp, Homo sapiens
acctagctagaaaca

SEQ ID NO: 6610 - DNA, 15 bp, Homo sapiens
tacctagctagaaac

SEQ ID NO: 6611 - DNA, 15 bp, Homo sapiens
ttacctagctagaaa

SEQ ID NO: 6612 - DNA, 15 bp, Homo sapiens
cttacctagctagaa

SEQ ID NO: 6613 - DNA, 15 bp, Homo sapiens
gcttacctagctaga

SEQ ID NO: 6614 - DNA, 15 bp, Homo sapiens
agcttacctagctag

SEQ ID NO: 6615 - DNA, 15 bp, Homo sapiens
cagcttacctagcta

SEQ ID NO: 6616 - DNA, 15 bp, Homo sapiens
ccagcttacctagct

SEQ ID NO: 6617 - DNA, 15 bp, Homo sapiens
cccagcttacctagc

SEQ ID NO: 6618 - DNA, 15 bp, Homo sapiens
tcccagcttacctag

SEQ ID NO: 6619 - DNA, 15 bp, Homo sapiens
ttcccagcttaccta

SEQ ID NO: 6620 - DNA, 15 bp, Homo sapiens
tttcccagcttacct

SEQ ID NO: 6621 - DNA, 15 bp, Homo sapiens
atttcccagcttacc

SEQ ID NO: 6622 - DNA, 15 bp, Homo sapiens
tatttcccagcttac

SEQ ID NO: 6623 - DNA, 15 bp, Homo sapiens
ctatttcccagctta

SEQ ID NO: 6624 - DNA, 15 bp, Homo sapiens
gctatttcccagctt

SEQ ID NO: 6625 - DNA, 15 bp, Homo sapiens
ggctatttcccagct

SEQ ID NO: 6626 - DNA, 15 bp, Homo sapiens
aggctatttcccagc

SEQ ID NO: 6627 - DNA, 15 bp, Homo sapiens
taggctatttcccag

SEQ ID NO: 6628 - DNA, 15 bp, Homo sapiens
ctaggctatttccca

SEQ ID NO: 6629 - DNA, 15 bp, Homo sapiens
actaggctatttccc

SEQ ID NO: 6630 - DNA, 15 bp, Homo sapiens
tactaggctatttcc

SEQ ID NO: 6631 - DNA, 15 bp, Homo sapiens
gtactaggctatttc

SEQ ID NO: 6632 - DNA, 15 bp, Homo sapiens
agtactaggctattt

SEQ ID NO: 6633 - DNA, 15 bp, Homo sapiens
aagtactaggctatt

SEQ ID NO: 6634 - DNA, 15 bp, Homo sapiens
aaagtactaggctat

SEQ ID NO: 6635 - DNA, 15 bp, Homo sapiens
caaagtactaggcta

SEQ ID NO: 6636 - DNA, 15 bp, Homo sapiens
acaaagtactaggct

SEQ ID NO: 6637 - DNA, 15 bp, Homo sapiens
gacaaagtactaggc

SEQ ID NO: 6638 - DNA, 15 bp, Homo sapiens
agacaaagtactagg

SEQ ID NO: 6639 - DNA, 15 bp, Homo sapiens
tagacaaagtactag

SEQ ID NO: 6640 - DNA, 15 bp, Homo sapiens
atagacaaagtacta

SEQ ID NO: 6641 - DNA, 15 bp, Homo sapiens
catagacaaagtact

SEQ ID NO: 6642 - DNA, 15 bp, Homo sapiens
acatagacaaagtac

SEQ ID NO: 6643 - DNA, 15 bp, Homo sapiens
cacatagacaaagta

SEQ ID NO: 6644 - DNA, 15 bp, Homo sapiens
acacatagacaaagt

SEQ ID NO: 6645 - DNA, 15 bp, Homo sapiens
aacacatagacaaag

SEQ ID NO: 6646 - DNA, 15 bp, Homo sapiens
aaacacatagacaaa

SEQ ID NO: 6647 - DNA, 15 bp, Homo sapiens
taaacacatagacaa

SEQ ID NO: 6648 - DNA, 15 bp, Homo sapiens
ataaacacatagaca

SEQ ID NO: 6649 - DNA, 15 bp, Homo sapiens
gataaacacatagac

SEQ ID NO: 6650 - DNA, 15 bp, Homo sapiens
agataaacacataga

SEQ ID NO: 6651 - DNA, 15 bp, Homo sapiens
aagataaacacatag

SEQ ID NO: 6652 - DNA, 15 bp, Homo sapiens
gaagataaacacata

SEQ ID NO: 6653 - DNA, 15 bp, Homo sapiens
tgaagataaacacat

SEQ ID NO: 6654 - DNA, 15 bp, Homo sapiens
ttgaagataaacaca

SEQ ID NO: 6655 - DNA, 15 bp, Homo sapiens
tttgaagataaacac

SEQ ID NO: 6656 - DNA, 15 bp, Homo sapiens
ttttgaagataaaca

SEQ ID NO: 6657 - DNA, 15 bp, Homo sapiens
attttgaagataaac

SEQ ID NO: 6658 - DNA, 15 bp, Homo sapiens
cattttgaagataaa

SEQ ID NO: 6659 - DNA, 15 bp, Homo sapiens
acattttgaagataa

SEQ ID NO: 6660 - DNA, 15 bp, Homo sapiens
gacattttgaagata

SEQ ID NO: 6661 - DNA, 15 bp, Homo sapiens
ggacattttgaagat

SEQ ID NO: 6662 - DNA, 15 bp, Homo sapiens
gggacattttgaaga

SEQ ID NO: 6663 - DNA, 15 bp, Homo sapiens
tgggacattttgaag

SEQ ID NO: 6664 - DNA, 15 bp, Homo sapiens
ttgggacattttgaa

SEQ ID NO: 6665 - DNA, 15 bp, Homo sapiens
tttgggacattttga

SEQ ID NO: 6666 - DNA, 15 bp, Homo sapiens
atttgggacattttg

SEQ ID NO: 6667 - DNA, 15 bp, Homo sapiens
tatttgggacatttt

SEQ ID NO: 6668 - DNA, 15 bp, Homo sapiens
ctatttgggacattt

SEQ ID NO: 6669 - DNA, 15 bp, Homo sapiens
gctatttgggacatt

SEQ ID NO: 6670 - DNA, 15 bp, Homo sapiens
ggctatttgggacat

SEQ ID NO: 6671 - DNA, 15 bp, Homo sapiens
gggctatttgggaca

SEQ ID NO: 6672 - DNA, 15 bp, Homo sapiens
agggctatttgggac

SEQ ID NO: 6673 - DNA, 15 bp, Homo sapiens
cagggctatttggga

SEQ ID NO: 6674 - DNA, 15 bp, Homo sapiens
ccagggctatttggg

SEQ ID NO: 6675 - DNA, 15 bp, Homo sapiens
cccagggctatttgg

SEQ ID NO: 6676 - DNA, 15 bp, Homo sapiens
tcccagggctatttg

SEQ ID NO: 6677 - DNA, 15 bp, Homo sapiens
ttcccagggctattt

SEQ ID NO: 6678 - DNA, 15 bp, Homo sapiens
tttcccagggctatt

SEQ ID NO: 6679 - DNA, 15 bp, Homo sapiens
ttttcccagggctat

SEQ ID NO: 6680 - DNA, 15 bp, Homo sapiens
tttttcccagggcta

SEQ ID NO: 6681 - DNA, 15 bp, Homo sapiens
ctttttcccagggct

SEQ ID NO: 6682 - DNA, 15 bp, Homo sapiens
cctttttcccagggc

SEQ ID NO: 6683 - DNA, 15 bp, Homo sapiens
acctttttcccaggg

SEQ ID NO: 6684 - DNA, 15 bp, Homo sapiens
gacctttttcccagg

SEQ ID NO: 6685 - DNA, 15 bp, Homo sapiens
cgacctttttcccag

SEQ ID NO: 6686 - DNA, 15 bp, Homo sapiens
acgacctttttccca

SEQ ID NO: 6687 - DNA, 15 bp, Homo sapiens
cacgacctttttccc

SEQ ID NO: 6688 - DNA, 15 bp, Homo sapiens
gcacgacctttttcc

SEQ ID NO: 6689 - DNA, 15 bp, Homo sapiens
tgcacgacctttttc

SEQ ID NO: 6690 - DNA, 15 bp, Homo sapiens
ctgcacgaccttttt

SEQ ID NO: 6691 - DNA, 15 bp, Homo sapiens
gctgcacgacctttt

SEQ ID NO: 6692 - DNA, 15 bp, Homo sapiens
agctgcacgaccttt

SEQ ID NO: 6693 - DNA, 15 bp, Homo sapiens
gagctgcacgacctt

SEQ ID NO: 6694 - DNA, 15 bp, Homo sapiens
tgagctgcacgacct

SEQ ID NO: 6695 - DNA, 15 bp, Homo sapiens
ttgagctgcacgacc

SEQ ID NO: 6696 - DNA, 15 bp, Homo sapiens
attgagctgcacgac

SEQ ID NO: 6697 - DNA, 15 bp, Homo sapiens
cattgagctgcacga

SEQ ID NO: 6698 - DNA, 15 bp, Homo sapiens
ccattgagctgcacg

SEQ ID NO: 6699 - DNA, 15 bp, Homo sapiens
cccattgagctgcac

SEQ ID NO: 6700 - DNA, 15 bp, Homo sapiens
ccccattgagctgca

SEQ ID NO: 6701 - DNA, 15 bp, Homo sapiens
cccccattgagctgc

SEQ ID NO: 6702 - DNA, 15 bp, Homo sapiens
gcccccattgagctg

SEQ ID NO: 6703 - DNA, 15 bp, Homo sapiens
agcccccattgagct

SEQ ID NO: 6704 - DNA, 15 bp, Homo sapiens
aagcccccattgagc

SEQ ID NO: 6705 - DNA, 15 bp, Homo sapiens
aaagcccccattgag

SEQ ID NO: 6706 - DNA, 15 bp, Homo sapiens
gaaagcccccattga

SEQ ID NO: 6707 - DNA, 15 bp, Homo sapiens
tgaaagcccccattg

SEQ ID NO: 6708 - DNA, 15 bp, Homo sapiens
ttgaaagcccccatt

SEQ ID NO: 6709 - DNA, 15 bp, Homo sapiens
gttgaaagcccccat

SEQ ID NO: 6710 - DNA, 15 bp, Homo sapiens
agttgaaagccccca

SEQ ID NO: 6711 - DNA, 15 bp, Homo sapiens
aagttgaaagccccc

SEQ ID NO: 6712 - DNA, 15 bp, Homo sapiens
taagttgaaagcccc

SEQ ID NO: 6713 - DNA, 15 bp, Homo sapiens
gtaagttgaaagccc

SEQ ID NO: 6714 - DNA, 15 bp, Homo sapiens
tgtaagttgaaagcc

SEQ ID NO: 6715 - DNA, 15 bp, Homo sapiens
ttgtaagttgaaagc

SEQ ID NO: 6716 - DNA, 15 bp, Homo sapiens
attgtaagttgaaag

SEQ ID NO: 6717 - DNA, 15 bp, Homo sapiens
aattgtaagttgaaa

SEQ ID NO: 6718 - DNA, 15 bp, Homo sapiens
aaattgtaagttgaa

SEQ ID NO: 6719 - DNA, 15 bp, Homo sapiens
aaaattgtaagttga

SEQ ID NO: 6720 - DNA, 15 bp, Homo sapiens
gaaaattgtaagttg

SEQ ID NO: 6721 - DNA, 15 bp, Homo sapiens
agaaaattgtaagtt

SEQ ID NO: 6722 - DNA, 15 bp, Homo sapiens
aagaaaattgtaagt

SEQ ID NO: 6723 - DNA, 15 bp, Homo sapiens
aaagaaaattgtaag

SEQ ID NO: 6724 - DNA, 15 bp, Homo sapiens
caaagaaaattgtaa

SEQ ID NO: 6725 - DNA, 15 bp, Homo sapiens
acaaagaaaattgta

SEQ ID NO: 6726 - DNA, 15 bp, Homo sapiens
aacaaagaaaattgt

SEQ ID NO: 6727 - DNA, 15 bp, Homo sapiens
aaacaaagaaaattg

SEQ ID NO: 6728 - DNA, 15 bp, Homo sapiens
aaaacaaagaaaatt

SEQ ID NO: 6729 - DNA, 15 bp, Homo sapiens
taaaacaaagaaaat

SEQ ID NO: 6730 - DNA, 15 bp, Homo sapiens
ctaaaacaaagaaaa

SEQ ID NO: 6731 - DNA, 15 bp, Homo sapiens
cctaaaacaaagaaa

SEQ ID NO: 6732 - DNA, 15 bp, Homo sapiens
gcctaaaacaaagaa

SEQ ID NO: 6733 - DNA, 15 bp, Homo sapiens
agcctaaaacaaaga

SEQ ID NO: 6734 - DNA, 15 bp, Homo sapiens
gagcctaaaacaaag

SEQ ID NO: 6735 - DNA, 15 bp, Homo sapiens
ggagcctaaaacaaa

SEQ ID NO: 6736 - DNA, 15 bp, Homo sapiens
tggagcctaaaacaa

SEQ ID NO: 6737 - DNA, 15 bp, Homo sapiens
atggagcctaaaaca

SEQ ID NO: 6738 - DNA, 15 bp, Homo sapiens
tatggagcctaaaac

SEQ ID NO: 6739 - DNA, 15 bp, Homo sapiens
ttatggagcctaaaa

SEQ ID NO: 6740 - DNA, 15 bp, Homo sapiens
tttatggagcctaaa

SEQ ID NO: 6741 - DNA, 15 bp, Homo sapiens
ttttatggagcctaa

SEQ ID NO: 6742 - DNA, 15 bp, Homo sapiens
tttttatggagccta

SEQ ID NO: 6743 - DNA, 15 bp, Homo sapiens
atttttatggagcct

SEQ ID NO: 6744 - DNA, 15 bp, Homo sapiens
tatttttatggagcc

SEQ ID NO: 6745 - DNA, 15 bp, Homo sapiens
gtatttttatggagc

SEQ ID NO: 6746 - DNA, 15 bp, Homo sapiens
tgtatttttatggag

SEQ ID NO: 6747 - DNA, 15 bp, Homo sapiens
ctgtatttttatgga

SEQ ID NO: 6748 - DNA, 15 bp, Homo sapiens
tctgtatttttatgg

SEQ ID NO: 6749 - DNA, 15 bp, Homo sapiens
gtctgtatttttatg

SEQ ID NO: 6750 - DNA, 15 bp, Homo sapiens
agtctgtatttttat

SEQ ID NO: 6751 - DNA, 15 bp, Homo sapiens
gagtctgtattttta

SEQ ID NO: 6752 - DNA, 15 bp, Homo sapiens
tgagtctgtattttt

SEQ ID NO: 6753 - DNA, 15 bp, Homo sapiens
gtgagtctgtatttt

SEQ ID NO: 6754 - DNA, 15 bp, Homo sapiens
ggtgagtctgtattt

SEQ ID NO: 6755 - DNA, 15 bp, Homo sapiens
tggtgagtctgtatt

SEQ ID NO: 6756 - DNA, 15 bp, Homo sapiens
ctggtgagtctgtat

SEQ ID NO: 6757 - DNA, 15 bp, Homo sapiens
actggtgagtctgta

SEQ ID NO: 6758 - DNA, 15 bp, Homo sapiens
aactggtgagtctgt

SEQ ID NO: 6759 - DNA, 15 bp, Homo sapiens
gaactggtgagtctg

SEQ ID NO: 6760 - DNA, 15 bp, Homo sapiens
ggaactggtgagtct

SEQ ID NO: 6761 - DNA, 15 bp, Homo sapiens
aggaactggtgagtc

SEQ ID NO: 6762 - DNA, 15 bp, Homo sapiens
caggaactggtgagt

SEQ ID NO: 6763 - DNA, 15 bp, Homo sapiens
gcaggaactggtgag

SEQ ID NO: 6764 - DNA, 15 bp, Homo sapiens
agcaggaactggtga

SEQ ID NO: 6765 - DNA, 15 bp, Homo sapiens
aagcaggaactggtg

SEQ ID NO: 6766 - DNA, 15 bp, Homo sapiens
aaagcaggaactggt

SEQ ID NO: 6767 - DNA, 15 bp, Homo sapiens
caaagcaggaactgg

SEQ ID NO: 6768 - DNA, 15 bp, Homo sapiens
tcaaagcaggaactg

SEQ ID NO: 6769 - DNA, 15 bp, Homo sapiens
atcaaagcaggaact

SEQ ID NO: 6770 - DNA, 15 bp, Homo sapiens
catcaaagcaggaac

SEQ ID NO: 6771 - DNA, 15 bp, Homo sapiens
acatcaaagcaggaa

SEQ ID NO: 6772 - DNA, 15 bp, Homo sapiens
cacatcaaagcagga

SEQ ID NO: 6773 - DNA, 15 bp, Homo sapiens
tcacatcaaagcagg

SEQ ID NO: 6774 - DNA, 15 bp, Homo sapiens
gtcacatcaaagcag

SEQ ID NO: 6775 - DNA, 15 bp, Homo sapiens
tgtcacatcaaagca

SEQ ID NO: 6776 - DNA, 15 bp, Homo sapiens
atgtcacatcaaagc

SEQ ID NO: 6777 - DNA, 15 bp, Homo sapiens
catgtcacatcaaag

SEQ ID NO: 6778 - DNA, 15 bp, Homo sapiens
acatgtcacatcaaa

SEQ ID NO: 6779 - DNA, 15 bp, Homo sapiens
cacatgtcacatcaa

SEQ ID NO: 6780 - DNA, 15 bp, Homo sapiens
tcacatgtcacatca

SEQ ID NO: 6781 - DNA, 15 bp, Homo sapiens
gtcacatgtcacatc

SEQ ID NO: 6782 - DNA, 15 bp, Homo sapiens
agtcacatgtcacat

SEQ ID NO: 6783 - DNA, 15 bp, Homo sapiens
gagtcacatgtcaca

SEQ ID NO: 6784 - DNA, 15 bp, Homo sapiens
ggagtcacatgtcac

SEQ ID NO: 6785 - DNA, 15 bp, Homo sapiens
gggagtcacatgtca

SEQ ID NO: 6786 - DNA, 15 bp, Homo sapiens
ggggagtcacatgtc

SEQ ID NO: 6787 - DNA, 15 bp, Homo sapiens
tggggagtcacatgt

SEQ ID NO: 6788 - DNA, 15 bp, Homo sapiens
ctggggagtcacatg

SEQ ID NO: 6789 - DNA, 15 bp, Homo sapiens
tctggggagtcacat

SEQ ID NO: 6790 - DNA, 15 bp, Homo sapiens
ttctggggagtcaca

SEQ ID NO: 6791 - DNA, 15 bp, Homo sapiens
attctggggagtcac

SEQ ID NO: 6792 - DNA, 15 bp, Homo sapiens
tattctggggagtca

SEQ ID NO: 6793 - DNA, 15 bp, Homo sapiens
gtattctggggagtc

SEQ ID NO: 6794 - DNA, 15 bp, Homo sapiens
tgtattctggggagt

SEQ ID NO: 6795 - DNA, 15 bp, Homo sapiens
gtgtattctggggag

SEQ ID NO: 6796 - DNA, 15 bp, Homo sapiens
ggtgtattctgggga

SEQ ID NO: 6797 - DNA, 15 bp, Homo sapiens
aggtgtattctgggg

SEQ ID NO: 6798 - DNA, 15 bp, Homo sapiens
aaggtgtattctggg

SEQ ID NO: 6799 - DNA, 15 bp, Homo sapiens
caaggtgtattctgg

SEQ ID NO: 6800 - DNA, 15 bp, Homo sapiens
gcaaggtgtattctg

SEQ ID NO: 6801 - DNA, 15 bp, Homo sapiens
agcaaggtgtattct

SEQ ID NO: 6802 - DNA, 15 bp, Homo sapiens
aagcaaggtgtattc

SEQ ID NO: 6803 - DNA, 15 bp, Homo sapiens
gaagcaaggtgtatt

SEQ ID NO: 6804 - DNA, 15 bp, Homo sapiens
agaagcaaggtgtat

SEQ ID NO: 6805 - DNA, 15 bp, Homo sapiens
cagaagcaaggtgta

SEQ ID NO: 6806 - DNA, 15 bp, Homo sapiens
acagaagcaaggtgt

SEQ ID NO: 6807 - DNA, 15 bp, Homo sapiens
tacagaagcaaggtg

SEQ ID NO: 6808 - DNA, 15 bp, Homo sapiens
ctacagaagcaaggt

SEQ ID NO: 6809 - DNA, 15 bp, Homo sapiens
tctacagaagcaagg

SEQ ID NO: 6810 - DNA, 15 bp, Homo sapiens
gtctacagaagcaag

SEQ ID NO: 6811 - DNA, 15 bp, Homo sapiens
ggtctacagaagcaa

SEQ ID NO: 6812 - DNA, 15 bp, Homo sapiens
tggtctacagaagca

SEQ ID NO: 6813 - DNA, 15 bp, Homo sapiens
ctggtctacagaagc

SEQ ID NO: 6814 - DNA, 15 bp, Homo sapiens
gctggtctacagaag

SEQ ID NO: 6815 - DNA, 15 bp, Homo sapiens
agctggtctacagaa

SEQ ID NO: 6816 - DNA, 15 bp, Homo sapiens
gagctggtctacaga

SEQ ID NO: 6817 - DNA, 15 bp, Homo sapiens
ggagctggtctacag

SEQ ID NO: 6818 - DNA, 15 bp, Homo sapiens
tggagctggtctaca

SEQ ID NO: 6819 - DNA, 15 bp, Homo sapiens
ttggagctggtctac

SEQ ID NO: 6820 - DNA, 15 bp, Homo sapiens
gttggagctggtcta

SEQ ID NO: 6821 - DNA, 15 bp, Homo sapiens
tgttggagctggtct

SEQ ID NO: 6822 - DNA, 15 bp, Homo sapiens
ctgttggagctggtc

SEQ ID NO: 6823 - DNA, 15 bp, Homo sapiens
cctgttggagctggt

SEQ ID NO: 6824 - DNA, 15 bp, Homo sapiens
tcctgttggagctgg

SEQ ID NO: 6825 - DNA, 15 bp, Homo sapiens
atcctgttggagctg

SEQ ID NO: 6826 - DNA, 15 bp, Homo sapiens
aatcctgttggagct

SEQ ID NO: 6827 - DNA, 15 bp, Homo sapiens
gaatcctgttggagc

SEQ ID NO: 6828 - DNA, 15 bp, Homo sapiens
ggaatcctgttggag

SEQ ID NO: 6829 - DNA, 15 bp, Homo sapiens
tggaatcctgttgga

SEQ ID NO: 6830 - DNA, 15 bp, Homo sapiens
atggaatcctgttgg

SEQ ID NO: 6831 - DNA, 15 bp, Homo sapiens
catggaatcctgttg

SEQ ID NO: 6832 - DNA, 15 bp, Homo sapiens
ccatggaatcctgtt

SEQ ID NO: 6833 - DNA, 15 bp, Homo sapiens
accatggaatcctgt

SEQ ID NO: 6834 - DNA, 15 bp, Homo sapiens
taccatggaatcctg

SEQ ID NO: 6835 - DNA, 15 bp, Homo sapiens
ctaccatggaatcct

SEQ ID NO: 6836 - DNA, 15 bp, Homo sapiens
gctaccatggaatcc

SEQ ID NO: 6837 - DNA, 15 bp, Homo sapiens
agctaccatggaatc

SEQ ID NO: 6838 - DNA, 15 bp, Homo sapiens
cagctaccatggaat

SEQ ID NO: 6839 - DNA, 15 bp, Homo sapiens
ccagctaccatggaa

SEQ ID NO: 6840 - DNA, 15 bp, Homo sapiens
cccagctaccatgga

SEQ ID NO: 6841 - DNA, 15 bp, Homo sapiens
tcccagctaccatgg

SEQ ID NO: 6842 - DNA, 15 bp, Homo sapiens
atcccagctaccatg

SEQ ID NO: 6843 - DNA, 15 bp, Homo sapiens
catcccagctaccat

SEQ ID NO: 6844 - DNA, 15 bp, Homo sapiens
acatcccagctacca

SEQ ID NO: 6845 - DNA, 15 bp, Homo sapiens
aacatcccagctacc

SEQ ID NO: 6846 - DNA, 15 bp, Homo sapiens
taacatcccagctac

SEQ ID NO: 6847 - DNA, 15 bp, Homo sapiens
ctaacatcccagcta

SEQ ID NO: 6848 - DNA, 15 bp, Homo sapiens
cctaacatcccagct

SEQ ID NO: 6849 - DNA, 15 bp, Homo sapiens
ccctaacatcccagc

SEQ ID NO: 6850 - DNA, 15 bp, Homo sapiens
gccctaacatcccag

SEQ ID NO: 6851 - DNA, 15 bp, Homo sapiens
agccctaacatccca

SEQ ID NO: 6852 - DNA, 15 bp, Homo sapiens
gagccctaacatccc

SEQ ID NO: 6853 - DNA, 15 bp, Homo sapiens
tgagccctaacatcc

SEQ ID NO: 6854 - DNA, 15 bp, Homo sapiens
ctgagccctaacatc

SEQ ID NO: 6855 - DNA, 15 bp, Homo sapiens
cctgagccctaacat

SEQ ID NO: 6856 - DNA, 15 bp, Homo sapiens
acctgagccctaaca

SEQ ID NO: 6857 - DNA, 15 bp, Homo sapiens
tacctgagccctaac

SEQ ID NO: 6858 - DNA, 15 bp, Homo sapiens
ttacctgagccctaa

SEQ ID NO: 6859 - DNA, 15 bp, Homo sapiens
cttacctgagcccta

SEQ ID NO: 6860 - DNA, 15 bp, Homo sapiens
acttacctgagccct

SEQ ID NO: 6861 - DNA, 15 bp, Homo sapiens
tacttacctgagccc

SEQ ID NO: 6862 - DNA, 15 bp, Homo sapiens
ttacttacctgagcc

SEQ ID NO: 6863 - DNA, 15 bp, Homo sapiens
gttacttacctgagc

SEQ ID NO: 6864 - DNA, 15 bp, Homo sapiens
ggttacttacctgag

SEQ ID NO: 6865 - DNA, 15 bp, Homo sapiens
aggttacttacctga

SEQ ID NO: 6866 - DNA, 15 bp, Homo sapiens
aaggttacttacctg

SEQ ID NO: 6867 - DNA, 15 bp, Homo sapiens
gaaggttacttacct

SEQ ID NO: 6868 - DNA, 15 bp, Homo sapiens
ggaaggttacttacc

SEQ ID NO: 6869 - DNA, 15 bp, Homo sapiens
aggaaggttacttac

SEQ ID NO: 6870 - DNA, 15 bp, Homo sapiens
aaggaaggttactta

SEQ ID NO: 6871 - DNA, 15 bp, Homo sapiens
aaaggaaggttactt

SEQ ID NO: 6872 - DNA, 15 bp, Homo sapiens
aaaaggaaggttact

SEQ ID NO: 6873 - DNA, 15 bp, Homo sapiens
aaaaaggaaggttac

SEQ ID NO: 6874 - DNA, 15 bp, Homo sapiens
aaaaaaggaaggtta

SEQ ID NO: 6875 - DNA, 15 bp, Homo sapiens
aaaaaaaggaaggtt

SEQ ID NO: 6876 - DNA, 15 bp, Homo sapiens
aaaaaaaaggaaggt

SEQ ID NO: 6877 - DNA, 15 bp, Homo sapiens
aaaaaaaaaggaagg

SEQ ID NO: 6878 - DNA, 15 bp, Homo sapiens
aaaaaaaaaaggaag

SEQ ID NO: 6879 - DNA, 15 bp, Homo sapiens
taaaaaaaaaaaaag

SEQ ID NO: 6880 - DNA, 15 bp, Homo sapiens
tactaaaaaaaaaaa

SEQ ID NO: 6881 - DNA, 15 bp, Homo sapiens
atactaaaaaaaaaa

SEQ ID NO: 6882 - DNA, 15 bp, Homo sapiens
tatactaaaaaaaaa

SEQ ID NO: 6883 - DNA, 15 bp, Homo sapiens
atatactaaaaaaaa

SEQ ID NO: 6884 - DNA, 15 bp, Homo sapiens
catatactaaaaaaa

SEQ ID NO: 6885 - DNA, 15 bp, Homo sapiens
acatatactaaaaaa

SEQ ID NO: 6886 - DNA, 15 bp, Homo sapiens
gacatatactaaaaa

SEQ ID NO: 6887 - DNA, 15 bp, Homo sapiens
ggacatatactaaaa

SEQ ID NO: 6888 - DNA, 15 bp, Homo sapiens
aggacatatactaaa

SEQ ID NO: 6889 - DNA, 15 bp, Homo sapiens
caggacatatactaa

SEQ ID NO: 6890 - DNA, 15 bp, Homo sapiens
ccaggacatatacta

SEQ ID NO: 6891 - DNA, 15 bp, Homo sapiens
accaggacatatact

SEQ ID NO: 6892 - DNA, 15 bp, Homo sapiens
aaccaggacatatac

SEQ ID NO: 6893 - DNA, 15 bp, Homo sapiens
aaaccaggacatata

SEQ ID NO: 6894 - DNA, 15 bp, Homo sapiens
caaaccaggacatat

SEQ ID NO: 6895 - DNA, 15 bp, Homo sapiens
ccaaaccaggacata

SEQ ID NO: 6896 - DNA, 15 bp, Homo sapiens
gccaaaccaggacat

SEQ ID NO: 6897 - DNA, 15 bp, Homo sapiens
ggccaaaccaggaca

SEQ ID NO: 6898 - DNA, 15 bp, Homo sapiens
tggccaaaccaggac

SEQ ID NO: 6899 - DNA, 15 bp, Homo sapiens
atggccaaaccagga

SEQ ID NO: 6900 - DNA, 15 bp, Homo sapiens
gatggccaaaccagg

SEQ ID NO: 6901 - DNA, 15 bp, Homo sapiens
agatggccaaaccag

SEQ ID NO: 6902 - DNA, 15 bp, Homo sapiens
cagatggccaaacca

SEQ ID NO: 6903 - DNA, 15 bp, Homo sapiens
acagatggccaaacc

SEQ ID NO: 6904 - DNA, 15 bp, Homo sapiens
aacagatggccaaac

SEQ ID NO: 6905 - DNA, 15 bp, Homo sapiens
aaacagatggccaaa

SEQ ID NO: 6906 - DNA, 15 bp, Homo sapiens
aaaacagatggccaa

SEQ ID NO: 6907 - DNA, 15 bp, Homo sapiens
aaaaacagatggcca

SEQ ID NO: 6908 - DNA, 15 bp, Homo sapiens
aaaaaacagatggcc

SEQ ID NO: 6909 - DNA, 15 bp, Homo sapiens
aaaaaaacagatggc

SEQ ID NO: 6910 - DNA, 15 bp, Homo sapiens
aaaaaaaacagatgg

SEQ ID NO: 6911 - DNA, 15 bp, Homo sapiens
aaaaaaaaacagatg

SEQ ID NO: 6912 - DNA, 15 bp, Homo sapiens
aaaaaaaaaacagat

SEQ ID NO: 6913 - DNA, 15 bp, Homo sapiens
aaaaaaaaaaacaga

SEQ ID NO: 6914 - DNA, 15 bp, Homo sapiens
aaaaaaaaaaaacag

SEQ ID NO: 6915 - DNA, 15 bp, Homo sapiens
aaaaaaaaaaaaaca

SEQ ID NO: 6916 - DNA, 15 bp, Homo sapiens
ttttttttttttaaa

SEQ ID NO: 6917 - DNA, 15 bp, Homo sapiens
tttttttttttttaa

SEQ ID NO: 6918 - DNA, 15 bp, Homo sapiens
tttttttttttttta

SEQ ID NO: 6919 - DNA, 15 bp, Homo sapiens
ccttttttttttttt

SEQ ID NO: 6920 - DNA, 15 bp, Homo sapiens
tcctttttttttttt

SEQ ID NO: 6921 - DNA, 15 bp, Homo sapiens
ttccttttttttttt

SEQ ID NO: 6922 - DNA, 15 bp, Homo sapiens
tttcctttttttttt

SEQ ID NO: 6923 - DNA, 15 bp, Homo sapiens
ttttccttttttttt

SEQ ID NO: 6924 - DNA, 15 bp, Homo sapiens
cttttcctttttttt

SEQ ID NO: 6925 - DNA, 15 bp, Homo sapiens
tcttttccttttttt

SEQ ID NO: 6926 - DNA, 15 bp, Homo sapiens
ctcttttcctttttt

SEQ ID NO: 6927 - DNA, 15 bp, Homo sapiens
cctcttttccttttt

SEQ ID NO: 6928 - DNA, 15 bp, Homo sapiens
tcctcttttcctttt

SEQ ID NO: 6929 - DNA, 15 bp, Homo sapiens
ttcctcttttccttt

SEQ ID NO: 6930 - DNA, 15 bp, Homo sapiens
tttcctcttttcctt

SEQ ID NO: 6931 - DNA, 15 bp, Homo sapiens
ttttcctcttttcct

SEQ ID NO: 6932 - DNA, 15 bp, Homo sapiens
tttttcctcttttcc

SEQ ID NO: 6933 - DNA, 15 bp, Homo sapiens
ttttttcctcttttc

SEQ ID NO: 6934 - DNA, 15 bp, Homo sapiens
tttttttcctctttt

SEQ ID NO: 6935 - DNA, 15 bp, Homo sapiens
atttttttcctcttt

SEQ ID NO: 6936 - DNA, 15 bp, Homo sapiens
tatttttttcctctt

SEQ ID NO: 6937 - DNA, 15 bp, Homo sapiens
atatttttttcctct

SEQ ID NO: 6938 - DNA, 15 bp, Homo sapiens
tatatttttttcctc

SEQ ID NO: 6939 - DNA, 15 bp, Homo sapiens
gtatatttttttcct

SEQ ID NO: 6940 - DNA, 15 bp, Homo sapiens
agtatatttttttcc

SEQ ID NO: 6941 - DNA, 15 bp, Homo sapiens
tagtatatttttttc

SEQ ID NO: 6942 - DNA, 15 bp, Homo sapiens
gtagtatattttttt

SEQ ID NO: 6943 - DNA, 15 bp, Homo sapiens
agtagtatatttttt

SEQ ID NO: 6944 - DNA, 15 bp, Homo sapiens
gagtagtatattttt

SEQ ID NO: 6945 - DNA, 15 bp, Homo sapiens
agagtagtatatttt

SEQ ID NO: 6946 - DNA, 15 bp, Homo sapiens
aagagtagtatattt

SEQ ID NO: 6947 - DNA, 15 bp, Homo sapiens
caagagtagtatatt

SEQ ID NO: 6948 - DNA, 15 bp, Homo sapiens
ccaagagtagtatat

SEQ ID NO: 6949 - DNA, 15 bp, Homo sapiens
tccaagagtagtata

SEQ ID NO: 6950 - DNA, 15 bp, Homo sapiens
gtccaagagtagtat

SEQ ID NO: 6951 - DNA, 15 bp, Homo sapiens
tgtccaagagtagta

SEQ ID NO: 6952 - DNA, 15 bp, Homo sapiens
ctgtccaagagtagt

SEQ ID NO: 6953 - DNA, 15 bp, Homo sapiens
actgtccaagagtag

SEQ ID NO: 6954 - DNA, 15 bp, Homo sapiens
tactgtccaagagta

SEQ ID NO: 6955 - DNA, 15 bp, Homo sapiens
atactgtccaagagt

SEQ ID NO: 6956 - DNA, 15 bp, Homo sapiens
tatactgtccaagag

SEQ ID NO: 6957 - DNA, 15 bp, Homo sapiens
ttatactgtccaaga

SEQ ID NO: 6958 - DNA, 15 bp, Homo sapiens
tttatactgtccaag

SEQ ID NO: 6959 - DNA, 15 bp, Homo sapiens
ttttatactgtccaa

SEQ ID NO: 6960 - DNA, 15 bp, Homo sapiens
cttttatactgtcca

SEQ ID NO: 6961 - DNA, 15 bp, Homo sapiens
acttttatactgtcc

SEQ ID NO: 6962 - DNA, 15 bp, Homo sapiens
tacttttatactgtc

SEQ ID NO: 6963 - DNA, 15 bp, Homo sapiens
gtacttttatactgt

SEQ ID NO: 6964 - DNA, 15 bp, Homo sapiens
ggtacttttatactg

SEQ ID NO: 6965 - DNA, 15 bp, Homo sapiens
gggtacttttatact

SEQ ID NO: 6966 - DNA, 15 bp, Homo sapiens
ggggtacttttatac

SEQ ID NO: 6967 - DNA, 15 bp, Homo sapiens
tggggtacttttata

SEQ ID NO: 6968 - DNA, 15 bp, Homo sapiens
ttggggtacttttat

SEQ ID NO: 6969 - DNA, 15 bp, Homo sapiens
tttggggtactttta

SEQ ID NO: 6970 - DNA, 15 bp, Homo sapiens
ctttggggtactttt

SEQ ID NO: 6971 - DNA, 15 bp, Homo sapiens
tctttggggtacttt

SEQ ID NO: 6972 - DNA, 15 bp, Homo sapiens
gtctttggggtactt

SEQ ID NO: 6973 - DNA, 15 bp, Homo sapiens
agtctttggggtact

SEQ ID NO: 6974 - DNA, 15 bp, Homo sapiens
tagtctttggggtac

SEQ ID NO: 6975 - DNA, 15 bp, Homo sapiens
ttagtctttggggta

SEQ ID NO: 6976 - DNA, 15 bp, Homo sapiens
tttagtctttggggt

SEQ ID NO: 6977 - DNA, 15 bp, Homo sapiens
ctttagtctttgggg

SEQ ID NO: 6978 - DNA, 15 bp, Homo sapiens
tctttagtctttggg

SEQ ID NO: 6979 - DNA, 15 bp, Homo sapiens
gtctttagtctttgg

SEQ ID NO: 6980 - DNA, 15 bp, Homo sapiens
tgtctttagtctttg

SEQ ID NO: 6981 - DNA, 15 bp, Homo sapiens
atgtctttagtcttt

SEQ ID NO: 6982 - DNA, 15 bp, Homo sapiens
tatgtctttagtctt

SEQ ID NO: 6983 - DNA, 15 bp, Homo sapiens
ttatgtctttagtct

SEQ ID NO: 6984 - DNA, 15 bp, Homo sapiens
gttatgtctttagtc

SEQ ID NO: 6985 - DNA, 15 bp, Homo sapiens
agttatgtctttagt

SEQ ID NO: 6986 - DNA, 15 bp, Homo sapiens
cagttatgtctttag

SEQ ID NO: 6987 - DNA, 15 bp, Homo sapiens
acagttatgtcttta

SEQ ID NO: 6988 - DNA, 15 bp, Homo sapiens
cacagttatgtcttt

SEQ ID NO: 6989 - DNA, 15 bp, Homo sapiens
gcacagttatgtctt

SEQ ID NO: 6990 - DNA, 15 bp, Homo sapiens
ggcacagttatgtct

SEQ ID NO: 6991 - DNA, 15 bp, Homo sapiens
tggcacagttatgtc

SEQ ID NO: 6992 - DNA, 15 bp, Homo sapiens
ttggcacagttatgt

SEQ ID NO: 6993 - DNA, 15 bp, Homo sapiens
tttggcacagttatg

SEQ ID NO: 6994 - DNA, 15 bp, Homo sapiens
gtttggcacagttat

SEQ ID NO: 6995 - DNA, 15 bp, Homo sapiens
agtttggcacagtta

SEQ ID NO: 6996 - DNA, 15 bp, Homo sapiens
cagtttggcacagtt

SEQ ID NO: 6997 - DNA, 15 bp, Homo sapiens
acagtttggcacagt

SEQ ID NO: 6998 - DNA, 15 bp, Homo sapiens
cacagtttggcacag

SEQ ID NO: 6999 - DNA, 15 bp, Homo sapiens
gcacagtttggcaca

SEQ ID NO: 7000 - DNA, 15 bp, Homo sapiens
ggcacagtttggcac

SEQ ID NO: 7001 - DNA, 15 bp, Homo sapiens
tggcacagtttggca

SEQ ID NO: 7002 - DNA, 15 bp, Homo sapiens
atggcacagtttggc

SEQ ID NO: 7003 - DNA, 15 bp, Homo sapiens
tatggcacagtttgg

SEQ ID NO: 7004 - DNA, 15 bp, Homo sapiens
atatggcacagtttg

SEQ ID NO: 7005 - DNA, 15 bp, Homo sapiens
tatatggcacagttt

SEQ ID NO: 7006 - DNA, 15 bp, Homo sapiens
ttatatggcacagtt

SEQ ID NO: 7007 - DNA, 15 bp, Homo sapiens
attatatggcacagt

SEQ ID NO: 7008 - DNA, 15 bp, Homo sapiens
tattatatggcacag

SEQ ID NO: 7009 - DNA, 15 bp, Homo sapiens
ttattatatggcaca

SEQ ID NO: 7010 - DNA, 15 bp, Homo sapiens
tttattatatggcac

SEQ ID NO: 7011 - DNA, 15 bp, Homo sapiens
ttttattatatggca

SEQ ID NO: 7012 - DNA, 15 bp, Homo sapiens
tttttattatatggc

SEQ ID NO: 7013 - DNA, 15 bp, Homo sapiens
ttttttattatatgg

SEQ ID NO: 7014 - DNA, 15 bp, Homo sapiens
tttttttattatatg

SEQ ID NO: 7015 - DNA, 15 bp, Homo sapiens
ttttttttattatat

SEQ ID NO: 7016 - DNA, 15 bp, Homo sapiens
cttttttttattata

SEQ ID NO: 7017 - DNA, 15 bp, Homo sapiens
acttttttttattat

SEQ ID NO: 7018 - DNA, 15 bp, Homo sapiens
gacttttttttatta

SEQ ID NO: 7019 - DNA, 15 bp, Homo sapiens
tgacttttttttatt

SEQ ID NO: 7020 - DNA, 15 bp, Homo sapiens
gtgacttttttttat

SEQ ID NO: 7021 - DNA, 15 bp, Homo sapiens
agtgactttttttta

SEQ ID NO: 7022 - DNA, 15 bp, Homo sapiens
aagtgactttttttt

SEQ ID NO: 7023 - DNA, 15 bp, Homo sapiens
gaagtgacttttttt

SEQ ID NO: 7024 - DNA, 15 bp, Homo sapiens
ggaagtgactttttt

SEQ ID NO: 7025 - DNA, 15 bp, Homo sapiens
gggaagtgacttttt

SEQ ID NO: 7026 - DNA, 15 bp, Homo sapiens
agggaagtgactttt

SEQ ID NO: 7027 - DNA, 15 bp, Homo sapiens
cagggaagtgacttt

SEQ ID NO: 7028 - DNA, 15 bp, Homo sapiens
tcagggaagtgactt

SEQ ID NO: 7029 - DNA, 15 bp, Homo sapiens
ctcagggaagtgact

SEQ ID NO: 7030 - DNA, 15 bp, Homo sapiens
gctcagggaagtgac

SEQ ID NO: 7031 - DNA, 15 bp, Homo sapiens
ggctcagggaagtga

SEQ ID NO: 7032 - DNA, 15 bp, Homo sapiens
gggctcagggaagtg

SEQ ID NO: 7033 - DNA, 15 bp, Homo sapiens
agggctcagggaagt

SEQ ID NO: 7034 - DNA, 15 bp, Homo sapiens
cagggctcagggaag

SEQ ID NO: 7035 - DNA, 15 bp, Homo sapiens
tcagggctcagggaa

SEQ ID NO: 7036 - DNA, 15 bp, Homo sapiens
ttcagggctcaggga

SEQ ID NO: 7037 - DNA, 15 bp, Homo sapiens
tttcagggctcaggg

SEQ ID NO: 7038 - DNA, 15 bp, Homo sapiens
ctttcagggctcagg

SEQ ID NO: 7039 - DNA, 15 bp, Homo sapiens
cctttcagggctcag

SEQ ID NO: 7040 - DNA, 15 bp, Homo sapiens
acctttcagggctca

SEQ ID NO: 7041 - DNA, 15 bp, Homo sapiens
gacctttcagggctc

SEQ ID NO: 7042 - DNA, 15 bp, Homo sapiens
tgacctttcagggct

SEQ ID NO: 7043 - DNA, 15 bp, Homo sapiens
ctgacctttcagggc

SEQ ID NO: 7044 - DNA, 15 bp, Homo sapiens
actgacctttcaggg

SEQ ID NO: 7045 - DNA, 15 bp, Homo sapiens
cactgacctttcagg

SEQ ID NO: 7046 - DNA, 15 bp, Homo sapiens
acactgacctttcag

SEQ ID NO: 7047 - DNA, 15 bp, Homo sapiens
cacactgacctttca

SEQ ID NO: 7048 - DNA, 15 bp, Homo sapiens
acacactgacctttc

SEQ ID NO: 7049 - DNA, 15 bp, Homo sapiens
cacacactgaccttt

SEQ ID NO: 7050 - DNA, 15 bp, Homo sapiens
acacacactgacctt

SEQ ID NO: 7051 - DNA, 15 bp, Homo sapiens
tacacacactgacct

SEQ ID NO: 7052 - DNA, 15 bp, Homo sapiens
ctacacacactgacc

SEQ ID NO: 7053 - DNA, 15 bp, Homo sapiens
cctacacacactgac

SEQ ID NO: 7054 - DNA, 15 bp, Homo sapiens
ccctacacacactga

SEQ ID NO: 7055 - DNA, 15 bp, Homo sapiens
accctacacacactg

SEQ ID NO: 7056 - DNA, 15 bp, Homo sapiens
aaccctacacacact

SEQ ID NO: 7057 - DNA, 15 bp, Homo sapiens
taaccctacacacac

SEQ ID NO: 7058 - DNA, 15 bp, Homo sapiens
gtaaccctacacaca

SEQ ID NO: 7059 - DNA, 15 bp, Homo sapiens
agtaaccctacacac

SEQ ID NO: 7060 - DNA, 15 bp, Homo sapiens
aagtaaccctacaca

SEQ ID NO: 7061 - DNA, 15 bp, Homo sapiens
caagtaaccctacac

SEQ ID NO: 7062 - DNA, 15 bp, Homo sapiens
ccaagtaaccctaca

SEQ ID NO: 7063 - DNA, 15 bp, Homo sapiens
accaagtaaccctac

SEQ ID NO: 7064 - DNA, 15 bp, Homo sapiens
gaccaagtaacccta

SEQ ID NO: 7065 - DNA, 15 bp, Homo sapiens
cgaccaagtaaccct

SEQ ID NO: 7066 - DNA, 15 bp, Homo sapiens
gcgaccaagtaaccc

SEQ ID NO: 7067 - DNA, 15 bp, Homo sapiens
ggcgaccaagtaacc

SEQ ID NO: 7068 - DNA, 15 bp, Homo sapiens
tggcgaccaagtaac

SEQ ID NO: 7069 - DNA, 15 bp, Homo sapiens
gtggcgaccaagtaa

SEQ ID NO: 7070 - DNA, 15 bp, Homo sapiens
tgtggcgaccaagta

SEQ ID NO: 7071 - DNA, 15 bp, Homo sapiens
ctgtggcgaccaagt

SEQ ID NO: 7072 - DNA, 15 bp, Homo sapiens
gctgtggcgaccaag

SEQ ID NO: 7073 - DNA, 15 bp, Homo sapiens
cgctgtggcgaccaa

SEQ ID NO: 7074 - DNA, 15 bp, Homo sapiens
acgctgtggcgacca

SEQ ID NO: 7075 - DNA, 15 bp, Homo sapiens
cacgctgtggcgacc

SEQ ID NO: 7076 - DNA, 15 bp, Homo sapiens
tcacgctgtggcgac

SEQ ID NO: 7077 - DNA, 15 bp, Homo sapiens
atcacgctgtggcga

SEQ ID NO: 7078 - DNA, 15 bp, Homo sapiens
gatcacgctgtggcg

SEQ ID NO: 7079 - DNA, 15 bp, Homo sapiens
agatcacgctgtggc

SEQ ID NO: 7080 - DNA, 15 bp, Homo sapiens
cagatcacgctgtgg

SEQ ID NO: 7081 - DNA, 15 bp, Homo sapiens
ccagatcacgctgtg

SEQ ID NO: 7082 - DNA, 15 bp, Homo sapiens
cccagatcacgctgt

SEQ ID NO: 7083 - DNA, 15 bp, Homo sapiens
ccccagatcacgctg

SEQ ID NO: 7084 - DNA, 15 bp, Homo sapiens
cccccagatcacgct

SEQ ID NO: 7085 - DNA, 15 bp, Homo sapiens
gcccccagatcacgc

SEQ ID NO: 7086 - DNA, 15 bp, Homo sapiens
cgcccccagatcacg

SEQ ID NO: 7087 - DNA, 15 bp, Homo sapiens
ccgcccccagatcac

SEQ ID NO: 7088 - DNA, 15 bp, Homo sapiens
cccgcccccagatca

SEQ ID NO: 7089 - DNA, 15 bp, Homo sapiens
gcccgcccccagatc

SEQ ID NO: 7090 - DNA, 15 bp, Homo sapiens
cgcccgcccccagat

SEQ ID NO: 7091 - DNA, 15 bp, Homo sapiens
acgcccgcccccaga

SEQ ID NO: 7092 - DNA, 15 bp, Homo sapiens
gacgcccgcccccag

SEQ ID NO: 7093 - DNA, 15 bp, Homo sapiens
tgacgcccgccccca

SEQ ID NO: 7094 - DNA, 15 bp, Homo sapiens
ctgacgcccgccccc

SEQ ID NO: 7095 - DNA, 15 bp, Homo sapiens
tctgacgcccgcccc

SEQ ID NO: 7096 - DNA, 15 bp, Homo sapiens
atctgacgcccgccc

SEQ ID NO: 7097 - DNA, 15 bp, Homo sapiens
aatctgacgcccgcc

SEQ ID NO: 7098 - DNA, 15 bp, Homo sapiens
taatctgacgcccgc

SEQ ID NO: 7099 - DNA, 15 bp, Homo sapiens
ctaatctgacgcccg

SEQ ID NO: 7100 - DNA, 15 bp, Homo sapiens
tctaatctgacgccc

SEQ ID NO: 7101 - DNA, 15 bp, Homo sapiens
ctctaatctgacgcc

SEQ ID NO: 7102 - DNA, 15 bp, Homo sapiens
gctctaatctgacgc

SEQ ID NO: 7103 - DNA, 15 bp, Homo sapiens
ggctctaatctgacg

SEQ ID NO: 7104 - DNA, 15 bp, Homo sapiens
cggctctaatctgac

SEQ ID NO: 7105 - DNA, 15 bp, Homo sapiens
ccggctctaatctga

SEQ ID NO: 7106 - DNA, 15 bp, Homo sapiens
tccggctctaatctg

SEQ ID NO: 7107 - DNA, 15 bp, Homo sapiens
ttccggctctaatct

SEQ ID NO: 7108 - DNA, 15 bp, Homo sapiens
gttccggctctaatc

SEQ ID NO: 7109 - DNA, 15 bp, Homo sapiens
agttccggctctaat

SEQ ID NO: 7110 - DNA, 15 bp, Homo sapiens
cagttccggctctaa

SEQ ID NO: 7111 - DNA, 15 bp, Homo sapiens
ccagttccggctcta

SEQ ID NO: 7112 - DNA, 15 bp, Homo sapiens
accagttccggctct

SEQ ID NO: 7113 - DNA, 15 bp, Homo sapiens
caccagttccggctc

SEQ ID NO: 7114 - DNA, 15 bp, Homo sapiens
tcaccagttccggct

SEQ ID NO: 7115 - DNA, 15 bp, Homo sapiens
atcaccagttccggc

SEQ ID NO: 7116 - DNA, 15 bp, Homo sapiens
gatcaccagttccgg

SEQ ID NO: 7117 - DNA, 15 bp, Homo sapiens
agatcaccagttccg

SEQ ID NO: 7118 - DNA, 15 bp, Homo sapiens
cagatcaccagttcc

SEQ ID NO: 7119 - DNA, 15 bp, Homo sapiens
gcagatcaccagttc

SEQ ID NO: 7120 - DNA, 15 bp, Homo sapiens
tgcagatcaccagtt

SEQ ID NO: 7121 - DNA, 15 bp, Homo sapiens
ttgcagatcaccagt

SEQ ID NO: 7122 - DNA, 15 bp, Homo sapiens
gttgcagatcaccag

SEQ ID NO: 7123 - DNA, 15 bp, Homo sapiens
agttgcagatcacca

SEQ ID NO: 7124 - DNA, 15 bp, Homo sapiens
aagttgcagatcacc

SEQ ID NO: 7125 - DNA, 15 bp, Homo sapiens
gaagttgcagatcac

SEQ ID NO: 7126 - DNA, 15 bp, Homo sapiens
tgaagttgcagatca

SEQ ID NO: 7127 - DNA, 15 bp, Homo sapiens
ctgaagttgcagatc

SEQ ID NO: 7128 - DNA, 15 bp, Homo sapiens
actgaagttgcagat

SEQ ID NO: 7129 - DNA, 15 bp, Homo sapiens
aactgaagttgcaga

SEQ ID NO: 7130 - DNA, 15 bp, Homo sapiens
gaactgaagttgcag

SEQ ID NO: 7131 - DNA, 15 bp, Homo sapiens
tgaactgaagttgca

SEQ ID NO: 7132 - DNA, 15 bp, Homo sapiens
gtgaactgaagttgc

SEQ ID NO: 7133 - DNA, 15 bp, Homo sapiens
ggtgaactgaagttg

SEQ ID NO: 7134 - DNA, 15 bp, Homo sapiens
aggtgaactgaagtt

SEQ ID NO: 7135 - DNA, 15 bp, Homo sapiens
aaggtgaactgaagt

SEQ ID NO: 7136 - DNA, 15 bp, Homo sapiens
caaggtgaactgaag

SEQ ID NO: 7137 - DNA, 15 bp, Homo sapiens
tcaaggtgaactgaa

SEQ ID NO: 7138 - DNA, 15 bp, Homo sapiens
ttcaaggtgaactga

SEQ ID NO: 7139 - DNA, 15 bp, Homo sapiens
cttcaaggtgaactg

SEQ ID NO: 7140 - DNA, 15 bp, Homo sapiens
gcttcaaggtgaact

SEQ ID NO: 7141 - DNA, 15 bp, Homo sapiens
tgcttcaaggtgaac

SEQ ID NO: 7142 - DNA, 15 bp, Homo sapiens
ctgcttcaaggtgaa

SEQ ID NO: 7143 - DNA, 15 bp, Homo sapiens
cctgcttcaaggtga

SEQ ID NO: 7144 - DNA, 15 bp, Homo sapiens
acctgcttcaaggtg

SEQ ID NO: 7145 - DNA, 15 bp, Homo sapiens
gacctgcttcaaggt

SEQ ID NO: 7146 - DNA, 15 bp, Homo sapiens
tgacctgcttcaagg

SEQ ID NO: 7147 - DNA, 15 bp, Homo sapiens
ctgacctgcttcaag

SEQ ID NO: 7148 - DNA, 15 bp, Homo sapiens
gctgacctgcttcaa

SEQ ID NO: 7149 - DNA, 15 bp, Homo sapiens
agctgacctgcttca

SEQ ID NO: 7150 - DNA, 15 bp, Homo sapiens
cagctgacctgcttc

SEQ ID NO: 7151 - DNA, 15 bp, Homo sapiens
tcagctgacctgctt

SEQ ID NO: 7152 - DNA, 15 bp, Homo sapiens
ctcagctgacctgct

SEQ ID NO: 7153 - DNA, 15 bp, Homo sapiens
gctcagctgacctgc

SEQ ID NO: 7154 - DNA, 15 bp, Homo sapiens
agctcagctgacctg

SEQ ID NO: 7155 - DNA, 15 bp, Homo sapiens
cagctcagctgacct

SEQ ID NO: 7156 - DNA, 15 bp, Homo sapiens
tcagctcagctgacc

SEQ ID NO: 7157 - DNA, 15 bp, Homo sapiens
ctcagctcagctgac

SEQ ID NO: 7158 - DNA, 15 bp, Homo sapiens
tctcagctcagctga

SEQ ID NO: 7159 - DNA, 15 bp, Homo sapiens
ctctcagctcagctg

SEQ ID NO: 7160 - DNA, 15 bp, Homo sapiens
gctctcagctcagct

SEQ ID NO: 7161 - DNA, 15 bp, Homo sapiens
cgctctcagctcagc

SEQ ID NO: 7162 - DNA, 15 bp, Homo sapiens
gcgctctcagctcag

SEQ ID NO: 7163 - DNA, 15 bp, Homo sapiens
agcgctctcagctca

SEQ ID NO: 7164 - DNA, 15 bp, Homo sapiens
aagcgctctcagctc

SEQ ID NO: 7165 - DNA, 15 bp, Homo sapiens
caagcgctctcagct

SEQ ID NO: 7166 - DNA, 15 bp, Homo sapiens
gcaagcgctctcagc

SEQ ID NO: 7167 - DNA, 15 bp, Homo sapiens
tgcaagcgctctcag

SEQ ID NO: 7168 - DNA, 15 bp, Homo sapiens
gtgcaagcgctctca

SEQ ID NO: 7169 - DNA, 15 bp, Homo sapiens
agtgcaagcgctctc

SEQ ID NO: 7170 - DNA, 15 bp, Homo sapiens
cagtgcaagcgctct

SEQ ID NO: 7171 - DNA, 15 bp, Homo sapiens
tcagtgcaagcgctc

SEQ ID NO: 7172 - DNA, 15 bp, Homo sapiens
ctcagtgcaagcgct

SEQ ID NO: 7173 - DNA, 15 bp, Homo sapiens
gctcagtgcaagcgc

SEQ ID NO: 7174 - DNA, 15 bp, Homo sapiens
ggctcagtgcaagcg

SEQ ID NO: 7175 - DNA, 15 bp, Homo sapiens
gggctcagtgcaagc

SEQ ID NO: 7176 - DNA, 15 bp, Homo sapiens
agggctcagtgcaag

SEQ ID NO: 7177 - DNA, 15 bp, Homo sapiens
aagggctcagtgcaa

SEQ ID NO: 7178 - DNA, 15 bp, Homo sapiens
aaagggctcagtgca

SEQ ID NO: 7179 - DNA, 15 bp, Homo sapiens
aaaagggctcagtgc

SEQ ID NO: 7180 - DNA, 15 bp, Homo sapiens
caaaagggctcagtg

SEQ ID NO: 7181 - DNA, 15 bp, Homo sapiens
gcaaaagggctcagt

SEQ ID NO: 7182 - DNA, 15 bp, Homo sapiens
cgcaaaagggctcag

SEQ ID NO: 7183 - DNA, 15 bp, Homo sapiens
gcgcaaaagggctca

SEQ ID NO: 7184 - DNA, 15 bp, Homo sapiens
agcgcaaaagggctc

SEQ ID NO: 7185 - DNA, 15 bp, Homo sapiens
cagcgcaaaagggct

SEQ ID NO: 7186 - DNA, 15 bp, Homo sapiens
gcagcgcaaaagggc

SEQ ID NO: 7187 - DNA, 15 bp, Homo sapiens
agcagcgcaaaaggg

SEQ ID NO: 7188 - DNA, 15 bp, Homo sapiens
cagcagcgcaaaagg

SEQ ID NO: 7189 - DNA, 15 bp, Homo sapiens
gcagcagcgcaaaag

SEQ ID NO: 7190 - DNA, 15 bp, Homo sapiens
agcagcagcgcaaaa

SEQ ID NO: 7191 - DNA, 15 bp, Homo sapiens
cagcagcagcgcaaa

SEQ ID NO: 7192 - DNA, 15 bp, Homo sapiens
acagcagcagcgcaa

SEQ ID NO: 7193 - DNA, 15 bp, Homo sapiens
aacagcagcagcgca

SEQ ID NO: 7194 - DNA, 15 bp, Homo sapiens
caacagcagcagcgc

SEQ ID NO: 7195 - DNA, 15 bp, Homo sapiens
gcaacagcagcagcg

SEQ ID NO: 7196 - DNA, 15 bp, Homo sapiens
ggcaacagcagcagc

SEQ ID NO: 7197 - DNA, 15 bp, Homo sapiens
aggcaacagcagcag

SEQ ID NO: 7198 - DNA, 15 bp, Homo sapiens
aaggcaacagcagca

SEQ ID NO: 7199 - DNA, 15 bp, Homo sapiens
taaggcaacagcagc

SEQ ID NO: 7200 - DNA, 15 bp, Homo sapiens
ctaaggcaacagcag

SEQ ID NO: 7201 - DNA, 15 bp, Homo sapiens
gctaaggcaacagca

SEQ ID NO: 7202 - DNA, 15 bp, Homo sapiens
cgctaaggcaacagc

SEQ ID NO: 7203 - DNA, 15 bp, Homo sapiens
ccgctaaggcaacag

SEQ ID NO: 7204 - DNA, 15 bp, Homo sapiens
accgctaaggcaaca

SEQ ID NO: 7205 - DNA, 15 bp, Homo sapiens
gaccgctaaggcaac

SEQ ID NO: 7206 - DNA, 15 bp, Homo sapiens
agaccgctaaggcaa

SEQ ID NO: 7207 - DNA, 15 bp, Homo sapiens
aagaccgctaaggca

SEQ ID NO: 7208 - DNA, 15 bp, Homo sapiens
gaagaccgctaaggc

SEQ ID NO: 7209 - DNA, 15 bp, Homo sapiens
tgaagaccgctaagg

SEQ ID NO: 7210 - DNA, 15 bp, Homo sapiens
ctgaagaccgctaag

SEQ ID NO: 7211 - DNA, 15 bp, Homo sapiens
gctgaagaccgctaa

SEQ ID NO: 7212 - DNA, 15 bp, Homo sapiens
tgctgaagaccgcta

SEQ ID NO: 7213 - DNA, 15 bp, Homo sapiens
atgctgaagaccgct

SEQ ID NO: 7214 - DNA, 15 bp, Homo sapiens
catgctgaagaccgc

SEQ ID NO: 7215 - DNA, 15 bp, Homo sapiens
acatgctgaagaccg

SEQ ID NO: 7216 - DNA, 15 bp, Homo sapiens
cacatgctgaagacc

SEQ ID NO: 7217 - DNA, 15 bp, Homo sapiens
acacatgctgaagac

SEQ ID NO: 7218 - DNA, 15 bp, Homo sapiens
aacacatgctgaaga

SEQ ID NO: 7219 - DNA, 15 bp, Homo sapiens
aaacacatgctgaag

SEQ ID NO: 7220 - DNA, 15 bp, Homo sapiens
caaacacatgctgaa

SEQ ID NO: 7221 - DNA, 15 bp, Homo sapiens
gcaaacacatgctga

SEQ ID NO: 7222 - DNA, 15 bp, Homo sapiens
agcaaacacatgctg

SEQ ID NO: 7223 - DNA, 15 bp, Homo sapiens
aagcaaacacatgct

SEQ ID NO: 7224 - DNA, 15 bp, Homo sapiens
aaagcaaacacatgc

SEQ ID NO: 7225 - DNA, 15 bp, Homo sapiens
caaagcaaacacatg

SEQ ID NO: 7226 - DNA, 15 bp, Homo sapiens
ccaaagcaaacacat

SEQ ID NO: 7227 - DNA, 15 bp, Homo sapiens
accaaagcaaacaca

SEQ ID NO: 7228 - DNA, 15 bp, Homo sapiens
aaccaaagcaaacac

SEQ ID NO: 7229 - DNA, 15 bp, Homo sapiens
aaaccaaagcaaaca

SEQ ID NO: 7230 - DNA, 15 bp, Homo sapiens
caaaccaaagcaaac

SEQ ID NO: 7231 - DNA, 15 bp, Homo sapiens
ccaaaccaaagcaaa

SEQ ID NO: 7232 - DNA, 15 bp, Homo sapiens
cccaaaccaaagcaa

SEQ ID NO: 7233 - DNA, 15 bp, Homo sapiens
ccccaaaccaaagca

SEQ ID NO: 7234 - DNA, 15 bp, Homo sapiens
accccaaaccaaagc

SEQ ID NO: 7235 - DNA, 15 bp, Homo sapiens
taccccaaaccaaag

SEQ ID NO: 7236 - DNA, 15 bp, Homo sapiens
ttaccccaaaccaaa

SEQ ID NO: 7237 - DNA, 15 bp, Homo sapiens
tttaccccaaaccaa

SEQ ID NO: 7238 - DNA, 15 bp, Homo sapiens
atttaccccaaacca

SEQ ID NO: 7239 - DNA, 15 bp, Homo sapiens
catttaccccaaacc

SEQ ID NO: 7240 - DNA, 15 bp, Homo sapiens
ccatttaccccaaac

SEQ ID NO: 7241 - DNA, 15 bp, Homo sapiens
gccatttaccccaaa

SEQ ID NO: 7242 - DNA, 15 bp, Homo sapiens
agccatttaccccaa

SEQ ID NO: 7243 - DNA, 15 bp, Homo sapiens
aagccatttacccca

SEQ ID NO: 7244 - DNA, 15 bp, Homo sapiens
taagccatttacccc

SEQ ID NO: 7245 - DNA, 15 bp, Homo sapiens
ctaagccatttaccc

SEQ ID NO: 7246 - DNA, 15 bp, Homo sapiens
actaagccatttacc

SEQ ID NO: 7247 - DNA, 15 bp, Homo sapiens
cactaagccatttac

SEQ ID NO: 7248 - DNA, 15 bp, Homo sapiens
ccactaagccattta

SEQ ID NO: 7249 - DNA, 15 bp, Homo sapiens
accactaagccattt

SEQ ID NO: 7250 - DNA, 15 bp, Homo sapiens
gaccactaagccatt

SEQ ID NO: 7251 - DNA, 15 bp, Homo sapiens
tgaccactaagccat

SEQ ID NO: 7252 - DNA, 15 bp, Homo sapiens
ttgaccactaagcca

SEQ ID NO: 7253 - DNA, 15 bp, Homo sapiens
gttgaccactaagcc

SEQ ID NO: 7254 - DNA, 15 bp, Homo sapiens
tgttgaccactaagc

SEQ ID NO: 7255 - DNA, 15 bp, Homo sapiens
atgttgaccactaag

SEQ ID NO: 7256 - DNA, 15 bp, Homo sapiens
aatgttgaccactaa

SEQ ID NO: 7257 - DNA, 15 bp, Homo sapiens
taatgttgaccacta

SEQ ID NO: 7258 - DNA, 15 bp, Homo sapiens
ctaatgttgaccact

SEQ ID NO: 7259 - DNA, 15 bp, Homo sapiens
actaatgttgaccac

SEQ ID NO: 7260 - DNA, 15 bp, Homo sapiens
cactaatgttgacca

SEQ ID NO: 7261 - DNA, 15 bp, Homo sapiens
tcactaatgttgacc

SEQ ID NO: 7262 - DNA, 15 bp, Homo sapiens
ctcactaatgttgac

SEQ ID NO: 7263 - DNA, 15 bp, Homo sapiens
gctcactaatgttga

SEQ ID NO: 7264 - DNA, 15 bp, Homo sapiens
tgctcactaatgttg

SEQ ID NO: 7265 - DNA, 15 bp, Homo sapiens
ctgctcactaatgtt

SEQ ID NO: 7266 - DNA, 15 bp, Homo sapiens
actgctcactaatgt

SEQ ID NO: 7267 - DNA, 15 bp, Homo sapiens
cactgctcactaatg

SEQ ID NO: 7268 - DNA, 15 bp, Homo sapiens
ccactgctcactaat

SEQ ID NO: 7269 - DNA, 15 bp, Homo sapiens
accactgctcactaa

SEQ ID NO: 7270 - DNA, 15 bp, Homo sapiens
taccactgctcacta

SEQ ID NO: 7271 - DNA, 15 bp, Homo sapiens
ttaccactgctcact

SEQ ID NO: 7272 - DNA, 15 bp, Homo sapiens
attaccactgctcac

SEQ ID NO: 7273 - DNA, 15 bp, Homo sapiens
cattaccactgctca

SEQ ID NO: 7274 - DNA, 15 bp, Homo sapiens
gcattaccactgctc

SEQ ID NO: 7275 - DNA, 15 bp, Homo sapiens
tgcattaccactgct

SEQ ID NO: 7276 - DNA, 15 bp, Homo sapiens
atgcattaccactgc

SEQ ID NO: 7277 - DNA, 15 bp, Homo sapiens
aatgcattaccactg

SEQ ID NO: 7278 - DNA, 15 bp, Homo sapiens
aaatgcattaccact

SEQ ID NO: 7279 - DNA, 15 bp, Homo sapiens
aaaatgcattaccac

SEQ ID NO: 7280 - DNA, 15 bp, Homo sapiens
gaaaatgcattacca

SEQ ID NO: 7281 - DNA, 15 bp, Homo sapiens
tgaaaatgcattacc

SEQ ID NO: 7282 - DNA, 15 bp, Homo sapiens
ctgaaaatgcattac

SEQ ID NO: 7283 - DNA, 15 bp, Homo sapiens
tctgaaaatgcatta

SEQ ID NO: 7284 - DNA, 15 bp, Homo sapiens
atctgaaaatgcatt

SEQ ID NO: 7285 - DNA, 15 bp, Homo sapiens
tatctgaaaatgcat

SEQ ID NO: 7286 - DNA, 15 bp, Homo sapiens
atatctgaaaatgca

SEQ ID NO: 7287 - DNA, 15 bp, Homo sapiens
catatctgaaaatgc

SEQ ID NO: 7288 - DNA, 15 bp, Homo sapiens
ccatatctgaaaatg

SEQ ID NO: 7289 - DNA, 15 bp, Homo sapiens
cccatatctgaaaat

SEQ ID NO: 7290 - DNA, 15 bp, Homo sapiens
tcccatatctgaaaa

SEQ ID NO: 7291 - DNA, 15 bp, Homo sapiens
ttcccatatctgaaa

SEQ ID NO: 7292 - DNA, 15 bp, Homo sapiens
gttcccatatctgaa

SEQ ID NO: 7293 - DNA, 15 bp, Homo sapiens
agttcccatatctga

SEQ ID NO: 7294 - DNA, 15 bp, Homo sapiens
cagttcccatatctg

SEQ ID NO: 7295 - DNA, 15 bp, Homo sapiens
ccagttcccatatct

SEQ ID NO: 7296 - DNA, 15 bp, Homo sapiens
accagttcccatatc

SEQ ID NO: 7297 - DNA, 15 bp, Homo sapiens
taccagttcccatat

SEQ ID NO: 7298 - DNA, 15 bp, Homo sapiens
ataccagttcccata

SEQ ID NO: 7299 - DNA, 15 bp, Homo sapiens
cataccagttcccat

SEQ ID NO: 7300 - DNA, 15 bp, Homo sapiens
acataccagttccca

SEQ ID NO: 7301 - DNA, 15 bp, Homo sapiens
cacataccagttccc

SEQ ID NO: 7302 - DNA, 15 bp, Homo sapiens
ccacataccagttcc

SEQ ID NO: 7303 - DNA, 15 bp, Homo sapiens
accacataccagttc

SEQ ID NO: 7304 - DNA, 15 bp, Homo sapiens
aaccacataccagtt

SEQ ID NO: 7305 - DNA, 15 bp, Homo sapiens
caaccacataccagt

SEQ ID NO: 7306 - DNA, 15 bp, Homo sapiens
ccaaccacataccag

SEQ ID NO: 7307 - DNA, 15 bp, Homo sapiens
accaaccacatacca

SEQ ID NO: 7308 - DNA, 15 bp, Homo sapiens
aaccaaccacatacc

SEQ ID NO: 7309 - DNA, 15 bp, Homo sapiens
gaaccaaccacatac

SEQ ID NO: 7310 - DNA, 15 bp, Homo sapiens
ggaaccaaccacata

SEQ ID NO: 7311 - DNA, 15 bp, Homo sapiens
gggaaccaaccacat

SEQ ID NO: 7312 - DNA, 15 bp, Homo sapiens
agggaaccaaccaca

SEQ ID NO: 7313 - DNA, 15 bp, Homo sapiens
tagggaaccaaccac

SEQ ID NO: 7314 - DNA, 15 bp, Homo sapiens
ctagggaaccaacca

SEQ ID NO: 7315 - DNA, 15 bp, Homo sapiens
tctagggaaccaacc

SEQ ID NO: 7316 - DNA, 15 bp, Homo sapiens
ttctagggaaccaac

SEQ ID NO: 7317 - DNA, 15 bp, Homo sapiens
cttctagggaaccaa

SEQ ID NO: 7318 - DNA, 15 bp, Homo sapiens
ccttctagggaacca

SEQ ID NO: 7319 - DNA, 15 bp, Homo sapiens
tccttctagggaacc

SEQ ID NO: 7320 - DNA, 15 bp, Homo sapiens
gtccttctagggaac

SEQ ID NO: 7321 - DNA, 15 bp, Homo sapiens
tgtccttctagggaa

SEQ ID NO: 7322 - DNA, 15 bp, Homo sapiens
gtgtccttctaggga

SEQ ID NO: 7323 - DNA, 15 bp, Homo sapiens
ggtgtccttctaggg

SEQ ID NO: 7324 - DNA, 15 bp, Homo sapiens
gggtgtccttctagg

SEQ ID NO: 7325 - DNA, 15 bp, Homo sapiens
agggtgtccttctag

SEQ ID NO: 7326 - DNA, 15 bp, Homo sapiens
gagggtgtccttcta

SEQ ID NO: 7327 - DNA, 15 bp, Homo sapiens
ggagggtgtccttct

SEQ ID NO: 7328 - DNA, 15 bp, Homo sapiens
aggagggtgtccttc

SEQ ID NO: 7329 - DNA, 15 bp, Homo sapiens
caggagggtgtcctt

SEQ ID NO: 7330 - DNA, 15 bp, Homo sapiens
tcaggagggtgtcct

SEQ ID NO: 7331 - DNA, 15 bp, Homo sapiens
ttcaggagggtgtcc

SEQ ID NO: 7332 - DNA, 15 bp, Homo sapiens
tttcaggagggtgtc

SEQ ID NO: 7333 - DNA, 15 bp, Homo sapiens
ctttcaggagggtgt

SEQ ID NO: 7334 - DNA, 15 bp, Homo sapiens
gctttcaggagggtg

SEQ ID NO: 7335 - DNA, 15 bp, Homo sapiens
agctttcaggagggt

SEQ ID NO: 7336 - DNA, 15 bp, Homo sapiens
cagctttcaggaggg

SEQ ID NO: 7337 - DNA, 15 bp, Homo sapiens
acagctttcaggagg

SEQ ID NO: 7338 - DNA, 15 bp, Homo sapiens
gacagctttcaggag

SEQ ID NO: 7339 - DNA, 15 bp, Homo sapiens
agacagctttcagga

SEQ ID NO: 7340 - DNA, 15 bp, Homo sapiens
gagacagctttcagg

SEQ ID NO: 7341 - DNA, 15 bp, Homo sapiens
tgagacagctttcag

SEQ ID NO: 7342 - DNA, 15 bp, Homo sapiens
ctgagacagctttca

SEQ ID NO: 7343 - DNA, 15 bp, Homo sapiens
tctgagacagctttc

SEQ ID NO: 7344 - DNA, 15 bp, Homo sapiens
ttctgagacagcttt

SEQ ID NO: 7345 - DNA, 15 bp, Homo sapiens
gttctgagacagctt

SEQ ID NO: 7346 - DNA, 15 bp, Homo sapiens
tgttctgagacagct

SEQ ID NO: 7347 - DNA, 15 bp, Homo sapiens
gtgttctgagacagc

SEQ ID NO: 7348 - DNA, 15 bp, Homo sapiens
ggtgttctgagacag

SEQ ID NO: 7349 - DNA, 15 bp, Homo sapiens
cggtgttctgagaca

SEQ ID NO: 7350 - DNA, 15 bp, Homo sapiens
ccggtgttctgagac

SEQ ID NO: 7351 - DNA, 15 bp, Homo sapiens
cccggtgttctgaga

SEQ ID NO: 7352 - DNA, 15 bp, Homo sapiens
ccccggtgttctgag

SEQ ID NO: 7353 - DNA, 15 bp, Homo sapiens
cccccggtgttctga

SEQ ID NO: 7354 - DNA, 15 bp, Homo sapiens
gcccccggtgttctg

SEQ ID NO: 7355 - DNA, 15 bp, Homo sapiens
ggcccccggtgttct

SEQ ID NO: 7356 - DNA, 15 bp, Homo sapiens
tggcccccggtgttc

SEQ ID NO: 7357 - DNA, 15 bp, Homo sapiens
atggcccccggtgtt

SEQ ID NO: 7358 - DNA, 15 bp, Homo sapiens
catggcccccggtgt

SEQ ID NO: 7359 - DNA, 15 bp, Homo sapiens
ccatggcccccggtg

SEQ ID NO: 7360 - DNA, 15 bp, Homo sapiens
gccatggcccccggt

SEQ ID NO: 7361 - DNA, 15 bp, Homo sapiens
agccatggcccccgg

SEQ ID NO: 7362 - DNA, 15 bp, Homo sapiens
tagccatggcccccg

SEQ ID NO: 7363 - DNA, 15 bp, Homo sapiens
ttagccatggccccc

SEQ ID NO: 7364 - DNA, 15 bp, Homo sapiens
attagccatggcccc

SEQ ID NO: 7365 - DNA, 15 bp, Homo sapiens
cattagccatggccc

SEQ ID NO: 7366 - DNA, 15 bp, Homo sapiens
acattagccatggcc

SEQ ID NO: 7367 - DNA, 15 bp, Homo sapiens
gacattagccatggc

SEQ ID NO: 7368 - DNA, 15 bp, Homo sapiens
tgacattagccatgg

SEQ ID NO: 7369 - DNA, 15 bp, Homo sapiens
atgacattagccatg

SEQ ID NO: 7370 - DNA, 15 bp, Homo sapiens
catgacattagccat

SEQ ID NO: 7371 - DNA, 15 bp, Homo sapiens
acatgacattagcca

SEQ ID NO: 7372 - DNA, 15 bp, Homo sapiens
cacatgacattagcc

SEQ ID NO: 7373 - DNA, 15 bp, Homo sapiens
gcacatgacattagc

SEQ ID NO: 7374 - DNA, 15 bp, Homo sapiens
agcacatgacattag

SEQ ID NO: 7375 - DNA, 15 bp, Homo sapiens
aagcacatgacatta

SEQ ID NO: 7376 - DNA, 15 bp, Homo sapiens
caagcacatgacatt

SEQ ID NO: 7377 - DNA, 15 bp, Homo sapiens
gcaagcacatgacat

SEQ ID NO: 7378 - DNA, 15 bp, Homo sapiens
agcaagcacatgaca

SEQ ID NO: 7379 - DNA, 15 bp, Homo sapiens
tagcaagcacatgac

SEQ ID NO: 7380 - DNA, 15 bp, Homo sapiens
gtagcaagcacatga

SEQ ID NO: 7381 - DNA, 15 bp, Homo sapiens
tgtagcaagcacatg

SEQ ID NO: 7382 - DNA, 15 bp, Homo sapiens
gtgtagcaagcacat

SEQ ID NO: 7383 - DNA, 15 bp, Homo sapiens
agtgtagcaagcaca

SEQ ID NO: 7384 - DNA, 15 bp, Homo sapiens
gagtgtagcaagcac

SEQ ID NO: 7385 - DNA, 15 bp, Homo sapiens
ggagtgtagcaagca

SEQ ID NO: 7386 - DNA, 15 bp, Homo sapiens
aggagtgtagcaagc

SEQ ID NO: 7387 - DNA, 15 bp, Homo sapiens
gaggagtgtagcaag

SEQ ID NO: 7388 - DNA, 15 bp, Homo sapiens
ggaggagtgtagcaa

SEQ ID NO: 7389 - DNA, 15 bp, Homo sapiens
gggaggagtgtagca

SEQ ID NO: 7390 - DNA, 15 bp, Homo sapiens
tgggaggagtgtagc

SEQ ID NO: 7391 - DNA, 15 bp, Homo sapiens
atgggaggagtgtag

SEQ ID NO: 7392 - DNA, 15 bp, Homo sapiens
catgggaggagtgta

SEQ ID NO: 7393 - DNA, 15 bp, Homo sapiens
ccatgggaggagtgt

SEQ ID NO: 7394 - DNA, 15 bp, Homo sapiens
accatgggaggagtg

SEQ ID NO: 7395 - DNA, 15 bp, Homo sapiens
taccatgggaggagt

SEQ ID NO: 7396 - DNA, 15 bp, Homo sapiens
ttaccatgggaggag

SEQ ID NO: 7397 - DNA, 15 bp, Homo sapiens
gttaccatgggagga

SEQ ID NO: 7398 - DNA, 15 bp, Homo sapiens
agttaccatgggagg

SEQ ID NO: 7399 - DNA, 15 bp, Homo sapiens
tagttaccatgggag

SEQ ID NO: 7400 - DNA, 15 bp, Homo sapiens
ttagttaccatggga

SEQ ID NO: 7401 - DNA, 15 bp, Homo sapiens
tttagttaccatggg

SEQ ID NO: 7402 - DNA, 15 bp, Homo sapiens
ctttagttaccatgg

SEQ ID NO: 7403 - DNA, 15 bp, Homo sapiens
tctttagttaccatg

SEQ ID NO: 7404 - DNA, 15 bp, Homo sapiens
ctctttagttaccat

SEQ ID NO: 7405 - DNA, 15 bp, Homo sapiens
tctctttagttacca

SEQ ID NO: 7406 - DNA, 15 bp, Homo sapiens
ctctctttagttacc

SEQ ID NO: 7407 - DNA, 15 bp, Homo sapiens
actctctttagttac

SEQ ID NO: 7408 - DNA, 15 bp, Homo sapiens
tactctctttagtta

SEQ ID NO: 7409 - DNA, 15 bp, Homo sapiens
gtactctctttagtt

SEQ ID NO: 7410 - DNA, 15 bp, Homo sapiens
ggtactctctttagt

SEQ ID NO: 7411 - DNA, 15 bp, Homo sapiens
gggtactctctttag

SEQ ID NO: 7412 - DNA, 15 bp, Homo sapiens
tgggtactctcttta

SEQ ID NO: 7413 - DNA, 15 bp, Homo sapiens
ctgggtactctcttt

SEQ ID NO: 7414 - DNA, 15 bp, Homo sapiens
tctgggtactctctt

SEQ ID NO: 7415 - DNA, 15 bp, Homo sapiens
atctgggtactctct

SEQ ID NO: 7416 - DNA, 15 bp, Homo sapiens
tatctgggtactctc

SEQ ID NO: 7417 - DNA, 15 bp, Homo sapiens
atatctgggtactct

SEQ ID NO: 7418 - DNA, 15 bp, Homo sapiens
tatatctgggtactc

SEQ ID NO: 7419 - DNA, 15 bp, Homo sapiens
gtatatctgggtact

SEQ ID NO: 7420 - DNA, 15 bp, Homo sapiens
tgtatatctgggtac

SEQ ID NO: 7421 - DNA, 15 bp, Homo sapiens
atgtatatctgggta

SEQ ID NO: 7422 - DNA, 15 bp, Homo sapiens
gatgtatatctgggt

SEQ ID NO: 7423 - DNA, 15 bp, Homo sapiens
agatgtatatctggg

SEQ ID NO: 7424 - DNA, 15 bp, Homo sapiens
cagatgtatatctgg

SEQ ID NO: 7425 - DNA, 15 bp, Homo sapiens
ccagatgtatatctg

SEQ ID NO: 7426 - DNA, 15 bp, Homo sapiens
accagatgtatatct

SEQ ID NO: 7427 - DNA, 15 bp, Homo sapiens
aaccagatgtatatc

SEQ ID NO: 7428 - DNA, 15 bp, Homo sapiens
gaaccagatgtatat

SEQ ID NO: 7429 - DNA, 15 bp, Homo sapiens
agaaccagatgtata

SEQ ID NO: 7430 - DNA, 15 bp, Homo sapiens
aagaaccagatgtat

SEQ ID NO: 7431 - DNA, 15 bp, Homo sapiens
caagaaccagatgta

SEQ ID NO: 7432 - DNA, 15 bp, Homo sapiens
ccaagaaccagatgt

SEQ ID NO: 7433 - DNA, 15 bp, Homo sapiens
cccaagaaccagatg

SEQ ID NO: 7434 - DNA, 15 bp, Homo sapiens
tcccaagaaccagat

SEQ ID NO: 7435 - DNA, 15 bp, Homo sapiens
gtcccaagaaccaga

SEQ ID NO: 7436 - DNA, 15 bp, Homo sapiens
agtcccaagaaccag

SEQ ID NO: 7437 - DNA, 15 bp, Homo sapiens
gagtcccaagaacca

SEQ ID NO: 7438 - DNA, 15 bp, Homo sapiens
agagtcccaagaacc

SEQ ID NO: 7439 - DNA, 15 bp, Homo sapiens
tagagtcccaagaac

SEQ ID NO: 7440 - DNA, 15 bp, Homo sapiens
ctagagtcccaagaa

SEQ ID NO: 7441 - DNA, 15 bp, Homo sapiens
tctagagtcccaaga

SEQ ID NO: 7442 - DNA, 15 bp, Homo sapiens
ctctagagtcccaag

SEQ ID NO: 7443 - DNA, 15 bp, Homo sapiens
cctctagagtcccaa

SEQ ID NO: 7444 - DNA, 15 bp, Homo sapiens
tcctctagagtccca

SEQ ID NO: 7445 - DNA, 15 bp, Homo sapiens
ctcctctagagtccc

SEQ ID NO: 7446 - DNA, 15 bp, Homo sapiens
cctcctctagagtcc

SEQ ID NO: 7447 - DNA, 15 bp, Homo sapiens
tcctcctctagagtc

SEQ ID NO: 7448 - DNA, 15 bp, Homo sapiens
atcctcctctagagt

SEQ ID NO: 7449 - DNA, 15 bp, Homo sapiens
catcctcctctagag

SEQ ID NO: 7450 - DNA, 15 bp, Homo sapiens
tcatcctcctctaga

SEQ ID NO: 7451 - DNA, 15 bp, Homo sapiens
ctcatcctcctctag

SEQ ID NO: 7452 - DNA, 15 bp, Homo sapiens
actcatcctcctcta

SEQ ID NO: 7453 - DNA, 15 bp, Homo sapiens
tactcatcctcctct

SEQ ID NO: 7454 - DNA, 15 bp, Homo sapiens
gtactcatcctcctc

SEQ ID NO: 7455 - DNA, 15 bp, Homo sapiens
agtactcatcctcct

SEQ ID NO: 7456 - DNA, 15 bp, Homo sapiens
aagtactcatcctcc

SEQ ID NO: 7457 - DNA, 15 bp, Homo sapiens
aaagtactcatcctc

SEQ ID NO: 7458 - DNA, 15 bp, Homo sapiens
caaagtactcatcct

SEQ ID NO: 7459 - DNA, 15 bp, Homo sapiens
acaaagtactcatcc

SEQ ID NO: 7460 - DNA, 15 bp, Homo sapiens
tacaaagtactcatc

SEQ ID NO: 7461 - DNA, 15 bp, Homo sapiens
ttacaaagtactcat

SEQ ID NO: 7462 - DNA, 15 bp, Homo sapiens
tttacaaagtactca

SEQ ID NO: 7463 - DNA, 15 bp, Homo sapiens
ttttacaaagtactc

SEQ ID NO: 7464 - DNA, 15 bp, Homo sapiens
tttttacaaagtact

SEQ ID NO: 7465 - DNA, 15 bp, Homo sapiens
gtttttacaaagtac

SEQ ID NO: 7466 - DNA, 15 bp, Homo sapiens
ggtttttacaaagta

SEQ ID NO: 7467 - DNA, 15 bp, Homo sapiens
aggtttttacaaagt

SEQ ID NO: 7468 - DNA, 15 bp, Homo sapiens
caggtttttacaaag

SEQ ID NO: 7469 - DNA, 15 bp, Homo sapiens
ccaggtttttacaaa

SEQ ID NO: 7470 - DNA, 15 bp, Homo sapiens
cccaggtttttacaa

SEQ ID NO: 7471 - DNA, 15 bp, Homo sapiens
ccccaggtttttaca

SEQ ID NO: 7472 - DNA, 15 bp, Homo sapiens
cccccaggtttttac

SEQ ID NO: 7473 - DNA, 15 bp, Homo sapiens
gcccccaggttttta

SEQ ID NO: 7474 - DNA, 15 bp, Homo sapiens
ggcccccaggttttt

SEQ ID NO: 7475 - DNA, 15 bp, Homo sapiens
gggcccccaggtttt

SEQ ID NO: 7476 - DNA, 15 bp, Homo sapiens
ggggcccccaggttt

SEQ ID NO: 7477 - DNA, 15 bp, Homo sapiens
tggggcccccaggtt

SEQ ID NO: 7478 - DNA, 15 bp, Homo sapiens
ctggggcccccaggt

SEQ ID NO: 7479 - DNA, 15 bp, Homo sapiens
actggggcccccagg

SEQ ID NO: 7480 - DNA, 15 bp, Homo sapiens
gactggggcccccag

SEQ ID NO: 7481 - DNA, 15 bp, Homo sapiens
tgactggggccccca

SEQ ID NO: 7482 - DNA, 15 bp, Homo sapiens
atgactggggccccc

SEQ ID NO: 7483 - DNA, 15 bp, Homo sapiens
aatgactggggcccc

SEQ ID NO: 7484 - DNA, 15 bp, Homo sapiens
gaatgactggggccc

SEQ ID NO: 7485 - DNA, 15 bp, Homo sapiens
agaatgactggggcc

SEQ ID NO: 7486 - DNA, 15 bp, Homo sapiens
tagaatgactggggc

SEQ ID NO: 7487 - DNA, 15 bp, Homo sapiens
ctagaatgactgggg

SEQ ID NO: 7488 - DNA, 15 bp, Homo sapiens
cctagaatgactggg

SEQ ID NO: 7489 - DNA, 15 bp, Homo sapiens
acctagaatgactgg

SEQ ID NO: 7490 - DNA, 15 bp, Homo sapiens
gacctagaatgactg

SEQ ID NO: 7491 - DNA, 15 bp, Homo sapiens
agacctagaatgact

SEQ ID NO: 7492 - DNA, 15 bp, Homo sapiens
cagacctagaatgac

SEQ ID NO: 7493 - DNA, 15 bp, Homo sapiens
tcagacctagaatga

SEQ ID NO: 7494 - DNA, 15 bp, Homo sapiens
gtcagacctagaatg

SEQ ID NO: 7495 - DNA, 15 bp, Homo sapiens
tgtcagacctagaat

SEQ ID NO: 7496 - DNA, 15 bp, Homo sapiens
gtgtcagacctagaa

SEQ ID NO: 7497 - DNA, 15 bp, Homo sapiens
agtgtcagacctaga

SEQ ID NO: 7498 - DNA, 15 bp, Homo sapiens
gagtgtcagacctag

SEQ ID NO: 7499 - DNA, 15 bp, Homo sapiens
tgagtgtcagaccta

SEQ ID NO: 7500 - DNA, 15 bp, Homo sapiens
ctgagtgtcagacct

SEQ ID NO: 7501 - DNA, 15 bp, Homo sapiens
cctgagtgtcagacc

SEQ ID NO: 7502 - DNA, 15 bp, Homo sapiens
acctgagtgtcagac

SEQ ID NO: 7503 - DNA, 15 bp, Homo sapiens
cacctgagtgtcaga

SEQ ID NO: 7504 - DNA, 15 bp, Homo sapiens
gcacctgagtgtcag

SEQ ID NO: 7505 - DNA, 15 bp, Homo sapiens
agcacctgagtgtca

SEQ ID NO: 7506 - DNA, 15 bp, Homo sapiens
cagcacctgagtgtc

SEQ ID NO: 7507 - DNA, 15 bp, Homo sapiens
acagcacctgagtgt

SEQ ID NO: 7508 - DNA, 15 bp, Homo sapiens
tacagcacctgagtg

SEQ ID NO: 7509 - DNA, 15 bp, Homo sapiens
atacagcacctgagt

SEQ ID NO: 7510 - DNA, 15 bp, Homo sapiens
gatacagcacctgag

SEQ ID NO: 7511 - DNA, 15 bp, Homo sapiens
tgatacagcacctga

SEQ ID NO: 7512 - DNA, 15 bp, Homo sapiens
ctgatacagcacctg

SEQ ID NO: 7513 - DNA, 15 bp, Homo sapiens
gctgatacagcacct

SEQ ID NO: 7514 - DNA, 15 bp, Homo sapiens
agctgatacagcacc

SEQ ID NO: 7515 - DNA, 15 bp, Homo sapiens
cagctgatacagcac

SEQ ID NO: 7516 - DNA, 15 bp, Homo sapiens
gcagctgatacagca

SEQ ID NO: 7517 - DNA, 15 bp, Homo sapiens
tgcagctgatacagc

SEQ ID NO: 7518 - DNA, 15 bp, Homo sapiens
ctgcagctgatacag

SEQ ID NO: 7519 - DNA, 15 bp, Homo sapiens
actgcagctgataca

SEQ ID NO: 7520 - DNA, 15 bp, Homo sapiens
aactgcagctgatac

SEQ ID NO: 7521 - DNA, 15 bp, Homo sapiens
aaactgcagctgata

SEQ ID NO: 7522 - DNA, 15 bp, Homo sapiens
caaactgcagctgat

SEQ ID NO: 7523 - DNA, 15 bp, Homo sapiens
tcaaactgcagctga

SEQ ID NO: 7524 - DNA, 15 bp, Homo sapiens
ttcaaactgcagctg

SEQ ID NO: 7525 - DNA, 15 bp, Homo sapiens
gttcaaactgcagct

SEQ ID NO: 7526 - DNA, 15 bp, Homo sapiens
agttcaaactgcagc

SEQ ID NO: 7527 - DNA, 15 bp, Homo sapiens
tagttcaaactgcag

SEQ ID NO: 7528 - DNA, 15 bp, Homo sapiens
gtagttcaaactgca

SEQ ID NO: 7529 - DNA, 15 bp, Homo sapiens
agtagttcaaactgc

SEQ ID NO: 7530 - DNA, 15 bp, Homo sapiens
aagtagttcaaactg

SEQ ID NO: 7531 - DNA, 15 bp, Homo sapiens
caagtagttcaaact

SEQ ID NO: 7532 - DNA, 15 bp, Homo sapiens
ccaagtagttcaaac

SEQ ID NO: 7533 - DNA, 15 bp, Homo sapiens
gccaagtagttcaaa

SEQ ID NO: 7534 - DNA, 15 bp, Homo sapiens
tgccaagtagttcaa

SEQ ID NO: 7535 - DNA, 15 bp, Homo sapiens
gtgccaagtagttca

SEQ ID NO: 7536 - DNA, 15 bp, Homo sapiens
ggtgccaagtagttc

SEQ ID NO: 7537 - DNA, 15 bp, Homo sapiens
tggtgccaagtagtt

SEQ ID NO: 7538 - DNA, 15 bp, Homo sapiens
atggtgccaagtagt

SEQ ID NO: 7539 - DNA, 15 bp, Homo sapiens
aatggtgccaagtag

SEQ ID NO: 7540 - DNA, 15 bp, Homo sapiens
caatggtgccaagta

SEQ ID NO: 7541 - DNA, 15 bp, Homo sapiens
acaatggtgccaagt

SEQ ID NO: 7542 - DNA, 15 bp, Homo sapiens
cacaatggtgccaag

SEQ ID NO: 7543 - DNA, 15 bp, Homo sapiens
acacaatggtgccaa

SEQ ID NO: 7544 - DNA, 15 bp, Homo sapiens
cacacaatggtgcca

SEQ ID NO: 7545 - DNA, 15 bp, Homo sapiens
ccacacaatggtgcc

SEQ ID NO: 7546 - DNA, 15 bp, Homo sapiens
tccacacaatggtgc

SEQ ID NO: 7547 - DNA, 15 bp, Homo sapiens
gtccacacaatggtg

SEQ ID NO: 7548 - DNA, 15 bp, Homo sapiens
agtccacacaatggt

SEQ ID NO: 7549 - DNA, 15 bp, Homo sapiens
aagtccacacaatgg

SEQ ID NO: 7550 - DNA, 15 bp, Homo sapiens
aaagtccacacaatg

SEQ ID NO: 7551 - DNA, 15 bp, Homo sapiens
taaagtccacacaat

SEQ ID NO: 7552 - DNA, 15 bp, Homo sapiens
ctaaagtccacacaa

SEQ ID NO: 7553 - DNA, 15 bp, Homo sapiens
actaaagtccacaca

SEQ ID NO: 7554 - DNA, 15 bp, Homo sapiens
aactaaagtccacac

SEQ ID NO: 7555 - DNA, 15 bp, Homo sapiens
aaactaaagtccaca

SEQ ID NO: 7556 - DNA, 15 bp, Homo sapiens
aaaactaaagtccac

SEQ ID NO: 7557 - DNA, 15 bp, Homo sapiens
caaaactaaagtcca

SEQ ID NO: 7558 - DNA, 15 bp, Homo sapiens
acaaaactaaagtcc

SEQ ID NO: 7559 - DNA, 15 bp, Homo sapiens
tacaaaactaaagtc

SEQ ID NO: 7560 - DNA, 15 bp, Homo sapiens
ttacaaaactaaagt

SEQ ID NO: 7561 - DNA, 15 bp, Homo sapiens
tttacaaaactaaag

SEQ ID NO: 7562 - DNA, 15 bp, Homo sapiens
ttttacaaaactaaa

SEQ ID NO: 7563 - DNA, 15 bp, Homo sapiens
tttttacaaaactaa

SEQ ID NO: 7564 - DNA, 15 bp, Homo sapiens
atttttacaaaacta

SEQ ID NO: 7565 - DNA, 15 bp, Homo sapiens
catttttacaaaact

SEQ ID NO: 7566 - DNA, 15 bp, Homo sapiens
tcatttttacaaaac

SEQ ID NO: 7567 - DNA, 15 bp, Homo sapiens
ttcatttttacaaaa

SEQ ID NO: 7568 - DNA, 15 bp, Homo sapiens
attcatttttacaaa

SEQ ID NO: 7569 - DNA, 15 bp, Homo sapiens
cattcatttttacaa

SEQ ID NO: 7570 - DNA, 15 bp, Homo sapiens
ccattcatttttaca

SEQ ID NO: 7571 - DNA, 15 bp, Homo sapiens
accattcatttttac

SEQ ID NO: 7572 - DNA, 15 bp, Homo sapiens
aaccattcattttta

SEQ ID NO: 7573 - DNA, 15 bp, Homo sapiens
gaaccattcattttt

SEQ ID NO: 7574 - DNA, 15 bp, Homo sapiens
ggaaccattcatttt

SEQ ID NO: 7575 - DNA, 15 bp, Homo sapiens
aggaaccattcattt

SEQ ID NO: 7576 - DNA, 15 bp, Homo sapiens
aaggaaccattcatt

SEQ ID NO: 7577 - DNA, 15 bp, Homo sapiens
taaggaaccattcat

SEQ ID NO: 7578 - DNA, 15 bp, Homo sapiens
ttaaggaaccattca

SEQ ID NO: 7579 - DNA, 15 bp, Homo sapiens
attaaggaaccattc

SEQ ID NO: 7580 - DNA, 15 bp, Homo sapiens
aattaaggaaccatt

SEQ ID NO: 7581 - DNA, 15 bp, Homo sapiens
aaattaaggaaccat

SEQ ID NO: 7582 - DNA, 15 bp, Homo sapiens
gaaattaaggaacca

SEQ ID NO: 7583 - DNA, 15 bp, Homo sapiens
agaaattaaggaacc

SEQ ID NO: 7584 - DNA, 15 bp, Homo sapiens
gagaaattaaggaac

SEQ ID NO: 7585 - DNA, 15 bp, Homo sapiens
tgagaaattaaggaa

SEQ ID NO: 7586 - DNA, 15 bp, Homo sapiens
ttgagaaattaagga

SEQ ID NO: 7587 - DNA, 15 bp, Homo sapiens
gttgagaaattaagg

SEQ ID NO: 7588 - DNA, 15 bp, Homo sapiens
ggttgagaaattaag

SEQ ID NO: 7589 - DNA, 15 bp, Homo sapiens
aggttgagaaattaa

SEQ ID NO: 7590 - DNA, 15 bp, Homo sapiens
aaggttgagaaatta

SEQ ID NO: 7591 - DNA, 15 bp, Homo sapiens
gaaggttgagaaatt

SEQ ID NO: 7592 - DNA, 15 bp, Homo sapiens
tgaaggttgagaaat

SEQ ID NO: 7593 - DNA, 15 bp, Homo sapiens
ctgaaggttgagaaa

SEQ ID NO: 7594 - DNA, 15 bp, Homo sapiens
cctgaaggttgagaa

SEQ ID NO: 7595 - DNA, 15 bp, Homo sapiens
gcctgaaggttgaga

SEQ ID NO: 7596 - DNA, 15 bp, Homo sapiens
agcctgaaggttgag

SEQ ID NO: 7597 - DNA, 15 bp, Homo sapiens
gagcctgaaggttga

SEQ ID NO: 7598 - DNA, 15 bp, Homo sapiens
tgagcctgaaggttg

SEQ ID NO: 7599 - DNA, 15 bp, Homo sapiens
ttgagcctgaaggtt

SEQ ID NO: 7600 - DNA, 15 bp, Homo sapiens
gttgagcctgaaggt

SEQ ID NO: 7601 - DNA, 15 bp, Homo sapiens
tgttgagcctgaagg

SEQ ID NO: 7602 - DNA, 15 bp, Homo sapiens
atgttgagcctgaag

SEQ ID NO: 7603 - DNA, 15 bp, Homo sapiens
gatgttgagcctgaa

SEQ ID NO: 7604 - DNA, 15 bp, Homo sapiens
agatgttgagcctga

SEQ ID NO: 7605 - DNA, 15 bp, Homo sapiens
gagatgttgagcctg

SEQ ID NO: 7606 - DNA, 15 bp, Homo sapiens
tgagatgttgagcct

SEQ ID NO: 7607 - DNA, 15 bp, Homo sapiens
ttgagatgttgagcc

SEQ ID NO: 7608 - DNA, 15 bp, Homo sapiens
cttgagatgttgagc

SEQ ID NO: 7609 - DNA, 15 bp, Homo sapiens
gcttgagatgttgag

SEQ ID NO: 7610 - DNA, 15 bp, Homo sapiens
agcttgagatgttga

SEQ ID NO: 7611 - DNA, 15 bp, Homo sapiens
cagcttgagatgttg

SEQ ID NO: 7612 - DNA, 15 bp, Homo sapiens
acagcttgagatgtt

SEQ ID NO: 7613 - DNA, 15 bp, Homo sapiens
aacagcttgagatgt

SEQ ID NO: 7614 - DNA, 15 bp, Homo sapiens
aaacagcttgagatg

SEQ ID NO: 7615 - DNA, 15 bp, Homo sapiens
caaacagcttgagat

SEQ ID NO: 7616 - DNA, 15 bp, Homo sapiens
acaaacagcttgaga

SEQ ID NO: 7617 - DNA, 15 bp, Homo sapiens
aacaaacagcttgag

SEQ ID NO: 7618 - DNA, 15 bp, Homo sapiens
caacaaacagcttga

SEQ ID NO: 7619 - DNA, 15 bp, Homo sapiens
acaacaaacagcttg

SEQ ID NO: 7620 - DNA, 15 bp, Homo sapiens
aacaacaaacagctt

SEQ ID NO: 7621 - DNA, 15 bp, Homo sapiens
caacaacaaacagct

SEQ ID NO: 7622 - DNA, 15 bp, Homo sapiens
acaacaacaaacagc

SEQ ID NO: 7623 - DNA, 15 bp, Homo sapiens
aacaacaacaaacag

SEQ ID NO: 7624 - DNA, 15 bp, Homo sapiens
caacaacaacaaaca

SEQ ID NO: 7625 - DNA, 15 bp, Homo sapiens
acaacaacaacaaac

SEQ ID NO: 7626 - DNA, 15 bp, Homo sapiens
aacaacaacaacaaa

SEQ ID NO: 7627 - DNA, 15 bp, Homo sapiens
caacaacaacaacaa

SEQ ID NO: 7628 - DNA, 15 bp, Homo sapiens
acaacaacaacaaca

SEQ ID NO: 7629 - DNA, 15 bp, Homo sapiens
aacaacaacaacaac

SEQ ID NO: 7630 - DNA, 15 bp, Homo sapiens
aaacaacaacaacaa

SEQ ID NO: 7631 - DNA, 15 bp, Homo sapiens
aaaacaacaacaaca

SEQ ID NO: 7632 - DNA, 15 bp, Homo sapiens
caaaacaacaacaac

SEQ ID NO: 7633 - DNA, 15 bp, Homo sapiens
acaaaacaacaacaa

SEQ ID NO: 7634 - DNA, 15 bp, Homo sapiens
aacaaaacaacaaca

SEQ ID NO: 7635 - DNA, 15 bp, Homo sapiens
aaacaaaacaacaac

SEQ ID NO: 7636 - DNA, 15 bp, Homo sapiens
aaaacaaaacaacaa

SEQ ID NO: 7637 - DNA, 15 bp, Homo sapiens
caaaacaaaacaaca

SEQ ID NO: 7638 - DNA, 15 bp, Homo sapiens
acaaaacaaaacaac

SEQ ID NO: 7639 - DNA, 15 bp, Homo sapiens
gacaaaacaaaacaa

SEQ ID NO: 7640 - DNA, 15 bp, Homo sapiens
agacaaaacaaaaca

SEQ ID NO: 7641 - DNA, 15 bp, Homo sapiens
aagacaaaacaaaac

SEQ ID NO: 7642 - DNA, 15 bp, Homo sapiens
aaagacaaaacaaaa

SEQ ID NO: 7643 - DNA, 15 bp, Homo sapiens
aaaagacaaaacaaa

SEQ ID NO: 7644 - DNA, 15 bp, Homo sapiens
aaaaagacaaaacaa

SEQ ID NO: 7645 - DNA, 15 bp, Homo sapiens
caaaaagacaaaaca

SEQ ID NO: 7646 - DNA, 15 bp, Homo sapiens
tcaaaaagacaaaac

SEQ ID NO: 7647 - DNA, 15 bp, Homo sapiens
ctaatcaaaaagaca

SEQ ID NO: 7648 - DNA, 15 bp, Homo sapiens
actaatcaaaaagac

SEQ ID NO: 7649 - DNA, 15 bp, Homo sapiens
cactaatcaaaaaga

SEQ ID NO: 7650 - DNA, 15 bp, Homo sapiens
ccactaatcaaaaag

SEQ ID NO: 7651 - DNA, 15 bp, Homo sapiens
accactaatcaaaaa

SEQ ID NO: 7652 - DNA, 15 bp, Homo sapiens
gaccactaatcaaaa

SEQ ID NO: 7653 - DNA, 15 bp, Homo sapiens
tgaccactaatcaaa

SEQ ID NO: 7654 - DNA, 15 bp, Homo sapiens
gtgaccactaatcaa

SEQ ID NO: 7655 - DNA, 15 bp, Homo sapiens
agtgaccactaatca

SEQ ID NO: 7656 - DNA, 15 bp, Homo sapiens
gagtgaccactaatc

SEQ ID NO: 7657 - DNA, 15 bp, Homo sapiens
ggagtgaccactaat

SEQ ID NO: 7658 - DNA, 15 bp, Homo sapiens
cggagtgaccactaa

SEQ ID NO: 7659 - DNA, 15 bp, Homo sapiens
gcggagtgaccacta

SEQ ID NO: 7660 - DNA, 15 bp, Homo sapiens
tgcggagtgaccact

SEQ ID NO: 7661 - DNA, 15 bp, Homo sapiens
atgcggagtgaccac

SEQ ID NO: 7662 - DNA, 15 bp, Homo sapiens
aatgcggagtgacca

SEQ ID NO: 7663 - DNA, 15 bp, Homo sapiens
aaatgcggagtgacc

SEQ ID NO: 7664 - DNA, 15 bp, Homo sapiens
caaatgcggagtgac

SEQ ID NO: 7665 - DNA, 15 bp, Homo sapiens
tcaaatgcggagtga

SEQ ID NO: 7666 - DNA, 15 bp, Homo sapiens
atcaaatgcggagtg

SEQ ID NO: 7667 - DNA, 15 bp, Homo sapiens
catcaaatgcggagt

SEQ ID NO: 7668 - DNA, 15 bp, Homo sapiens
acatcaaatgcggag

SEQ ID NO: 7669 - DNA, 15 bp, Homo sapiens
aacatcaaatgcgga

SEQ ID NO: 7670 - DNA, 15 bp, Homo sapiens
aaacatcaaatgcgg

SEQ ID NO: 7671 - DNA, 15 bp, Homo sapiens
aaaacatcaaatgcg

SEQ ID NO: 7672 - DNA, 15 bp, Homo sapiens
caaaacatcaaatgc

SEQ ID NO: 7673 - DNA, 15 bp, Homo sapiens
tcaaaacatcaaatg

SEQ ID NO: 7674 - DNA, 15 bp, Homo sapiens
gtcaaaacatcaaat

SEQ ID NO: 7675 - DNA, 15 bp, Homo sapiens
tgtcaaaacatcaaa

SEQ ID NO: 7676 - DNA, 15 bp, Homo sapiens
atgtcaaaacatcaa

SEQ ID NO: 7677 - DNA, 15 bp, Homo sapiens
catgtcaaaacatca

SEQ ID NO: 7678 - DNA, 15 bp, Homo sapiens
acatgtcaaaacatc

SEQ ID NO: 7679 - DNA, 15 bp, Homo sapiens
cacatgtcaaaacat

SEQ ID NO: 7680 - DNA, 15 bp, Homo sapiens
ccacatgtcaaaaca

SEQ ID NO: 7681 - DNA, 15 bp, Homo sapiens
tccacatgtcaaaac

SEQ ID NO: 7682 - DNA, 15 bp, Homo sapiens
atccacatgtcaaaa

SEQ ID NO: 7683 - DNA, 15 bp, Homo sapiens
aatccacatgtcaaa

SEQ ID NO: 7684 - DNA, 15 bp, Homo sapiens
aaatccacatgtcaa

SEQ ID NO: 7685 - DNA, 15 bp, Homo sapiens
gaaatccacatgtca

SEQ ID NO: 7686 - DNA, 15 bp, Homo sapiens
tgaaatccacatgtc

SEQ ID NO: 7687 - DNA, 15 bp, Homo sapiens
ctgaaatccacatgt

SEQ ID NO: 7688 - DNA, 15 bp, Homo sapiens
tctgaaatccacatg

SEQ ID NO: 7689 - DNA, 15 bp, Homo sapiens
ttctgaaatccacat

SEQ ID NO: 7690 - DNA, 15 bp, Homo sapiens
gttctgaaatccaca

SEQ ID NO: 7691 - DNA, 15 bp, Homo sapiens
agttctgaaatccac

SEQ ID NO: 7692 - DNA, 15 bp, Homo sapiens
aagttctgaaatcca

SEQ ID NO: 7693 - DNA, 15 bp, Homo sapiens
gaagttctgaaatcc

SEQ ID NO: 7694 - DNA, 15 bp, Homo sapiens
agaagttctgaaatc

SEQ ID NO: 7695 - DNA, 15 bp, Homo sapiens
cagaagttctgaaat

SEQ ID NO: 7696 - DNA, 15 bp, Homo sapiens
acagaagttctgaaa

SEQ ID NO: 7697 - DNA, 15 bp, Homo sapiens
cacagaagttctgaa

SEQ ID NO: 7698 - DNA, 15 bp, Homo sapiens
acacagaagttctga

SEQ ID NO: 7699 - DNA, 15 bp, Homo sapiens
cacacagaagttctg

SEQ ID NO: 7700 - DNA, 15 bp, Homo sapiens
ccacacagaagttct

SEQ ID NO: 7701 - DNA, 15 bp, Homo sapiens
accacacagaagttc

SEQ ID NO: 7702 - DNA, 15 bp, Homo sapiens
taccacacagaagtt

SEQ ID NO: 7703 - DNA, 15 bp, Homo sapiens
ttaccacacagaagt

SEQ ID NO: 7704 - DNA, 15 bp, Homo sapiens
tttaccacacagaag

SEQ ID NO: 7705 - DNA, 15 bp, Homo sapiens
ctttaccacacagaa

SEQ ID NO: 7706 - DNA, 15 bp, Homo sapiens
gctttaccacacaga

SEQ ID NO: 7707 - DNA, 15 bp, Homo sapiens
tgctttaccacacag

SEQ ID NO: 7708 - DNA, 15 bp, Homo sapiens
ctgctttaccacaca

SEQ ID NO: 7709 - DNA, 15 bp, Homo sapiens
tctgctttaccacac

SEQ ID NO: 7710 - DNA, 15 bp, Homo sapiens
ttctgctttaccaca

SEQ ID NO: 7711 - DNA, 15 bp, Homo sapiens
attctgctttaccac

SEQ ID NO: 7712 - DNA, 15 bp, Homo sapiens
cattctgctttacca

SEQ ID NO: 7713 - DNA, 15 bp, Homo sapiens
acattctgctttacc

SEQ ID NO: 7714 - DNA, 15 bp, Homo sapiens
aacattctgctttac

SEQ ID NO: 7715 - DNA, 15 bp, Homo sapiens
gaacattctgcttta

SEQ ID NO: 7716 - DNA, 15 bp, Homo sapiens
ggaacattctgcttt

SEQ ID NO: 7717 - DNA, 15 bp, Homo sapiens
tggaacattctgctt

SEQ ID NO: 7718 - DNA, 15 bp, Homo sapiens
ttggaacattctgct

SEQ ID NO: 7719 - DNA, 15 bp, Homo sapiens
attggaacattctgc

SEQ ID NO: 7720 - DNA, 15 bp, Homo sapiens
aattggaacattctg

SEQ ID NO: 7721 - DNA, 15 bp, Homo sapiens
caattggaacattct

SEQ ID NO: 7722 - DNA, 15 bp, Homo sapiens
tcaattggaacattc

SEQ ID NO: 7723 - DNA, 15 bp, Homo sapiens
ttcaattggaacatt

SEQ ID NO: 7724 - DNA, 15 bp, Homo sapiens
attcaattggaacat

SEQ ID NO: 7725 - DNA, 15 bp, Homo sapiens
aattcaattggaaca

SEQ ID NO: 7726 - DNA, 15 bp, Homo sapiens
aaattcaattggaac

SEQ ID NO: 7727 - DNA, 15 bp, Homo sapiens
aaaattcaattggaa

SEQ ID NO: 7728 - DNA, 15 bp, Homo sapiens
gaaaattcaattgga

SEQ ID NO: 7729 - DNA, 15 bp, Homo sapiens
ggaaaattcaattgg

SEQ ID NO: 7730 - DNA, 15 bp, Homo sapiens
gggaaaattcaattg

SEQ ID NO: 7731 - DNA, 15 bp, Homo sapiens
tgggaaaattcaatt

SEQ ID NO: 7732 - DNA, 15 bp, Homo sapiens
atgggaaaattcaat

SEQ ID NO: 7733 - DNA, 15 bp, Homo sapiens
aatgggaaaattcaa

SEQ ID NO: 7734 - DNA, 15 bp, Homo sapiens
aaatgggaaaattca

SEQ ID NO: 7735 - DNA, 15 bp, Homo sapiens
aaaatgggaaaattc

SEQ ID NO: 7736 - DNA, 15 bp, Homo sapiens
aaaaatgggaaaatt

SEQ ID NO: 7737 - DNA, 15 bp, Homo sapiens
aaaaaatgggaaaat

SEQ ID NO: 7738 - DNA, 15 bp, Homo sapiens
aaaaaaatgggaaaa

SEQ ID NO: 7739 - DNA, 15 bp, Homo sapiens
aaaaaaaatgggaaa

SEQ ID NO: 7740 - DNA, 15 bp, Homo sapiens
gaaaaaaaatgggaa

SEQ ID NO: 7741 - DNA, 15 bp, Homo sapiens
ggaaaaaaaatggga

SEQ ID NO: 7742 - DNA, 15 bp, Homo sapiens
gggaaaaaaaatggg

SEQ ID NO: 7743 - DNA, 15 bp, Homo sapiens
ggggaaaaaaaatgg

SEQ ID NO: 7744 - DNA, 15 bp, Homo sapiens
aggggaaaaaaaatg

SEQ ID NO: 7745 - DNA, 15 bp, Homo sapiens
taggggaaaaaaaat

SEQ ID NO: 7746 - DNA, 15 bp, Homo sapiens
ttaggggaaaaaaaa

SEQ ID NO: 7747 - DNA, 15 bp, Homo sapiens
cttaggggaaaaaaa

SEQ ID NO: 7748 - DNA, 15 bp, Homo sapiens
gcttaggggaaaaaa

SEQ ID NO: 7749 - DNA, 15 bp, Homo sapiens
tgcttaggggaaaaa

SEQ ID NO: 7750 - DNA, 15 bp, Homo sapiens
ttgcttaggggaaaa

SEQ ID NO: 7751 - DNA, 15 bp, Homo sapiens
tttgcttaggggaaa

SEQ ID NO: 7752 - DNA, 15 bp, Homo sapiens
ttttgcttaggggaa

SEQ ID NO: 7753 - DNA, 15 bp, Homo sapiens
tttttgcttagggga

SEQ ID NO: 7754 - DNA, 15 bp, Homo sapiens
atttttgcttagggg

SEQ ID NO: 7755 - DNA, 15 bp, Homo sapiens
catttttgcttaggg

SEQ ID NO: 7756 - DNA, 15 bp, Homo sapiens
acatttttgcttagg

SEQ ID NO: 7757 - DNA, 15 bp, Homo sapiens
cacatttttgcttag

SEQ ID NO: 7758 - DNA, 15 bp, Homo sapiens
tcacatttttgctta

SEQ ID NO: 7759 - DNA, 15 bp, Homo sapiens
ctcacatttttgctt

SEQ ID NO: 7760 - DNA, 15 bp, Homo sapiens
actcacatttttgct

SEQ ID NO: 7761 - DNA, 15 bp, Homo sapiens
aactcacatttttgc

SEQ ID NO: 7762 - DNA, 15 bp, Homo sapiens
aaactcacatttttg

SEQ ID NO: 7763 - DNA, 15 bp, Homo sapiens
aaaactcacattttt

SEQ ID NO: 7764 - DNA, 15 bp, Homo sapiens
gaaaactcacatttt

SEQ ID NO: 7765 - DNA, 15 bp, Homo sapiens
tgaaaactcacattt

SEQ ID NO: 7766 - DNA, 15 bp, Homo sapiens
gtgaaaactcacatt

SEQ ID NO: 7767 - DNA, 15 bp, Homo sapiens
agtgaaaactcacat

SEQ ID NO: 7768 - DNA, 15 bp, Homo sapiens
aagtgaaaactcaca

SEQ ID NO: 7769 - DNA, 15 bp, Homo sapiens
taagtgaaaactcac

SEQ ID NO: 7770 - DNA, 15 bp, Homo sapiens
ataagtgaaaactca

SEQ ID NO: 7771 - DNA, 15 bp, Homo sapiens
cataagtgaaaactc

SEQ ID NO: 7772 - DNA, 15 bp, Homo sapiens
gcataagtgaaaact

SEQ ID NO: 7773 - DNA, 15 bp, Homo sapiens
cgcataagtgaaaac

SEQ ID NO: 7774 - DNA, 15 bp, Homo sapiens
ccgcataagtgaaaa

SEQ ID NO: 7775 - DNA, 15 bp, Homo sapiens
gccgcataagtgaaa

SEQ ID NO: 7776 - DNA, 15 bp, Homo sapiens
ggccgcataagtgaa

SEQ ID NO: 7777 - DNA, 15 bp, Homo sapiens
tggccgcataagtga

SEQ ID NO: 7778 - DNA, 15 bp, Homo sapiens
atggccgcataagtg

SEQ ID NO: 7779 - DNA, 15 bp, Homo sapiens
aatggccgcataagt

SEQ ID NO: 7780 - DNA, 15 bp, Homo sapiens
caatggccgcataag

SEQ ID NO: 7781 - DNA, 15 bp, Homo sapiens
acaatggccgcataa

SEQ ID NO: 7782 - DNA, 15 bp, Homo sapiens
cacaatggccgcata

SEQ ID NO: 7783 - DNA, 15 bp, Homo sapiens
tcacaatggccgcat

SEQ ID NO: 7784 - DNA, 15 bp, Homo sapiens
atcacaatggccgca

SEQ ID NO: 7785 - DNA, 15 bp, Homo sapiens
aatcacaatggccgc

SEQ ID NO: 7786 - DNA, 15 bp, Homo sapiens
gaatcacaatggccg

SEQ ID NO: 7787 - DNA, 15 bp, Homo sapiens
ggaatcacaatggcc

SEQ ID NO: 7788 - DNA, 15 bp, Homo sapiens
cggaatcacaatggc

SEQ ID NO: 7789 - DNA, 15 bp, Homo sapiens
tcggaatcacaatgg

SEQ ID NO: 7790 - DNA, 15 bp, Homo sapiens
gtcggaatcacaatg

SEQ ID NO: 7791 - DNA, 15 bp, Homo sapiens
agtcggaatcacaat

SEQ ID NO: 7792 - DNA, 15 bp, Homo sapiens
cagtcggaatcacaa

SEQ ID NO: 7793 - DNA, 15 bp, Homo sapiens
tcagtcggaatcaca

SEQ ID NO: 7794 - DNA, 15 bp, Homo sapiens
ctcagtcggaatcac

SEQ ID NO: 7795 - DNA, 15 bp, Homo sapiens
tctcagtcggaatca

SEQ ID NO: 7796 - DNA, 15 bp, Homo sapiens
gtctcagtcggaatc

SEQ ID NO: 7797 - DNA, 15 bp, Homo sapiens
ggtctcagtcggaat

SEQ ID NO: 7798 - DNA, 15 bp, Homo sapiens
gggtctcagtcggaa

SEQ ID NO: 7799 - DNA, 15 bp, Homo sapiens
agggtctcagtcgga

SEQ ID NO: 7800 - DNA, 15 bp, Homo sapiens
tagggtctcagtcgg

SEQ ID NO: 7801 - DNA, 15 bp, Homo sapiens
ttagggtctcagtcg

SEQ ID NO: 7802 - DNA, 15 bp, Homo sapiens
cttagggtctcagtc

SEQ ID NO: 7803 - DNA, 15 bp, Homo sapiens
acttagggtctcagt

SEQ ID NO: 7804 - DNA, 15 bp, Homo sapiens
gacttagggtctcag

SEQ ID NO: 7805 - DNA, 15 bp, Homo sapiens
cgacttagggtctca

SEQ ID NO: 7806 - DNA, 15 bp, Homo sapiens
acgacttagggtctc

SEQ ID NO: 7807 - DNA, 15 bp, Homo sapiens
aacgacttagggtct

SEQ ID NO: 7808 - DNA, 15 bp, Homo sapiens
gaacgacttagggtc

SEQ ID NO: 7809 - DNA, 15 bp, Homo sapiens
agaacgacttagggt

SEQ ID NO: 7810 - DNA, 15 bp, Homo sapiens
aagaacgacttaggg

SEQ ID NO: 7811 - DNA, 15 bp, Homo sapiens
aaagaacgacttagg

SEQ ID NO: 7812 - DNA, 15 bp, Homo sapiens
caaagaacgacttag

SEQ ID NO: 7813 - DNA, 15 bp, Homo sapiens
acaaagaacgactta

SEQ ID NO: 7814 - DNA, 15 bp, Homo sapiens
aacaaagaacgactt

SEQ ID NO: 7815 - DNA, 15 bp, Homo sapiens
caacaaagaacgact

SEQ ID NO: 7816 - DNA, 15 bp, Homo sapiens
acaacaaagaacgac

SEQ ID NO: 7817 - DNA, 15 bp, Homo sapiens
gacaacaaagaacga

SEQ ID NO: 7818 - DNA, 15 bp, Homo sapiens
agacaacaaagaacg

SEQ ID NO: 7819 - DNA, 15 bp, Homo sapiens
gagacaacaaagaac

SEQ ID NO: 7820 - DNA, 15 bp, Homo sapiens
agagacaacaaagaa

SEQ ID NO: 7821 - DNA, 15 bp, Homo sapiens
gagagacaacaaaga

SEQ ID NO: 7822 - DNA, 15 bp, Homo sapiens
agagagacaacaaag

SEQ ID NO: 7823 - DNA, 15 bp, Homo sapiens
tagagagacaacaaa

SEQ ID NO: 7824 - DNA, 15 bp, Homo sapiens
ctagagagacaacaa

SEQ ID NO: 7825 - DNA, 15 bp, Homo sapiens
actagagagacaaca

SEQ ID NO: 7826 - DNA, 15 bp, Homo sapiens
cactagagagacaac

SEQ ID NO: 7827 - DNA, 15 bp, Homo sapiens
ccactagagagacaa

SEQ ID NO: 7828 - DNA, 15 bp, Homo sapiens
accactagagagaca

SEQ ID NO: 7829 - DNA, 15 bp, Homo sapiens
aaccactagagagac

SEQ ID NO: 7830 - DNA, 15 bp, Homo sapiens
aaaccactagagaga

SEQ ID NO: 7831 - DNA, 15 bp, Homo sapiens
gaaaccactagagag

SEQ ID NO: 7832 - DNA, 15 bp, Homo sapiens
agaaaccactagaga

SEQ ID NO: 7833 - DNA, 15 bp, Homo sapiens
cagaaaccactagag

SEQ ID NO: 7834 - DNA, 15 bp, Homo sapiens
tcagaaaccactaga

SEQ ID NO: 7835 - DNA, 15 bp, Homo sapiens
gtcagaaaccactag

SEQ ID NO: 7836 - DNA, 15 bp, Homo sapiens
tgtcagaaaccacta

SEQ ID NO: 7837 - DNA, 15 bp, Homo sapiens
gtgtcagaaaccact

SEQ ID NO: 7838 - DNA, 15 bp, Homo sapiens
ggtgtcagaaaccac

SEQ ID NO: 7839 - DNA, 15 bp, Homo sapiens
aggtgtcagaaacca

SEQ ID NO: 7840 - DNA, 15 bp, Homo sapiens
gaggtgtcagaaacc

SEQ ID NO: 7841 - DNA, 15 bp, Homo sapiens
tgaggtgtcagaaac

SEQ ID NO: 7842 - DNA, 15 bp, Homo sapiens
ctgaggtgtcagaaa

SEQ ID NO: 7843 - DNA, 15 bp, Homo sapiens
actgaggtgtcagaa

SEQ ID NO: 7844 - DNA, 15 bp, Homo sapiens
cactgaggtgtcaga

SEQ ID NO: 7845 - DNA, 15 bp, Homo sapiens
acactgaggtgtcag

SEQ ID NO: 7846 - DNA, 15 bp, Homo sapiens
cacactgaggtgtca

SEQ ID NO: 7847 - DNA, 15 bp, Homo sapiens
tcacactgaggtgtc

SEQ ID NO: 7848 - DNA, 15 bp, Homo sapiens
ttcacactgaggtgt

SEQ ID NO: 7849 - DNA, 15 bp, Homo sapiens
cttcacactgaggtg

SEQ ID NO: 7850 - DNA, 15 bp, Homo sapiens
gcttcacactgaggt

SEQ ID NO: 7851 - DNA, 15 bp, Homo sapiens
agcttcacactgagg

SEQ ID NO: 7852 - DNA, 15 bp, Homo sapiens
cagcttcacactgag

SEQ ID NO: 7853 - DNA, 15 bp, Homo sapiens
acagcttcacactga

SEQ ID NO: 7854 - DNA, 15 bp, Homo sapiens
aacagcttcacactg

SEQ ID NO: 7855 - DNA, 15 bp, Homo sapiens
caacagcttcacact

SEQ ID NO: 7856 - DNA, 15 bp, Homo sapiens
acaacagcttcacac

SEQ ID NO: 7857 - DNA, 15 bp, Homo sapiens
tacaacagcttcaca

SEQ ID NO: 7858 - DNA, 15 bp, Homo sapiens
ctacaacagcttcac

SEQ ID NO: 7859 - DNA, 15 bp, Homo sapiens
tctacaacagcttca

SEQ ID NO: 7860 - DNA, 15 bp, Homo sapiens
gtctacaacagcttc

SEQ ID NO: 7861 - DNA, 15 bp, Homo sapiens
tgtctacaacagctt

SEQ ID NO: 7862 - DNA, 15 bp, Homo sapiens
atgtctacaacagct

SEQ ID NO: 7863 - DNA, 15 bp, Homo sapiens
gatgtctacaacagc

SEQ ID NO: 7864 - DNA, 15 bp, Homo sapiens
ggatgtctacaacag

SEQ ID NO: 7865 - DNA, 15 bp, Homo sapiens
tggatgtctacaaca

SEQ ID NO: 7866 - DNA, 15 bp, Homo sapiens
atggatgtctacaac

SEQ ID NO: 7867 - DNA, 15 bp, Homo sapiens
tatggatgtctacaa

SEQ ID NO: 7868 - DNA, 15 bp, Homo sapiens
ttatggatgtctaca

SEQ ID NO: 7869 - DNA, 15 bp, Homo sapiens
cttatggatgtctac

SEQ ID NO: 7870 - DNA, 15 bp, Homo sapiens
tcttatggatgtcta

SEQ ID NO: 7871 - DNA, 15 bp, Homo sapiens
ttcttatggatgtct

SEQ ID NO: 7872 - DNA, 15 bp, Homo sapiens
tttcttatggatgtc

SEQ ID NO: 7873 - DNA, 15 bp, Homo sapiens
atttcttatggatgt

SEQ ID NO: 7874 - DNA, 15 bp, Homo sapiens
tatttcttatggatg

SEQ ID NO: 7875 - DNA, 15 bp, Homo sapiens
ctatttcttatggat

SEQ ID NO: 7876 - DNA, 15 bp, Homo sapiens
gctatttcttatgga

SEQ ID NO: 7877 - DNA, 15 bp, Homo sapiens
ggctatttcttatgg

SEQ ID NO: 7878 - DNA, 15 bp, Homo sapiens
aggctatttcttatg

SEQ ID NO: 7879 - DNA, 15 bp, Homo sapiens
caggctatttcttat

SEQ ID NO: 7880 - DNA, 15 bp, Homo sapiens
gcaggctatttctta

SEQ ID NO: 7881 - DNA, 15 bp, Homo sapiens
agcaggctatttctt

SEQ ID NO: 7882 - DNA, 15 bp, Homo sapiens
aagcaggctatttct

SEQ ID NO: 7883 - DNA, 15 bp, Homo sapiens
taagcaggctatttc

SEQ ID NO: 7884 - DNA, 15 bp, Homo sapiens
ctaagcaggctattt

SEQ ID NO: 7885 - DNA, 15 bp, Homo sapiens
cctaagcaggctatt

SEQ ID NO: 7886 - DNA, 15 bp, Homo sapiens
ccctaagcaggctat

SEQ ID NO: 7887 - DNA, 15 bp, Homo sapiens
tccctaagcaggcta

SEQ ID NO: 7888 - DNA, 15 bp, Homo sapiens
atccctaagcaggct

SEQ ID NO: 7889 - DNA, 15 bp, Homo sapiens
aatccctaagcaggc

SEQ ID NO: 7890 - DNA, 15 bp, Homo sapiens
taatccctaagcagg

SEQ ID NO: 7891 - DNA, 15 bp, Homo sapiens
ataatccctaagcag

SEQ ID NO: 7892 - DNA, 15 bp, Homo sapiens
cataatccctaagca

SEQ ID NO: 7893 - DNA, 15 bp, Homo sapiens
acataatccctaagc

SEQ ID NO: 7894 - DNA, 15 bp, Homo sapiens
cacataatccctaag

SEQ ID NO: 7895 - DNA, 15 bp, Homo sapiens
tcacataatccctaa

SEQ ID NO: 7896 - DNA, 15 bp, Homo sapiens
ctcacataatcccta

SEQ ID NO: 7897 - DNA, 15 bp, Homo sapiens
cctcacataatccct

SEQ ID NO: 7898 - DNA, 15 bp, Homo sapiens
ccctcacataatccc

SEQ ID NO: 7899 - DNA, 15 bp, Homo sapiens
gccctcacataatcc

SEQ ID NO: 7900 - DNA, 15 bp, Homo sapiens
tgccctcacataatc

SEQ ID NO: 7901 - DNA, 15 bp, Homo sapiens
ttgccctcacataat

SEQ ID NO: 7902 - DNA, 15 bp, Homo sapiens
cttgccctcacataa

SEQ ID NO: 7903 - DNA, 15 bp, Homo sapiens
ccttgccctcacata

SEQ ID NO: 7904 - DNA, 15 bp, Homo sapiens
accttgccctcacat

SEQ ID NO: 7905 - DNA, 15 bp, Homo sapiens
aaccttgccctcaca

SEQ ID NO: 7906 - DNA, 15 bp, Homo sapiens
aaaccttgccctcac

SEQ ID NO: 7907 - DNA, 15 bp, Homo sapiens
caaaccttgccctca

SEQ ID NO: 7908 - DNA, 15 bp, Homo sapiens
ccaaaccttgccctc

SEQ ID NO: 7909 - DNA, 15 bp, Homo sapiens
gccaaaccttgccct

SEQ ID NO: 7910 - DNA, 15 bp, Homo sapiens
agccaaaccttgccc

SEQ ID NO: 7911 - DNA, 15 bp, Homo sapiens
cagccaaaccttgcc

SEQ ID NO: 7912 - DNA, 15 bp, Homo sapiens
tcagccaaaccttgc

SEQ ID NO: 7913 - DNA, 15 bp, Homo sapiens
ttcagccaaaccttg

SEQ ID NO: 7914 - DNA, 15 bp, Homo sapiens
cttcagccaaacctt

SEQ ID NO: 7915 - DNA, 15 bp, Homo sapiens
ccttcagccaaacct

SEQ ID NO: 7916 - DNA, 15 bp, Homo sapiens
tccttcagccaaacc

SEQ ID NO: 7917 - DNA, 15 bp, Homo sapiens
ctccttcagccaaac

SEQ ID NO: 7918 - DNA, 15 bp, Homo sapiens
tctccttcagccaaa

SEQ ID NO: 7919 - DNA, 15 bp, Homo sapiens
ttctccttcagccaa

SEQ ID NO: 7920 - DNA, 15 bp, Homo sapiens
attctccttcagcca

SEQ ID NO: 7921 - DNA, 15 bp, Homo sapiens
tattctccttcagcc

SEQ ID NO: 7922 - DNA, 15 bp, Homo sapiens
ctattctccttcagc

SEQ ID NO: 7923 - DNA, 15 bp, Homo sapiens
tctattctccttcag

SEQ ID NO: 7924 - DNA, 15 bp, Homo sapiens
ttctattctccttca

SEQ ID NO: 7925 - DNA, 15 bp, Homo sapiens
cttctattctccttc

SEQ ID NO: 7926 - DNA, 15 bp, Homo sapiens
ccttctattctcctt

SEQ ID NO: 7927 - DNA, 15 bp, Homo sapiens
accttctattctcct

SEQ ID NO: 7928 - DNA, 15 bp, Homo sapiens
caccttctattctcc

SEQ ID NO: 7929 - DNA, 15 bp, Homo sapiens
acaccttctattctc

SEQ ID NO: 7930 - DNA, 15 bp, Homo sapiens
cacaccttctattct

SEQ ID NO: 7931 - DNA, 15 bp, Homo sapiens
ccacaccttctattc

SEQ ID NO: 7932 - DNA, 15 bp, Homo sapiens
tccacaccttctatt

SEQ ID NO: 7933 - DNA, 15 bp, Homo sapiens
ttccacaccttctat

SEQ ID NO: 7934 - DNA, 15 bp, Homo sapiens
cttccacaccttcta

SEQ ID NO: 7935 - DNA, 15 bp, Homo sapiens
ccttccacaccttct

SEQ ID NO: 7936 - DNA, 15 bp, Homo sapiens
tccttccacaccttc

SEQ ID NO: 7937 - DNA, 15 bp, Homo sapiens
ttccttccacacctt

SEQ ID NO: 7938 - DNA, 15 bp, Homo sapiens
cttccttccacacct

SEQ ID NO: 7939 - DNA, 15 bp, Homo sapiens
gcttccttccacacc

SEQ ID NO: 7940 - DNA, 15 bp, Homo sapiens
cgcttccttccacac

SEQ ID NO: 7941 - DNA, 15 bp, Homo sapiens
ccgcttccttccaca

SEQ ID NO: 7942 - DNA, 15 bp, Homo sapiens
tccgcttccttccac

SEQ ID NO: 7943 - DNA, 15 bp, Homo sapiens
ttccgcttccttcca

SEQ ID NO: 7944 - DNA, 15 bp, Homo sapiens
cttccgcttccttcc

SEQ ID NO: 7945 - DNA, 15 bp, Homo sapiens
tcttccgcttccttc

SEQ ID NO: 7946 - DNA, 15 bp, Homo sapiens
gtcttccgcttcctt

SEQ ID NO: 7947 - DNA, 15 bp, Homo sapiens
ggtcttccgcttcct

SEQ ID NO: 7948 - DNA, 15 bp, Homo sapiens
tggtcttccgcttcc

SEQ ID NO: 7949 - DNA, 15 bp, Homo sapiens
ctggtcttccgcttc

SEQ ID NO: 7950 - DNA, 15 bp, Homo sapiens
tctggtcttccgctt

SEQ ID NO: 7951 - DNA, 15 bp, Homo sapiens
ttctggtcttccgct

SEQ ID NO: 7952 - DNA, 15 bp, Homo sapiens
cttctggtcttccgc

SEQ ID NO: 7953 - DNA, 15 bp, Homo sapiens
tcttctggtcttccg

SEQ ID NO: 7954 - DNA, 15 bp, Homo sapiens
ctcttctggtcttcc

SEQ ID NO: 7955 - DNA, 15 bp, Homo sapiens
gctcttctggtcttc

SEQ ID NO: 7956 - DNA, 15 bp, Homo sapiens
tgctcttctggtctt

SEQ ID NO: 7957 - DNA, 15 bp, Homo sapiens
atgctcttctggtct

SEQ ID NO: 7958 - DNA, 15 bp, Homo sapiens
gatgctcttctggtc

SEQ ID NO: 7959 - DNA, 15 bp, Homo sapiens
tgatgctcttctggt

SEQ ID NO: 7960 - DNA, 15 bp, Homo sapiens
gtgatgctcttctgg

SEQ ID NO: 7961 - DNA, 15 bp, Homo sapiens
tgtgatgctcttctg

SEQ ID NO: 7962 - DNA, 15 bp, Homo sapiens
gtgtgatgctcttct

SEQ ID NO: 7963 - DNA, 15 bp, Homo sapiens
agtgtgatgctcttc

SEQ ID NO: 7964 - DNA, 15 bp, Homo sapiens
cagtgtgatgctctt

SEQ ID NO: 7965 - DNA, 15 bp, Homo sapiens
gcagtgtgatgctct

SEQ ID NO: 7966 - DNA, 15 bp, Homo sapiens
ggcagtgtgatgctc

SEQ ID NO: 7967 - DNA, 15 bp, Homo sapiens
aggcagtgtgatgct

SEQ ID NO: 7968 - DNA, 15 bp, Homo sapiens
gaggcagtgtgatgc

SEQ ID NO: 7969 - DNA, 15 bp, Homo sapiens
tgaggcagtgtgatg

SEQ ID NO: 7970 - DNA, 15 bp, Homo sapiens
ttgaggcagtgtgat

SEQ ID NO: 7971 - DNA, 15 bp, Homo sapiens
cttgaggcagtgtga

SEQ ID NO: 7972 - DNA, 15 bp, Homo sapiens
acttgaggcagtgtg

SEQ ID NO: 7973 - DNA, 15 bp, Homo sapiens
gacttgaggcagtgt

SEQ ID NO: 7974 - DNA, 15 bp, Homo sapiens
ggacttgaggcagtg

SEQ ID NO: 7975 - DNA, 15 bp, Homo sapiens
gggacttgaggcagt

SEQ ID NO: 7976 - DNA, 15 bp, Homo sapiens
tgggacttgaggcag

SEQ ID NO: 7977 - DNA, 15 bp, Homo sapiens
ttgggacttgaggca

SEQ ID NO: 7978 - DNA, 15 bp, Homo sapiens
tttgggacttgaggc

SEQ ID NO: 7979 - DNA, 15 bp, Homo sapiens
atttgggacttgagg

SEQ ID NO: 7980 - DNA, 15 bp, Homo sapiens
aatttgggacttgag

SEQ ID NO: 7981 - DNA, 15 bp, Homo sapiens
aaatttgggacttga

SEQ ID NO: 7982 - DNA, 15 bp, Homo sapiens
caaatttgggacttg

SEQ ID NO: 7983 - DNA, 15 bp, Homo sapiens
tcaaatttgggactt

SEQ ID NO: 7984 - DNA, 15 bp, Homo sapiens
atcaaatttgggact

SEQ ID NO: 7985 - DNA, 15 bp, Homo sapiens
aatcaaatttgggac

SEQ ID NO: 7986 - DNA, 15 bp, Homo sapiens
gaatcaaatttggga

SEQ ID NO: 7987 - DNA, 15 bp, Homo sapiens
agaatcaaatttggg

SEQ ID NO: 7988 - DNA, 15 bp, Homo sapiens
cagaatcaaatttgg

SEQ ID NO: 7989 - DNA, 15 bp, Homo sapiens
gcagaatcaaatttg

SEQ ID NO: 7990 - DNA, 15 bp, Homo sapiens
agcagaatcaaattt

SEQ ID NO: 7991 - DNA, 15 bp, Homo sapiens
gagcagaatcaaatt

SEQ ID NO: 7992 - DNA, 15 bp, Homo sapiens
ggagcagaatcaaat

SEQ ID NO: 7993 - DNA, 15 bp, Homo sapiens
aggagcagaatcaaa

SEQ ID NO: 7994 - DNA, 15 bp, Homo sapiens
caggagcagaatcaa

SEQ ID NO: 7995 - DNA, 15 bp, Homo sapiens
tcaggagcagaatca

SEQ ID NO: 7996 - DNA, 15 bp, Homo sapiens
atcaggagcagaatc

SEQ ID NO: 7997 - DNA, 15 bp, Homo sapiens
gatcaggagcagaat

SEQ ID NO: 7998 - DNA, 15 bp, Homo sapiens
ggatcaggagcagaa

SEQ ID NO: 7999 - DNA, 15 bp, Homo sapiens
aggatcaggagcaga

SEQ ID NO: 8000 - DNA, 15 bp, Homo sapiens
caggatcaggagcag

SEQ ID NO: 8001 - DNA, 15 bp, Homo sapiens
acaggatcaggagca

SEQ ID NO: 8002 - DNA, 15 bp, Homo sapiens
cacaggatcaggagc

SEQ ID NO: 8003 - DNA, 15 bp, Homo sapiens
tcacaggatcaggag

SEQ ID NO: 8004 - DNA, 15 bp, Homo sapiens
gtcacaggatcagga

SEQ ID NO: 8005 - DNA, 15 bp, Homo sapiens
agtcacaggatcagg

SEQ ID NO: 8006 - DNA, 15 bp, Homo sapiens
gagtcacaggatcag

SEQ ID NO: 8007 - DNA, 15 bp, Homo sapiens
tgagtcacaggatca

SEQ ID NO: 8008 - DNA, 15 bp, Homo sapiens
ttgagtcacaggatc

SEQ ID NO: 8009 - DNA, 15 bp, Homo sapiens
tttgagtcacaggat

SEQ ID NO: 8010 - DNA, 15 bp, Homo sapiens
atttgagtcacagga

SEQ ID NO: 8011 - DNA, 15 bp, Homo sapiens
aatttgagtcacagg

SEQ ID NO: 8012 - DNA, 15 bp, Homo sapiens
caatttgagtcacag

SEQ ID NO: 8013 - DNA, 15 bp, Homo sapiens
acaatttgagtcaca

SEQ ID NO: 8014 - DNA, 15 bp, Homo sapiens
gacaatttgagtcac

SEQ ID NO: 8015 - DNA, 15 bp, Homo sapiens
tgacaatttgagtca

SEQ ID NO: 8016 - DNA, 15 bp, Homo sapiens
atgacaatttgagtc

SEQ ID NO: 8017 - DNA, 15 bp, Homo sapiens
aatgacaatttgagt

SEQ ID NO: 8018 - DNA, 15 bp, Homo sapiens
gaatgacaatttgag

SEQ ID NO: 8019 - DNA, 15 bp, Homo sapiens
agaatgacaatttga

SEQ ID NO: 8020 - DNA, 15 bp, Homo sapiens
gagaatgacaatttg

SEQ ID NO: 8021 - DNA, 15 bp, Homo sapiens
agagaatgacaattt

SEQ ID NO: 8022 - DNA, 15 bp, Homo sapiens
aagagaatgacaatt

SEQ ID NO: 8023 - DNA, 15 bp, Homo sapiens
aaagagaatgacaat

SEQ ID NO: 8024 - DNA, 15 bp, Homo sapiens
aaaagagaatgacaa

SEQ ID NO: 8025 - DNA, 15 bp, Homo sapiens
taaaagagaatgaca

SEQ ID NO: 8026 - DNA, 15 bp, Homo sapiens
gtaaaagagaatgac

SEQ ID NO: 8027 - DNA, 15 bp, Homo sapiens
agtaaaagagaatga

SEQ ID NO: 8028 - DNA, 15 bp, Homo sapiens
cagtaaaagagaatg

SEQ ID NO: 8029 - DNA, 15 bp, Homo sapiens
gcagtaaaagagaat

SEQ ID NO: 8030 - DNA, 15 bp, Homo sapiens
agcagtaaaagagaa

SEQ ID NO: 8031 - DNA, 15 bp, Homo sapiens
cagcagtaaaagaga

SEQ ID NO: 8032 - DNA, 15 bp, Homo sapiens
acagcagtaaaagag

SEQ ID NO: 8033 - DNA, 15 bp, Homo sapiens
cacagcagtaaaaga

SEQ ID NO: 8034 - DNA, 15 bp, Homo sapiens
ccacagcagtaaaag

SEQ ID NO: 8035 - DNA, 15 bp, Homo sapiens
cccacagcagtaaaa

SEQ ID NO: 8036 - DNA, 15 bp, Homo sapiens
ccccacagcagtaaa

SEQ ID NO: 8037 - DNA, 15 bp, Homo sapiens
accccacagcagtaa

SEQ ID NO: 8038 - DNA, 15 bp, Homo sapiens
caccccacagcagta

SEQ ID NO: 8039 - DNA, 15 bp, Homo sapiens
acaccccacagcagt

SEQ ID NO: 8040 - DNA, 15 bp, Homo sapiens
cacaccccacagcag

SEQ ID NO: 8041 - DNA, 15 bp, Homo sapiens
gcacaccccacagca

SEQ ID NO: 8042 - DNA, 15 bp, Homo sapiens
agcacaccccacagc

SEQ ID NO: 8043 - DNA, 15 bp, Homo sapiens
gagcacaccccacag

SEQ ID NO: 8044 - DNA, 15 bp, Homo sapiens
agagcacaccccaca

SEQ ID NO: 8045 - DNA, 15 bp, Homo sapiens
cagagcacaccccac

SEQ ID NO: 8046 - DNA, 15 bp, Homo sapiens
ccagagcacacccca

SEQ ID NO: 8047 - DNA, 15 bp, Homo sapiens
cccagagcacacccc

SEQ ID NO: 8048 - DNA, 15 bp, Homo sapiens
gcccagagcacaccc

SEQ ID NO: 8049 - DNA, 15 bp, Homo sapiens
ggcccagagcacacc

SEQ ID NO: 8050 - DNA, 15 bp, Homo sapiens
gggcccagagcacac

SEQ ID NO: 8051 - DNA, 15 bp, Homo sapiens
tgggcccagagcaca

SEQ ID NO: 8052 - DNA, 15 bp, Homo sapiens
ctgggcccagagcac

SEQ ID NO: 8053 - DNA, 15 bp, Homo sapiens
gctgggcccagagca

SEQ ID NO: 8054 - DNA, 15 bp, Homo sapiens
agctgggcccagagc

SEQ ID NO: 8055 - DNA, 15 bp, Homo sapiens
cagctgggcccagag

SEQ ID NO: 8056 - DNA, 15 bp, Homo sapiens
tcagctgggcccaga

SEQ ID NO: 8057 - DNA, 15 bp, Homo sapiens
gtcagctgggcccag

SEQ ID NO: 8058 - DNA, 15 bp, Homo sapiens
tgtcagctgggccca

SEQ ID NO: 8059 - DNA, 15 bp, Homo sapiens
ctgtcagctgggccc

SEQ ID NO: 8060 - DNA, 15 bp, Homo sapiens
cctgtcagctgggcc

SEQ ID NO: 8061 - DNA, 15 bp, Homo sapiens
tcctgtcagctgggc

SEQ ID NO: 8062 - DNA, 15 bp, Homo sapiens
gtcctgtcagctggg

SEQ ID NO: 8063 - DNA, 15 bp, Homo sapiens
tgtcctgtcagctgg

SEQ ID NO: 8064 - DNA, 15 bp, Homo sapiens
atgtcctgtcagctg

SEQ ID NO: 8065 - DNA, 15 bp, Homo sapiens
aatgtcctgtcagct

SEQ ID NO: 8066 - DNA, 15 bp, Homo sapiens
gaatgtcctgtcagc

SEQ ID NO: 8067 - DNA, 15 bp, Homo sapiens
agaatgtcctgtcag

SEQ ID NO: 8068 - DNA, 15 bp, Homo sapiens
aagaatgtcctgtca

SEQ ID NO: 8069 - DNA, 15 bp, Homo sapiens
aaagaatgtcctgtc

SEQ ID NO: 8070 - DNA, 15 bp, Homo sapiens
caaagaatgtcctgt

SEQ ID NO: 8071 - DNA, 15 bp, Homo sapiens
acaaagaatgtcctg

SEQ ID NO: 8072 - DNA, 15 bp, Homo sapiens
tacaaagaatgtcct

SEQ ID NO: 8073 - DNA, 15 bp, Homo sapiens
gtacaaagaatgtcc

SEQ ID NO: 8074 - DNA, 15 bp, Homo sapiens
agtacaaagaatgtc

SEQ ID NO: 8075 - DNA, 15 bp, Homo sapiens
gagtacaaagaatgt

SEQ ID NO: 8076 - DNA, 15 bp, Homo sapiens
ggagtacaaagaatg

SEQ ID NO: 8077 - DNA, 15 bp, Homo sapiens
tggagtacaaagaat

SEQ ID NO: 8078 - DNA, 15 bp, Homo sapiens
gtggagtacaaagaa

SEQ ID NO: 8079 - DNA, 15 bp, Homo sapiens
cgtggagtacaaaga

SEQ ID NO: 8080 - DNA, 15 bp, Homo sapiens
acgtggagtacaaag

SEQ ID NO: 8081 - DNA, 15 bp, Homo sapiens
tacgtggagtacaaa

SEQ ID NO: 8082 - DNA, 15 bp, Homo sapiens
atacgtggagtacaa

SEQ ID NO: 8083 - DNA, 15 bp, Homo sapiens
aatacgtggagtaca

SEQ ID NO: 8084 - DNA, 15 bp, Homo sapiens
aaatacgtggagtac

SEQ ID NO: 8085 - DNA, 15 bp, Homo sapiens
taaatacgtggagta

SEQ ID NO: 8086 - DNA, 15 bp, Homo sapiens
ataaatacgtggagt

SEQ ID NO: 8087 - DNA, 15 bp, Homo sapiens
cataaatacgtggag

SEQ ID NO: 8088 - DNA, 15 bp, Homo sapiens
gcataaatacgtgga

SEQ ID NO: 8089 - DNA, 15 bp, Homo sapiens
agcataaatacgtgg

SEQ ID NO: 8090 - DNA, 15 bp, Homo sapiens
cagcataaatacgtg

SEQ ID NO: 8091 - DNA, 15 bp, Homo sapiens
ccagcataaatacgt

SEQ ID NO: 8092 - DNA, 15 bp, Homo sapiens
accagcataaatacg

SEQ ID NO: 8093 - DNA, 15 bp, Homo sapiens
caccagcataaatac

SEQ ID NO: 8094 - DNA, 15 bp, Homo sapiens
ccaccagcataaata

SEQ ID NO: 8095 - DNA, 15 bp, Homo sapiens
cccaccagcataaat

SEQ ID NO: 8096 - DNA, 15 bp, Homo sapiens
tcccaccagcataaa

SEQ ID NO: 8097 - DNA, 15 bp, Homo sapiens
ctcccaccagcataa

SEQ ID NO: 8098 - DNA, 15 bp, Homo sapiens
actcccaccagcata

SEQ ID NO: 8099 - DNA, 15 bp, Homo sapiens
aactcccaccagcat

SEQ ID NO: 8100 - DNA, 15 bp, Homo sapiens
caactcccaccagca

SEQ ID NO: 8101 - DNA, 15 bp, Homo sapiens
acaactcccaccagc

SEQ ID NO: 8102 - DNA, 15 bp, Homo sapiens
tacaactcccaccag

SEQ ID NO: 8103 - DNA, 15 bp, Homo sapiens
atacaactcccacca

SEQ ID NO: 8104 - DNA, 15 bp, Homo sapiens
catacaactcccacc

SEQ ID NO: 8105 - DNA, 15 bp, Homo sapiens
ccatacaactcccac

SEQ ID NO: 8106 - DNA, 15 bp, Homo sapiens
gccatacaactccca

SEQ ID NO: 8107 - DNA, 15 bp, Homo sapiens
agccatacaactccc

SEQ ID NO: 8108 - DNA, 15 bp, Homo sapiens
tagccatacaactcc

SEQ ID NO: 8109 - DNA, 15 bp, Homo sapiens
ctagccatacaactc

SEQ ID NO: 8110 - DNA, 15 bp, Homo sapiens
actagccatacaact

SEQ ID NO: 8111 - DNA, 15 bp, Homo sapiens
cactagccatacaac

SEQ ID NO: 8112 - DNA, 15 bp, Homo sapiens
gcactagccatacaa

SEQ ID NO: 8113 - DNA, 15 bp, Homo sapiens
agcactagccataca

SEQ ID NO: 8114 - DNA, 15 bp, Homo sapiens
aagcactagccatac

SEQ ID NO: 8115 - DNA, 15 bp, Homo sapiens
aaagcactagccata

SEQ ID NO: 8116 - DNA, 15 bp, Homo sapiens
caaagcactagccat

SEQ ID NO: 8117 - DNA, 15 bp, Homo sapiens
acaaagcactagcca

SEQ ID NO: 8118 - DNA, 15 bp, Homo sapiens
cacaaagcactagcc

SEQ ID NO: 8119 - DNA, 15 bp, Homo sapiens
gcacaaagcactagc

SEQ ID NO: 8120 - DNA, 15 bp, Homo sapiens
agcacaaagcactag

SEQ ID NO: 8121 - DNA, 15 bp, Homo sapiens
aagcacaaagcacta

SEQ ID NO: 8122 - DNA, 15 bp, Homo sapiens
aaagcacaaagcact

SEQ ID NO: 8123 - DNA, 15 bp, Homo sapiens
caaagcacaaagcac

SEQ ID NO: 8124 - DNA, 15 bp, Homo sapiens
acaaagcacaaagca

SEQ ID NO: 8125 - DNA, 15 bp, Homo sapiens
gacaaagcacaaagc

SEQ ID NO: 8126 - DNA, 15 bp, Homo sapiens
agacaaagcacaaag

SEQ ID NO: 8127 - DNA, 15 bp, Homo sapiens
gagacaaagcacaaa

SEQ ID NO: 8128 - DNA, 15 bp, Homo sapiens
tgagacaaagcacaa

SEQ ID NO: 8129 - DNA, 15 bp, Homo sapiens
ctgagacaaagcaca

SEQ ID NO: 8130 - DNA, 15 bp, Homo sapiens
tctgagacaaagcac

SEQ ID NO: 8131 - DNA, 15 bp, Homo sapiens
ttctgagacaaagca

SEQ ID NO: 8132 - DNA, 15 bp, Homo sapiens
tttctgagacaaagc

SEQ ID NO: 8133 - DNA, 15 bp, Homo sapiens
atttctgagacaaag

SEQ ID NO: 8134 - DNA, 15 bp, Homo sapiens
aatttctgagacaaa

SEQ ID NO: 8135 - DNA, 15 bp, Homo sapiens
caatttctgagacaa

SEQ ID NO: 8136 - DNA, 15 bp, Homo sapiens
acaatttctgagaca

SEQ ID NO: 8137 - DNA, 15 bp, Homo sapiens
cacaatttctgagac

SEQ ID NO: 8138 - DNA, 15 bp, Homo sapiens
acacaatttctgaga

SEQ ID NO: 8139 - DNA, 15 bp, Homo sapiens
cacacaatttctgag

SEQ ID NO: 8140 - DNA, 15 bp, Homo sapiens
ccacacaatttctga

SEQ ID NO: 8141 - DNA, 15 bp, Homo sapiens
tccacacaatttctg

SEQ ID NO: 8142 - DNA, 15 bp, Homo sapiens
gtccacacaatttct

SEQ ID NO: 8143 - DNA, 15 bp, Homo sapiens
agtccacacaatttc

SEQ ID NO: 8144 - DNA, 15 bp, Homo sapiens
tagtccacacaattt

SEQ ID NO: 8145 - DNA, 15 bp, Homo sapiens
ttagtccacacaatt

SEQ ID NO: 8146 - DNA, 15 bp, Homo sapiens
tttagtccacacaat

SEQ ID NO: 8147 - DNA, 15 bp, Homo sapiens
atttagtccacacaa

SEQ ID NO: 8148 - DNA, 15 bp, Homo sapiens
catttagtccacaca

SEQ ID NO: 8149 - DNA, 15 bp, Homo sapiens
acatttagtccacac

SEQ ID NO: 8150 - DNA, 15 bp, Homo sapiens
tacatttagtccaca

SEQ ID NO: 8151 - DNA, 15 bp, Homo sapiens
ttacatttagtccac

SEQ ID NO: 8152 - DNA, 15 bp, Homo sapiens
attacatttagtcca

SEQ ID NO: 8153 - DNA, 15 bp, Homo sapiens
tattacatttagtcc

SEQ ID NO: 8154 - DNA, 15 bp, Homo sapiens
atattacatttagtc

SEQ ID NO: 8155 - DNA, 15 bp, Homo sapiens
catattacatttagt

SEQ ID NO: 8156 - DNA, 15 bp, Homo sapiens
ccatattacatttag

SEQ ID NO: 8157 - DNA, 15 bp, Homo sapiens
cccatattacattta

SEQ ID NO: 8158 - DNA, 15 bp, Homo sapiens
gcccatattacattt

SEQ ID NO: 8159 - DNA, 15 bp, Homo sapiens
tgcccatattacatt

SEQ ID NO: 8160 - DNA, 15 bp, Homo sapiens
ctgcccatattacat

SEQ ID NO: 8161 - DNA, 15 bp, Homo sapiens
actgcccatattaca

SEQ ID NO: 8162 - DNA, 15 bp, Homo sapiens
cactgcccatattac

SEQ ID NO: 8163 - DNA, 15 bp, Homo sapiens
tcactgcccatatta

SEQ ID NO: 8164 - DNA, 15 bp, Homo sapiens
ttcactgcccatatt

SEQ ID NO: 8165 - DNA, 15 bp, Homo sapiens
attcactgcccatat

SEQ ID NO: 8166 - DNA, 15 bp, Homo sapiens
cattcactgcccata

SEQ ID NO: 8167 - DNA, 15 bp, Homo sapiens
ccattcactgcccat

SEQ ID NO: 8168 - DNA, 15 bp, Homo sapiens
cccattcactgccca

SEQ ID NO: 8169 - DNA, 15 bp, Homo sapiens
acccattcactgccc

SEQ ID NO: 8170 - DNA, 15 bp, Homo sapiens
aacccattcactgcc

SEQ ID NO: 8171 - DNA, 15 bp, Homo sapiens
aaacccattcactgc

SEQ ID NO: 8172 - DNA, 15 bp, Homo sapiens
gaaacccattcactg

SEQ ID NO: 8173 - DNA, 15 bp, Homo sapiens
agaaacccattcact

SEQ ID NO: 8174 - DNA, 15 bp, Homo sapiens
aagaaacccattcac

SEQ ID NO: 8175 - DNA, 15 bp, Homo sapiens
gaagaaacccattca

SEQ ID NO: 8176 - DNA, 15 bp, Homo sapiens
agaagaaacccattc

SEQ ID NO: 8177 - DNA, 15 bp, Homo sapiens
cagaagaaacccatt

SEQ ID NO: 8178 - DNA, 15 bp, Homo sapiens
ccagaagaaacccat

SEQ ID NO: 8179 - DNA, 15 bp, Homo sapiens
tccagaagaaaccca

SEQ ID NO: 8180 - DNA, 15 bp, Homo sapiens
ttccagaagaaaccc

SEQ ID NO: 8181 - DNA, 15 bp, Homo sapiens
cttccagaagaaacc

SEQ ID NO: 8182 - DNA, 15 bp, Homo sapiens
tcttccagaagaaac

SEQ ID NO: 8183 - DNA, 15 bp, Homo sapiens
atcttccagaagaaa

SEQ ID NO: 8184 - DNA, 15 bp, Homo sapiens
catcttccagaagaa

SEQ ID NO: 8185 - DNA, 15 bp, Homo sapiens
acatcttccagaaga

SEQ ID NO: 8186 - DNA, 15 bp, Homo sapiens
aacatcttccagaag

SEQ ID NO: 8187 - DNA, 15 bp, Homo sapiens
taacatcttccagaa

SEQ ID NO: 8188 - DNA, 15 bp, Homo sapiens
ctaacatcttccaga

SEQ ID NO: 8189 - DNA, 15 bp, Homo sapiens
cctaacatcttccag

SEQ ID NO: 8190 - DNA, 15 bp, Homo sapiens
gcctaacatcttcca

SEQ ID NO: 8191 - DNA, 15 bp, Homo sapiens
ggcctaacatcttcc

SEQ ID NO: 8192 - DNA, 15 bp, Homo sapiens
aggcctaacatcttc

SEQ ID NO: 8193 - DNA, 15 bp, Homo sapiens
caggcctaacatctt

SEQ ID NO: 8194 - DNA, 15 bp, Homo sapiens
ccaggcctaacatct

SEQ ID NO: 8195 - DNA, 15 bp, Homo sapiens
tccaggcctaacatc

SEQ ID NO: 8196 - DNA, 15 bp, Homo sapiens
ctccaggcctaacat

SEQ ID NO: 8197 - DNA, 15 bp, Homo sapiens
cctccaggcctaaca

SEQ ID NO: 8198 - DNA, 15 bp, Homo sapiens
ccctccaggcctaac

SEQ ID NO: 8199 - DNA, 15 bp, Homo sapiens
accctccaggcctaa

SEQ ID NO: 8200 - DNA, 15 bp, Homo sapiens
caccctccaggccta

SEQ ID NO: 8201 - DNA, 15 bp, Homo sapiens
ccaccctccaggcct

SEQ ID NO: 8202 - DNA, 15 bp, Homo sapiens
accaccctccaggcc

SEQ ID NO: 8203 - DNA, 15 bp, Homo sapiens
aaccaccctccaggc

SEQ ID NO: 8204 - DNA, 15 bp, Homo sapiens
aaaccaccctccagg

SEQ ID NO: 8205 - DNA, 15 bp, Homo sapiens
caaaccaccctccag

SEQ ID NO: 8206 - DNA, 15 bp, Homo sapiens
ccaaaccaccctcca

SEQ ID NO: 8207 - DNA, 15 bp, Homo sapiens
cccaaaccaccctcc

SEQ ID NO: 8208 - DNA, 15 bp, Homo sapiens
acccaaaccaccctc

SEQ ID NO: 8209 - DNA, 15 bp, Homo sapiens
aacccaaaccaccct

SEQ ID NO: 8210 - DNA, 15 bp, Homo sapiens
aaacccaaaccaccc

SEQ ID NO: 8211 - DNA, 15 bp, Homo sapiens
aaaacccaaaccacc

SEQ ID NO: 8212 - DNA, 15 bp, Homo sapiens
aaaaacccaaaccac

SEQ ID NO: 8213 - DNA, 15 bp, Homo sapiens
taaaaacccaaacca

SEQ ID NO: 8214 - DNA, 15 bp, Homo sapiens
gtaaaaacccaaacc

SEQ ID NO: 8215 - DNA, 15 bp, Homo sapiens
cgtaaaaacccaaac

SEQ ID NO: 8216 - DNA, 15 bp, Homo sapiens
tcgtaaaaacccaaa

SEQ ID NO: 8217 - DNA, 15 bp, Homo sapiens
ctcgtaaaaacccaa

SEQ ID NO: 8218 - DNA, 15 bp, Homo sapiens
actcgtaaaaaccca

SEQ ID NO: 8219 - DNA, 15 bp, Homo sapiens
gactcgtaaaaaccc

SEQ ID NO: 8220 - DNA, 15 bp, Homo sapiens
agactcgtaaaaacc

SEQ ID NO: 8221 - DNA, 15 bp, Homo sapiens
aagactcgtaaaaac

SEQ ID NO: 8222 - DNA, 15 bp, Homo sapiens
aaagactcgtaaaaa

SEQ ID NO: 8223 - DNA, 15 bp, Homo sapiens
aaaagactcgtaaaa

SEQ ID NO: 8224 - DNA, 15 bp, Homo sapiens
aaaaagactcgtaaa

SEQ ID NO: 8225 - DNA, 15 bp, Homo sapiens
gaaaaagactcgtaa

SEQ ID NO: 8226 - DNA, 15 bp, Homo sapiens
agaaaaagactcgta

SEQ ID NO: 8227 - DNA, 15 bp, Homo sapiens
gagaaaaagactcgt

SEQ ID NO: 8228 - DNA, 15 bp, Homo sapiens
tgagaaaaagactcg

SEQ ID NO: 8229 - DNA, 15 bp, Homo sapiens
ctgagaaaaagactc

SEQ ID NO: 8230 - DNA, 15 bp, Homo sapiens
tctgagaaaaagact

SEQ ID NO: 8231 - DNA, 15 bp, Homo sapiens
atctgagaaaaagac

SEQ ID NO: 8232 - DNA, 15 bp, Homo sapiens
aatctgagaaaaaga

SEQ ID NO: 8233 - DNA, 15 bp, Homo sapiens
taatctgagaaaaag

SEQ ID NO: 8234 - DNA, 15 bp, Homo sapiens
gtaatctgagaaaaa

SEQ ID NO: 8235 - DNA, 15 bp, Homo sapiens
tgtaatctgagaaaa

SEQ ID NO: 8236 - DNA, 15 bp, Homo sapiens
ctgtaatctgagaaa

SEQ ID NO: 8237 - DNA, 15 bp, Homo sapiens
tctgtaatctgagaa

SEQ ID NO: 8238 - DNA, 15 bp, Homo sapiens
atctgtaatctgaga

SEQ ID NO: 8239 - DNA, 15 bp, Homo sapiens
aatctgtaatctgag

SEQ ID NO: 8240 - DNA, 15 bp, Homo sapiens
taatctgtaatctga

SEQ ID NO: 8241 - DNA, 15 bp, Homo sapiens
gtaatctgtaatctg

SEQ ID NO: 8242 - DNA, 15 bp, Homo sapiens
cgtaatctgtaatct

SEQ ID NO: 8243 - DNA, 15 bp, Homo sapiens
tcgtaatctgtaatc

SEQ ID NO: 8244 - DNA, 15 bp, Homo sapiens
ttcgtaatctgtaat

SEQ ID NO: 8245 - DNA, 15 bp, Homo sapiens
attcgtaatctgtaa

SEQ ID NO: 8246 - DNA, 15 bp, Homo sapiens
cattcgtaatctgta

SEQ ID NO: 8247 - DNA, 15 bp, Homo sapiens
ccattcgtaatctgt

SEQ ID NO: 8248 - DNA, 15 bp, Homo sapiens
tccattcgtaatctg

SEQ ID NO: 8249 - DNA, 15 bp, Homo sapiens
atccattcgtaatct

SEQ ID NO: 8250 - DNA, 15 bp, Homo sapiens
catccattcgtaatc

SEQ ID NO: 8251 - DNA, 15 bp, Homo sapiens
acatccattcgtaat

SEQ ID NO: 8252 - DNA, 15 bp, Homo sapiens
aacatccattcgtaa

SEQ ID NO: 8253 - DNA, 15 bp, Homo sapiens
taacatccattcgta

SEQ ID NO: 8254 - DNA, 15 bp, Homo sapiens
ataacatccattcgt

SEQ ID NO: 8255 - DNA, 15 bp, Homo sapiens
tataacatccattcg

SEQ ID NO: 8256 - DNA, 15 bp, Homo sapiens
ttataacatccattc

SEQ ID NO: 8257 - DNA, 15 bp, Homo sapiens
tttataacatccatt

SEQ ID NO: 8258 - DNA, 15 bp, Homo sapiens
ttttataacatccat

SEQ ID NO: 8259 - DNA, 15 bp, Homo sapiens
gttttataacatcca

SEQ ID NO: 8260 - DNA, 15 bp, Homo sapiens
tgttttataacatcc

SEQ ID NO: 8261 - DNA, 15 bp, Homo sapiens
ctgttttataacatc

SEQ ID NO: 8262 - DNA, 15 bp, Homo sapiens
cctgttttataacat

SEQ ID NO: 8263 - DNA, 15 bp, Homo sapiens
gcctgttttataaca

SEQ ID NO: 8264 - DNA, 15 bp, Homo sapiens
tgcctgttttataac

SEQ ID NO: 8265 - DNA, 15 bp, Homo sapiens
ctgcctgttttataa

SEQ ID NO: 8266 - DNA, 15 bp, Homo sapiens
actgcctgttttata

SEQ ID NO: 8267 - DNA, 15 bp, Homo sapiens
cactgcctgttttat

SEQ ID NO: 8268 - DNA, 15 bp, Homo sapiens
acactgcctgtttta

SEQ ID NO: 8269 - DNA, 15 bp, Homo sapiens
aacactgcctgtttt

SEQ ID NO: 8270 - DNA, 15 bp, Homo sapiens
caacactgcctgttt

SEQ ID NO: 8271 - DNA, 15 bp, Homo sapiens
tcaacactgcctgtt

SEQ ID NO: 8272 - DNA, 15 bp, Homo sapiens
gtcaacactgcctgt

SEQ ID NO: 8273 - DNA, 15 bp, Homo sapiens
tgtcaacactgcctg

SEQ ID NO: 8274 - DNA, 15 bp, Homo sapiens
gtgtcaacactgcct

SEQ ID NO: 8275 - DNA, 15 bp, Homo sapiens
ggtgtcaacactgcc

SEQ ID NO: 8276 - DNA, 15 bp, Homo sapiens
tggtgtcaacactgc

SEQ ID NO: 8277 - DNA, 15 bp, Homo sapiens
atggtgtcaacactg

SEQ ID NO: 8278 - DNA, 15 bp, Homo sapiens
tatggtgtcaacact

SEQ ID NO: 8279 - DNA, 15 bp, Homo sapiens
gtatggtgtcaacac

SEQ ID NO: 8280 - DNA, 15 bp, Homo sapiens
tgtatggtgtcaaca

SEQ ID NO: 8281 - DNA, 15 bp, Homo sapiens
ctgtatggtgtcaac

SEQ ID NO: 8282 - DNA, 15 bp, Homo sapiens
actgtatggtgtcaa

SEQ ID NO: 8283 - DNA, 15 bp, Homo sapiens
aactgtatggtgtca

SEQ ID NO: 8284 - DNA, 15 bp, Homo sapiens
aaactgtatggtgtc

SEQ ID NO: 8285 - DNA, 15 bp, Homo sapiens
gaaactgtatggtgt

SEQ ID NO: 8286 - DNA, 15 bp, Homo sapiens
agaaactgtatggtg

SEQ ID NO: 8287 - DNA, 15 bp, Homo sapiens
gagaaactgtatggt

SEQ ID NO: 8288 - DNA, 15 bp, Homo sapiens
ggagaaactgtatgg

SEQ ID NO: 8289 - DNA, 15 bp, Homo sapiens
aggagaaactgtatg

SEQ ID NO: 8290 - DNA, 15 bp, Homo sapiens
taggagaaactgtat

SEQ ID NO: 8291 - DNA, 15 bp, Homo sapiens
ttaggagaaactgta

SEQ ID NO: 8292 - DNA, 15 bp, Homo sapiens
cttaggagaaactgt

SEQ ID NO: 8293 - DNA, 15 bp, Homo sapiens
tcttaggagaaactg

SEQ ID NO: 8294 - DNA, 15 bp, Homo sapiens
ttcttaggagaaact

SEQ ID NO: 8295 - DNA, 15 bp, Homo sapiens
tttcttaggagaaac

SEQ ID NO: 8296 - DNA, 15 bp, Homo sapiens
atttcttaggagaaa

SEQ ID NO: 8297 - DNA, 15 bp, Homo sapiens
catttcttaggagaa

SEQ ID NO: 8298 - DNA, 15 bp, Homo sapiens
acatttcttaggaga

SEQ ID NO: 8299 - DNA, 15 bp, Homo sapiens
tacatttcttaggag

SEQ ID NO: 8300 - DNA, 15 bp, Homo sapiens
gtacatttcttagga

SEQ ID NO: 8301 - DNA, 15 bp, Homo sapiens
tgtacatttcttagg

SEQ ID NO: 8302 - DNA, 15 bp, Homo sapiens
ctgtacatttcttag

SEQ ID NO: 8303 - DNA, 15 bp, Homo sapiens
tctgtacatttctta

SEQ ID NO: 8304 - DNA, 15 bp, Homo sapiens
ctctgtacatttctt

SEQ ID NO: 8305 - DNA, 15 bp, Homo sapiens
tctctgtacatttct

SEQ ID NO: 8306 - DNA, 15 bp, Homo sapiens
ctctctgtacatttc

SEQ ID NO: 8307 - DNA, 15 bp, Homo sapiens
actctctgtacattt

SEQ ID NO: 8308 - DNA, 15 bp, Homo sapiens
aactctctgtacatt

SEQ ID NO: 8309 - DNA, 15 bp, Homo sapiens
gaactctctgtacat

SEQ ID NO: 8310 - DNA, 15 bp, Homo sapiens
tgaactctctgtaca

SEQ ID NO: 8311 - DNA, 15 bp, Homo sapiens
ttgaactctctgtac

SEQ ID NO: 8312 - DNA, 15 bp, Homo sapiens
gttgaactctctgta

SEQ ID NO: 8313 - DNA, 15 bp, Homo sapiens
ggttgaactctctgt

SEQ ID NO: 8314 - DNA, 15 bp, Homo sapiens
aggttgaactctctg

SEQ ID NO: 8315 - DNA, 15 bp, Homo sapiens
caggttgaactctct

SEQ ID NO: 8316 - DNA, 15 bp, Homo sapiens
tcaggttgaactctc

SEQ ID NO: 8317 - DNA, 15 bp, Homo sapiens
ctcaggttgaactct

SEQ ID NO: 8318 - DNA, 15 bp, Homo sapiens
cctcaggttgaactc

SEQ ID NO: 8319 - DNA, 15 bp, Homo sapiens
tcctcaggttgaact

SEQ ID NO: 8320 - DNA, 15 bp, Homo sapiens
ttcctcaggttgaac

SEQ ID NO: 8321 - DNA, 15 bp, Homo sapiens
cttcctcaggttgaa

SEQ ID NO: 8322 - DNA, 15 bp, Homo sapiens
gcttcctcaggttga

SEQ ID NO: 8323 - DNA, 15 bp, Homo sapiens
agcttcctcaggttg

SEQ ID NO: 8324 - DNA, 15 bp, Homo sapiens
tagcttcctcaggtt

SEQ ID NO: 8325 - DNA, 15 bp, Homo sapiens
ttagcttcctcaggt

SEQ ID NO: 8326 - DNA, 15 bp, Homo sapiens
attagcttcctcagg

SEQ ID NO: 8327 - DNA, 15 bp, Homo sapiens
aattagcttcctcag

SEQ ID NO: 8328 - DNA, 15 bp, Homo sapiens
caattagcttcctca

SEQ ID NO: 8329 - DNA, 15 bp, Homo sapiens
tcaattagcttcctc

SEQ ID NO: 8330 - DNA, 15 bp, Homo sapiens
ttcaattagcttcct

SEQ ID NO: 8331 - DNA, 15 bp, Homo sapiens
tttcaattagcttcc

SEQ ID NO: 8332 - DNA, 15 bp, Homo sapiens
ttttcaattagcttc

SEQ ID NO: 8333 - DNA, 15 bp, Homo sapiens
attttcaattagctt

SEQ ID NO: 8334 - DNA, 15 bp, Homo sapiens
tattttcaattagct

SEQ ID NO: 8335 - DNA, 15 bp, Homo sapiens
ttattttcaattagc

SEQ ID NO: 8336 - DNA, 15 bp, Homo sapiens
tttattttcaattag

SEQ ID NO: 8337 - DNA, 15 bp, Homo sapiens
gtttattttcaatta

SEQ ID NO: 8338 - DNA, 15 bp, Homo sapiens
agtttattttcaatt

SEQ ID NO: 8339 - DNA, 15 bp, Homo sapiens
aagtttattttcaat

SEQ ID NO: 8340 - DNA, 15 bp, Homo sapiens
aaagtttattttcaa

SEQ ID NO: 8341 - DNA, 15 bp, Homo sapiens
aaaagtttattttca

SEQ ID NO: 8342 - DNA, 15 bp, Homo sapiens
taaaagtttattttc

SEQ ID NO: 8343 - DNA, 15 bp, Homo sapiens
ttaaaagtttatttt

SEQ ID NO: 8344 - DNA, 15 bp, Homo sapiens
tttaaaagtttattt

SEQ ID NO: 8345 - DNA, 15 bp, Homo sapiens
ttttaaaagtttatt

SEQ ID NO: 8346 - DNA, 15 bp, Homo sapiens
tttttaaaagtttat

SEQ ID NO: 8347 - DNA, 15 bp, Homo sapiens
ctttttaaaagttta

SEQ ID NO: 8348 - DNA, 15 bp, Homo sapiens
tctttttaaaagttt

SEQ ID NO: 8349 - DNA, 15 bp, Homo sapiens
ttctttttaaaagtt

SEQ ID NO: 8350 - DNA, 15 bp, Homo sapiens
tttctttttaaaagt

SEQ ID NO: 8351 - DNA, 15 bp, Homo sapiens
atttctttttaaaag

SEQ ID NO: 8352 - DNA, 15 bp, Homo sapiens
catttctttttaaaa

SEQ ID NO: 8353 - DNA, 15 bp, Homo sapiens
acatttctttttaaa

SEQ ID NO: 8354 - DNA, 15 bp, Homo sapiens
tacatttctttttaa

SEQ ID NO: 8355 - DNA, 15 bp, Homo sapiens
ctacatttcttttta

SEQ ID NO: 8356 - DNA, 15 bp, Homo sapiens
tctacatttcttttt

SEQ ID NO: 8357 - DNA, 15 bp, Homo sapiens
ttctacatttctttt

SEQ ID NO: 8358 - DNA, 15 bp, Homo sapiens
tttctacatttcttt

SEQ ID NO: 8359 - DNA, 15 bp, Homo sapiens
ctttctacatttctt

SEQ ID NO: 8360 - DNA, 15 bp, Homo sapiens
tctttctacatttct

SEQ ID NO: 8361 - DNA, 15 bp, Homo sapiens
ctctttctacatttc

SEQ ID NO: 8362 - DNA, 15 bp, Homo sapiens
cctctttctacattt

SEQ ID NO: 8363 - DNA, 15 bp, Homo sapiens
tcctctttctacatt

SEQ ID NO: 8364 - DNA, 15 bp, Homo sapiens
ttcctctttctacat

SEQ ID NO: 8365 - DNA, 15 bp, Homo sapiens
tttcctctttctaca

SEQ ID NO: 8366 - DNA, 15 bp, Homo sapiens
atttcctctttctac

SEQ ID NO: 8367 - DNA, 15 bp, Homo sapiens
aatttcctctttcta

SEQ ID NO: 8368 - DNA, 15 bp, Homo sapiens
aaatttcctctttct

SEQ ID NO: 8369 - DNA, 15 bp, Homo sapiens
taaatttcctctttc

SEQ ID NO: 8370 - DNA, 15 bp, Homo sapiens
ttaaatttcctcttt

SEQ ID NO: 8371 - DNA, 15 bp, Homo sapiens
tttaaatttcctctt

SEQ ID NO: 8372 - DNA, 15 bp, Homo sapiens
ttttaaatttcctct

SEQ ID NO: 8373 - DNA, 15 bp, Homo sapiens
tttttaaatttcctc

SEQ ID NO: 8374 - DNA, 15 bp, Homo sapiens
ctttttaaatttcct

SEQ ID NO: 8375 - DNA, 15 bp, Homo sapiens
actttttaaatttcc

SEQ ID NO: 8376 - DNA, 15 bp, Homo sapiens
tactttttaaatttc

SEQ ID NO: 8377 - DNA, 15 bp, Homo sapiens
atactttttaaattt

SEQ ID NO: 8378 - DNA, 15 bp, Homo sapiens
gatactttttaaatt

SEQ ID NO: 8379 - DNA, 15 bp, Homo sapiens
agatactttttaaat

SEQ ID NO: 8380 - DNA, 15 bp, Homo sapiens
aagatactttttaaa

SEQ ID NO: 8381 - DNA, 15 bp, Homo sapiens
taagatactttttaa

SEQ ID NO: 8382 - DNA, 15 bp, Homo sapiens
ataagatacttttta

SEQ ID NO: 8383 - DNA, 15 bp, Homo sapiens
cataagatacttttt

SEQ ID NO: 8384 - DNA, 15 bp, Homo sapiens
tcataagatactttt

SEQ ID NO: 8385 - DNA, 15 bp, Homo sapiens
ttcataagatacttt

SEQ ID NO: 8386 - DNA, 15 bp, Homo sapiens
attcataagatactt

SEQ ID NO: 8387 - DNA, 15 bp, Homo sapiens
cattcataagatact

SEQ ID NO: 8388 - DNA, 15 bp, Homo sapiens
ccattcataagatac

SEQ ID NO: 8389 - DNA, 15 bp, Homo sapiens
cccattcataagata

SEQ ID NO: 8390 - DNA, 15 bp, Homo sapiens
tcccattcataagat

SEQ ID NO: 8391 - DNA, 15 bp, Homo sapiens
ttcccattcataaga

SEQ ID NO: 8392 - DNA, 15 bp, Homo sapiens
tttcccattcataag

SEQ ID NO: 8393 - DNA, 15 bp, Homo sapiens
ctttcccattcataa

SEQ ID NO: 8394 - DNA, 15 bp, Homo sapiens
tctttcccattcata

SEQ ID NO: 8395 - DNA, 15 bp, Homo sapiens
atctttcccattcat

SEQ ID NO: 8396 - DNA, 15 bp, Homo sapiens
catctttcccattca

SEQ ID NO: 8397 - DNA, 15 bp, Homo sapiens
acatctttcccattc

SEQ ID NO: 8398 - DNA, 15 bp, Homo sapiens
tacatctttcccatt

SEQ ID NO: 8399 - DNA, 15 bp, Homo sapiens
ctacatctttcccat

SEQ ID NO: 8400 - DNA, 15 bp, Homo sapiens
gctacatctttccca

SEQ ID NO: 8401 - DNA, 15 bp, Homo sapiens
ggctacatctttccc

SEQ ID NO: 8402 - DNA, 15 bp, Homo sapiens
tggctacatctttcc

SEQ ID NO: 8403 - DNA, 15 bp, Homo sapiens
atggctacatctttc

SEQ ID NO: 8404 - DNA, 15 bp, Homo sapiens
aatggctacatcttt

SEQ ID NO: 8405 - DNA, 15 bp, Homo sapiens
aaatggctacatctt

SEQ ID NO: 8406 - DNA, 15 bp, Homo sapiens
caaatggctacatct

SEQ ID NO: 8407 - DNA, 15 bp, Homo sapiens
tcaaatggctacatc

SEQ ID NO: 8408 - DNA, 15 bp, Homo sapiens
ctcaaatggctacat

SEQ ID NO: 8409 - DNA, 15 bp, Homo sapiens
gctcaaatggctaca

SEQ ID NO: 8410 - DNA, 15 bp, Homo sapiens
agctcaaatggctac

SEQ ID NO: 8411 - DNA, 15 bp, Homo sapiens
aagctcaaatggcta

SEQ ID NO: 8412 - DNA, 15 bp, Homo sapiens
gaagctcaaatggct

SEQ ID NO: 8413 - DNA, 15 bp, Homo sapiens
tgaagctcaaatggc

SEQ ID NO: 8414 - DNA, 15 bp, Homo sapiens
ttgaagctcaaatgg

SEQ ID NO: 8415 - DNA, 15 bp, Homo sapiens
tttgaagctcaaatg

SEQ ID NO: 8416 - DNA, 15 bp, Homo sapiens
ctttgaagctcaaat

SEQ ID NO: 8417 - DNA, 15 bp, Homo sapiens
tctttgaagctcaaa

SEQ ID NO: 8418 - DNA, 15 bp, Homo sapiens
ttctttgaagctcaa

SEQ ID NO: 8419 - DNA, 15 bp, Homo sapiens
gttctttgaagctca

SEQ ID NO: 8420 - DNA, 15 bp, Homo sapiens
agttctttgaagctc

SEQ ID NO: 8421 - DNA, 15 bp, Homo sapiens
aagttctttgaagct

SEQ ID NO: 8422 - DNA, 15 bp, Homo sapiens
aaagttctttgaagc

SEQ ID NO: 8423 - DNA, 15 bp, Homo sapiens
aaaagttctttgaag

SEQ ID NO: 8424 - DNA, 15 bp, Homo sapiens
caaaagttctttgaa

SEQ ID NO: 8425 - DNA, 15 bp, Homo sapiens
tcaaaagttctttga

SEQ ID NO: 8426 - DNA, 15 bp, Homo sapiens
ctcaaaagttctttg

SEQ ID NO: 8427 - DNA, 15 bp, Homo sapiens
cctcaaaagttcttt

SEQ ID NO: 8428 - DNA, 15 bp, Homo sapiens
ccctcaaaagttctt

SEQ ID NO: 8429 - DNA, 15 bp, Homo sapiens
tccctcaaaagttct

SEQ ID NO: 8430 - DNA, 15 bp, Homo sapiens
ttccctcaaaagttc

SEQ ID NO: 8431 - DNA, 15 bp, Homo sapiens
attccctcaaaagtt

SEQ ID NO: 8432 - DNA, 15 bp, Homo sapiens
aattccctcaaaagt

SEQ ID NO: 8433 - DNA, 15 bp, Homo sapiens
gaattccctcaaaag

SEQ ID NO: 8434 - DNA, 15 bp, Homo sapiens
agaattccctcaaaa

SEQ ID NO: 8435 - DNA, 15 bp, Homo sapiens
gagaattccctcaaa

SEQ ID NO: 8436 - DNA, 15 bp, Homo sapiens
tgagaattccctcaa

SEQ ID NO: 8437 - DNA, 15 bp, Homo sapiens
ttgagaattccctca

SEQ ID NO: 8438 - DNA, 15 bp, Homo sapiens
tttgagaattccctc

SEQ ID NO: 8439 - DNA, 15 bp, Homo sapiens
ctttgagaattccct

SEQ ID NO: 8440 - DNA, 15 bp, Homo sapiens
cctttgagaattccc

SEQ ID NO: 8441 - DNA, 15 bp, Homo sapiens
tcctttgagaattcc

SEQ ID NO: 8442 - DNA, 15 bp, Homo sapiens
gtcctttgagaattc

SEQ ID NO: 8443 - DNA, 15 bp, Homo sapiens
tgtcctttgagaatt

SEQ ID NO: 8444 - DNA, 15 bp, Homo sapiens
ctgtcctttgagaat

SEQ ID NO: 8445 - DNA, 15 bp, Homo sapiens
actgtcctttgagaa

SEQ ID NO: 8446 - DNA, 15 bp, Homo sapiens
tactgtcctttgaga

SEQ ID NO: 8447 - DNA, 15 bp, Homo sapiens
gtactgtcctttgag

SEQ ID NO: 8448 - DNA, 15 bp, Homo sapiens
ggtactgtcctttga

SEQ ID NO: 8449 - DNA, 15 bp, Homo sapiens
gggtactgtcctttg

SEQ ID NO: 8450 - DNA, 15 bp, Homo sapiens
cgggtactgtccttt

SEQ ID NO: 8451 - DNA, 15 bp, Homo sapiens
acgggtactgtcctt

SEQ ID NO: 8452 - DNA, 15 bp, Homo sapiens
gacgggtactgtcct

SEQ ID NO: 8453 - DNA, 15 bp, Homo sapiens
agacgggtactgtcc

SEQ ID NO: 8454 - DNA, 15 bp, Homo sapiens
aagacgggtactgtc

SEQ ID NO: 8455 - DNA, 15 bp, Homo sapiens
aaagacgggtactgt

SEQ ID NO: 8456 - DNA, 15 bp, Homo sapiens
taaagacgggtactg

SEQ ID NO: 8457 - DNA, 15 bp, Homo sapiens
ctaaagacgggtact

SEQ ID NO: 8458 - DNA, 15 bp, Homo sapiens
actaaagacgggtac

SEQ ID NO: 8459 - DNA, 15 bp, Homo sapiens
tactaaagacgggta

SEQ ID NO: 8460 - DNA, 15 bp, Homo sapiens
ctactaaagacgggt

SEQ ID NO: 8461 - DNA, 15 bp, Homo sapiens
tctactaaagacggg

SEQ ID NO: 8462 - DNA, 15 bp, Homo sapiens
atctactaaagacgg

SEQ ID NO: 8463 - DNA, 15 bp, Homo sapiens
tatctactaaagacg

SEQ ID NO: 8464 - DNA, 15 bp, Homo sapiens
ttatctactaaagac

SEQ ID NO: 8465 - DNA, 15 bp, Homo sapiens
tttatctactaaaga

SEQ ID NO: 8466 - DNA, 15 bp, Homo sapiens
atttatctactaaag

SEQ ID NO: 8467 - DNA, 15 bp, Homo sapiens
catttatctactaaa

SEQ ID NO: 8468 - DNA, 15 bp, Homo sapiens
gcatttatctactaa

SEQ ID NO: 8469 - DNA, 15 bp, Homo sapiens
agcatttatctacta

SEQ ID NO: 8470 - DNA, 15 bp, Homo sapiens
aagcatttatctact

SEQ ID NO: 8471 - DNA, 15 bp, Homo sapiens
caagcatttatctac

SEQ ID NO: 8472 - DNA, 15 bp, Homo sapiens
tcaagcatttatcta

SEQ ID NO: 8473 - DNA, 15 bp, Homo sapiens
atcaagcatttatct

SEQ ID NO: 8474 - DNA, 15 bp, Homo sapiens
tatcaagcatttatc

SEQ ID NO: 8475 - DNA, 15 bp, Homo sapiens
atatcaagcatttat

SEQ ID NO: 8476 - DNA, 15 bp, Homo sapiens
gatatcaagcattta

SEQ ID NO: 8477 - DNA, 15 bp, Homo sapiens
agatatcaagcattt

SEQ ID NO: 8478 - DNA, 15 bp, Homo sapiens
tagatatcaagcatt

SEQ ID NO: 8479 - DNA, 15 bp, Homo sapiens
atagatatcaagcat

SEQ ID NO: 8480 - DNA, 15 bp, Homo sapiens
aatagatatcaagca

SEQ ID NO: 8481 - DNA, 15 bp, Homo sapiens
aaatagatatcaagc

SEQ ID NO: 8482 - DNA, 15 bp, Homo sapiens
aaaatagatatcaag

SEQ ID NO: 8483 - DNA, 15 bp, Homo sapiens
aaaaatagatatcaa

SEQ ID NO: 8484 - DNA, 15 bp, Homo sapiens
gaaaaatagatatca

SEQ ID NO: 8485 - DNA, 15 bp, Homo sapiens
agaaaaatagatatc

SEQ ID NO: 8486 - DNA, 15 bp, Homo sapiens
aagaaaaatagatat

SEQ ID NO: 8487 - DNA, 15 bp, Homo sapiens
gaagaaaaatagata

SEQ ID NO: 8488 - DNA, 15 bp, Homo sapiens
agaagaaaaatagat

SEQ ID NO: 8489 - DNA, 15 bp, Homo sapiens
aagaagaaaaataga

SEQ ID NO: 8490 - DNA, 15 bp, Homo sapiens
aaagaagaaaaatag

SEQ ID NO: 8491 - DNA, 15 bp, Homo sapiens
aaaagaagaaaaata

SEQ ID NO: 8492 - DNA, 15 bp, Homo sapiens
taaaagaagaaaaat

SEQ ID NO: 8493 - DNA, 15 bp, Homo sapiens
gtaaaagaagaaaaa

SEQ ID NO: 8494 - DNA, 15 bp, Homo sapiens
agtaaaagaagaaaa

SEQ ID NO: 8495 - DNA, 15 bp, Homo sapiens
aagtaaaagaagaaa

SEQ ID NO: 8496 - DNA, 15 bp, Homo sapiens
aaagtaaaagaagaa

SEQ ID NO: 8497 - DNA, 15 bp, Homo sapiens
aaaagtaaaagaaga

SEQ ID NO: 8498 - DNA, 15 bp, Homo sapiens
aaaaagtaaaagaag

SEQ ID NO: 8499 - DNA, 15 bp, Homo sapiens
taaaaagtaaaagaa

SEQ ID NO: 8500 - DNA, 15 bp, Homo sapiens
ttaaaaagtaaaaga

SEQ ID NO: 8501 - DNA, 15 bp, Homo sapiens
tttaaaaagtaaaag

SEQ ID NO: 8502 - DNA, 15 bp, Homo sapiens
ctttaaaaagtaaaa

SEQ ID NO: 8503 - DNA, 15 bp, Homo sapiens
tctttaaaaagtaaa

SEQ ID NO: 8504 - DNA, 15 bp, Homo sapiens
ttctttaaaaagtaa

SEQ ID NO: 8505 - DNA, 15 bp, Homo sapiens
attctttaaaaagta

SEQ ID NO: 8506 - DNA, 15 bp, Homo sapiens
aattctttaaaaagt

SEQ ID NO: 8507 - DNA, 15 bp, Homo sapiens
taattctttaaaaag

SEQ ID NO: 8508 - DNA, 15 bp, Homo sapiens
gtaattctttaaaaa

SEQ ID NO: 8509 - DNA, 15 bp, Homo sapiens
agtaattctttaaaa

SEQ ID NO: 8510 - DNA, 15 bp, Homo sapiens
tagtaattctttaaa

SEQ ID NO: 8511 - DNA, 15 bp, Homo sapiens
ttagtaattctttaa

SEQ ID NO: 8512 - DNA, 15 bp, Homo sapiens
tttagtaattcttta

SEQ ID NO: 8513 - DNA, 15 bp, Homo sapiens
ttttagtaattcttt

SEQ ID NO: 8514 - DNA, 15 bp, Homo sapiens
attttagtaattctt

SEQ ID NO: 8515 - DNA, 15 bp, Homo sapiens
tattttagtaattct

SEQ ID NO: 8516 - DNA, 15 bp, Homo sapiens
ttattttagtaattc

SEQ ID NO: 8517 - DNA, 15 bp, Homo sapiens
attattttagtaatt

SEQ ID NO: 8518 - DNA, 15 bp, Homo sapiens
tattattttagtaat

SEQ ID NO: 8519 - DNA, 15 bp, Homo sapiens
gtattattttagtaa

SEQ ID NO: 8520 - DNA, 15 bp, Homo sapiens
tgtattattttagta

SEQ ID NO: 8521 - DNA, 15 bp, Homo sapiens
atgtattattttagt

SEQ ID NO: 8522 - DNA, 15 bp, Homo sapiens
catgtattattttag

SEQ ID NO: 8523 - DNA, 15 bp, Homo sapiens
ccatgtattatttta

SEQ ID NO: 8524 - DNA, 15 bp, Homo sapiens
tccatgtattatttt

SEQ ID NO: 8525 - DNA, 15 bp, Homo sapiens
atccatgtattattt

SEQ ID NO: 8526 - DNA, 15 bp, Homo sapiens
aatccatgtattatt

SEQ ID NO: 8527 - DNA, 15 bp, Homo sapiens
aaatccatgtattat

SEQ ID NO: 8528 - DNA, 15 bp, Homo sapiens
taaatccatgtatta

SEQ ID NO: 8529 - DNA, 15 bp, Homo sapiens
ataaatccatgtatt

SEQ ID NO: 8530 - DNA, 15 bp, Homo sapiens
tataaatccatgtat

SEQ ID NO: 8531 - DNA, 15 bp, Homo sapiens
ctataaatccatgta

SEQ ID NO: 8532 - DNA, 15 bp, Homo sapiens
tctataaatccatgt

SEQ ID NO: 8533 - DNA, 15 bp, Homo sapiens
ttctataaatccatg

SEQ ID NO: 8534 - DNA, 15 bp, Homo sapiens
tttctataaatccat

SEQ ID NO: 8535 - DNA, 15 bp, Homo sapiens
ttttctataaatcca

SEQ ID NO: 8536 - DNA, 15 bp, Homo sapiens
tttttctataaatcc

SEQ ID NO: 8537 - DNA, 15 bp, Homo sapiens
atttttctataaatc

SEQ ID NO: 8538 - DNA, 15 bp, Homo sapiens
gatttttctataaat

SEQ ID NO: 8539 - DNA, 15 bp, Homo sapiens
tgatttttctataaa

SEQ ID NO: 8540 - DNA, 15 bp, Homo sapiens
ttgatttttctataa

SEQ ID NO: 8541 - DNA, 15 bp, Homo sapiens
tttgatttttctata

SEQ ID NO: 8542 - DNA, 15 bp, Homo sapiens
gtttgatttttctat

SEQ ID NO: 8543 - DNA, 15 bp, Homo sapiens
ggtttgatttttcta

SEQ ID NO: 8544 - DNA, 15 bp, Homo sapiens
tggtttgatttttct

SEQ ID NO: 8545 - DNA, 15 bp, Homo sapiens
gtggtttgatttttc

SEQ ID NO: 8546 - DNA, 15 bp, Homo sapiens
agtggtttgattttt

SEQ ID NO: 8547 - DNA, 15 bp, Homo sapiens
aagtggtttgatttt

SEQ ID NO: 8548 - DNA, 15 bp, Homo sapiens
taagtggtttgattt

SEQ ID NO: 8549 - DNA, 15 bp, Homo sapiens
ttaagtggtttgatt

SEQ ID NO: 8550 - DNA, 15 bp, Homo sapiens
tttaagtggtttgat

SEQ ID NO: 8551 - DNA, 15 bp, Homo sapiens
ttttaagtggtttga

SEQ ID NO: 8552 - DNA, 15 bp, Homo sapiens
tttttaagtggtttg

SEQ ID NO: 8553 - DNA, 15 bp, Homo sapiens
atttttaagtggttt

SEQ ID NO: 8554 - DNA, 15 bp, Homo sapiens
aatttttaagtggtt

SEQ ID NO: 8555 - DNA, 15 bp, Homo sapiens
caatttttaagtggt

SEQ ID NO: 8556 - DNA, 15 bp, Homo sapiens
tcaatttttaagtgg

SEQ ID NO: 8557 - DNA, 15 bp, Homo sapiens
atcaatttttaagtg

SEQ ID NO: 8558 - DNA, 15 bp, Homo sapiens
gatcaatttttaagt

SEQ ID NO: 8559 - DNA, 15 bp, Homo sapiens
tgatcaatttttaag

SEQ ID NO: 8560 - DNA, 15 bp, Homo sapiens
ctgatcaatttttaa

SEQ ID NO: 8561 - DNA, 15 bp, Homo sapiens
cctgatcaattttta

SEQ ID NO: 8562 - DNA, 15 bp, Homo sapiens
acctgatcaattttt

SEQ ID NO: 8563 - DNA, 15 bp, Homo sapiens
cacctgatcaatttt

SEQ ID NO: 8564 - DNA, 15 bp, Homo sapiens
ccacctgatcaattt

SEQ ID NO: 8565 - DNA, 15 bp, Homo sapiens
gccacctgatcaatt

SEQ ID NO: 8566 - DNA, 15 bp, Homo sapiens
agccacctgatcaat

SEQ ID NO: 8567 - DNA, 15 bp, Homo sapiens
cagccacctgatcaa

SEQ ID NO: 8568 - DNA, 15 bp, Homo sapiens
ccagccacctgatca

SEQ ID NO: 8569 - DNA, 15 bp, Homo sapiens
cccagccacctgatc

SEQ ID NO: 8570 - DNA, 15 bp, Homo sapiens
gcccagccacctgat

SEQ ID NO: 8571 - DNA, 15 bp, Homo sapiens
tgcccagccacctga

SEQ ID NO: 8572 - DNA, 15 bp, Homo sapiens
ttgcccagccacctg

SEQ ID NO: 8573 - DNA, 15 bp, Homo sapiens
cttgcccagccacct

SEQ ID NO: 8574 - DNA, 15 bp, Homo sapiens
ccttgcccagccacc

SEQ ID NO: 8575 - DNA, 15 bp, Homo sapiens
accttgcccagccac

SEQ ID NO: 8576 - DNA, 15 bp, Homo sapiens
caccttgcccagcca

SEQ ID NO: 8577 - DNA, 15 bp, Homo sapiens
ccaccttgcccagcc

SEQ ID NO: 8578 - DNA, 15 bp, Homo sapiens
gccaccttgcccagc

SEQ ID NO: 8579 - DNA, 15 bp, Homo sapiens
agccaccttgcccag

SEQ ID NO: 8580 - DNA, 15 bp, Homo sapiens
gagccaccttgccca

SEQ ID NO: 8581 - DNA, 15 bp, Homo sapiens
tgagccaccttgccc

SEQ ID NO: 8582 - DNA, 15 bp, Homo sapiens
atgagccaccttgcc

SEQ ID NO: 8583 - DNA, 15 bp, Homo sapiens
catgagccaccttgc

SEQ ID NO: 8584 - DNA, 15 bp, Homo sapiens
gcatgagccaccttg

SEQ ID NO: 8585 - DNA, 15 bp, Homo sapiens
ggcatgagccacctt

SEQ ID NO: 8586 - DNA, 15 bp, Homo sapiens
aggcatgagccacct

SEQ ID NO: 8587 - DNA, 15 bp, Homo sapiens
caggcatgagccacc

SEQ ID NO: 8588 - DNA, 15 bp, Homo sapiens
acaggcatgagccac

SEQ ID NO: 8589 - DNA, 15 bp, Homo sapiens
tacaggcatgagcca

SEQ ID NO: 8590 - DNA, 15 bp, Homo sapiens
ttacaggcatgagcc

SEQ ID NO: 8591 - DNA, 15 bp, Homo sapiens
attacaggcatgagc

SEQ ID NO: 8592 - DNA, 15 bp, Homo sapiens
gattacaggcatgag

SEQ ID NO: 8593 - DNA, 15 bp, Homo sapiens
tgattacaggcatga

SEQ ID NO: 8594 - DNA, 15 bp, Homo sapiens
gtgattacaggcatg

SEQ ID NO: 8595 - DNA, 15 bp, Homo sapiens
tgtgattacaggcat

SEQ ID NO: 8596 - DNA, 15 bp, Homo sapiens
ctgtgattacaggca

SEQ ID NO: 8597 - DNA, 15 bp, Homo sapiens
gctgtgattacaggc

SEQ ID NO: 8598 - DNA, 15 bp, Homo sapiens
cgctgtgattacagg

SEQ ID NO: 8599 - DNA, 15 bp, Homo sapiens
gcgctgtgattacag

SEQ ID NO: 8600 - DNA, 15 bp, Homo sapiens
agcgctgtgattaca

SEQ ID NO: 8601 - DNA, 15 bp, Homo sapiens
aagcgctgtgattac

SEQ ID NO: 8602 - DNA, 15 bp, Homo sapiens
aaagcgctgtgatta

SEQ ID NO: 8603 - DNA, 15 bp, Homo sapiens
caaagcgctgtgatt

SEQ ID NO: 8604 - DNA, 15 bp, Homo sapiens
ccaaagcgctgtgat

SEQ ID NO: 8605 - DNA, 15 bp, Homo sapiens
cccaaagcgctgtga

SEQ ID NO: 8606 - DNA, 15 bp, Homo sapiens
tcccaaagcgctgtg

SEQ ID NO: 8607 - DNA, 15 bp, Homo sapiens
ctcccaaagcgctgt

SEQ ID NO: 8608 - DNA, 15 bp, Homo sapiens
cctcccaaagcgctg

SEQ ID NO: 8609 - DNA, 15 bp, Homo sapiens
gcctcccaaagcgct

SEQ ID NO: 8610 - DNA, 15 bp, Homo sapiens
ggcctcccaaagcgc

SEQ ID NO: 8611 - DNA, 15 bp, Homo sapiens
aggcctcccaaagcg

SEQ ID NO: 8612 - DNA, 15 bp, Homo sapiens
taggcctcccaaagc

SEQ ID NO: 8613 - DNA, 15 bp, Homo sapiens
ctaggcctcccaaag

SEQ ID NO: 8614 - DNA, 15 bp, Homo sapiens
cctaggcctcccaaa

SEQ ID NO: 8615 - DNA, 15 bp, Homo sapiens
gcctaggcctcccaa

SEQ ID NO: 8616 - DNA, 15 bp, Homo sapiens
cgcctaggcctccca

SEQ ID NO: 8617 - DNA, 15 bp, Homo sapiens
ccgcctaggcctccc

SEQ ID NO: 8618 - DNA, 15 bp, Homo sapiens
cccgcctaggcctcc

SEQ ID NO: 8619 - DNA, 15 bp, Homo sapiens
acccgcctaggcctc

SEQ ID NO: 8620 - DNA, 15 bp, Homo sapiens
cacccgcctaggcct

SEQ ID NO: 8621 - DNA, 15 bp, Homo sapiens
ccacccgcctaggcc

SEQ ID NO: 8622 - DNA, 15 bp, Homo sapiens
tccacccgcctaggc

SEQ ID NO: 8623 - DNA, 15 bp, Homo sapiens
atccacccgcctagg

SEQ ID NO: 8624 - DNA, 15 bp, Homo sapiens
gatccacccgcctag

SEQ ID NO: 8625 - DNA, 15 bp, Homo sapiens
tgatccacccgccta

SEQ ID NO: 8626 - DNA, 15 bp, Homo sapiens
gtgatccacccgcct

SEQ ID NO: 8627 - DNA, 15 bp, Homo sapiens
ggtgatccacccgcc

SEQ ID NO: 8628 - DNA, 15 bp, Homo sapiens
aggtgatccacccgc

SEQ ID NO: 8629 - DNA, 15 bp, Homo sapiens
caggtgatccacccg

SEQ ID NO: 8630 - DNA, 15 bp, Homo sapiens
tcaggtgatccaccc

SEQ ID NO: 8631 - DNA, 15 bp, Homo sapiens
ttcaggtgatccacc

SEQ ID NO: 8632 - DNA, 15 bp, Homo sapiens
cttcaggtgatccac

SEQ ID NO: 8633 - DNA, 15 bp, Homo sapiens
acttcaggtgatcca

SEQ ID NO: 8634 - DNA, 15 bp, Homo sapiens
gacttcaggtgatcc

SEQ ID NO: 8635 - DNA, 15 bp, Homo sapiens
tgacttcaggtgatc

SEQ ID NO: 8636 - DNA, 15 bp, Homo sapiens
ctgacttcaggtgat

SEQ ID NO: 8637 - DNA, 15 bp, Homo sapiens
cctgacttcaggtga

SEQ ID NO: 8638 - DNA, 15 bp, Homo sapiens
tcctgacttcaggtg

SEQ ID NO: 8639 - DNA, 15 bp, Homo sapiens
ctcctgacttcaggt

SEQ ID NO: 8640 - DNA, 15 bp, Homo sapiens
actcctgacttcagg

SEQ ID NO: 8641 - DNA, 15 bp, Homo sapiens
aactcctgacttcag

SEQ ID NO: 8642 - DNA, 15 bp, Homo sapiens
gaactcctgacttca

SEQ ID NO: 8643 - DNA, 15 bp, Homo sapiens
cgaactcctgacttc

SEQ ID NO: 8644 - DNA, 15 bp, Homo sapiens
tcgaactcctgactt

SEQ ID NO: 8645 - DNA, 15 bp, Homo sapiens
ctcgaactcctgact

SEQ ID NO: 8646 - DNA, 15 bp, Homo sapiens
tctcgaactcctgac

SEQ ID NO: 8647 - DNA, 15 bp, Homo sapiens
gtctcgaactcctga

SEQ ID NO: 8648 - DNA, 15 bp, Homo sapiens
ggtctcgaactcctg

SEQ ID NO: 8649 - DNA, 15 bp, Homo sapiens
tggtctcgaactcct

SEQ ID NO: 8650 - DNA, 15 bp, Homo sapiens
ctggtctcgaactcc

SEQ ID NO: 8651 - DNA, 15 bp, Homo sapiens
gctggtctcgaactc

SEQ ID NO: 8652 - DNA, 15 bp, Homo sapiens
ggctggtctcgaact

SEQ ID NO: 8653 - DNA, 15 bp, Homo sapiens
aggctggtctcgaac

SEQ ID NO: 8654 - DNA, 15 bp, Homo sapiens
caggctggtctcgaa

SEQ ID NO: 8655 - DNA, 15 bp, Homo sapiens
ccaggctggtctcga

SEQ ID NO: 8656 - DNA, 15 bp, Homo sapiens
gccaggctggtctcg

SEQ ID NO: 8657 - DNA, 15 bp, Homo sapiens
agccaggctggtctc

SEQ ID NO: 8658 - DNA, 15 bp, Homo sapiens
tagccaggctggtct

SEQ ID NO: 8659 - DNA, 15 bp, Homo sapiens
ttagccaggctggtc

SEQ ID NO: 8660 - DNA, 15 bp, Homo sapiens
gttagccaggctggt

SEQ ID NO: 8661 - DNA, 15 bp, Homo sapiens
tgttagccaggctgg

SEQ ID NO: 8662 - DNA, 15 bp, Homo sapiens
gtgttagccaggctg

SEQ ID NO: 8663 - DNA, 15 bp, Homo sapiens
cgtgttagccaggct

SEQ ID NO: 8664 - DNA, 15 bp, Homo sapiens
ccgtgttagccaggc

SEQ ID NO: 8665 - DNA, 15 bp, Homo sapiens
gccgtgttagccagg

SEQ ID NO: 8666 - DNA, 15 bp, Homo sapiens
cgccgtgttagccag

SEQ ID NO: 8667 - DNA, 15 bp, Homo sapiens
tcgccgtgttagcca

SEQ ID NO: 8668 - DNA, 15 bp, Homo sapiens
ttcgccgtgttagcc

SEQ ID NO: 8669 - DNA, 15 bp, Homo sapiens
tttcgccgtgttagc

SEQ ID NO: 8670 - DNA, 15 bp, Homo sapiens
gtttcgccgtgttag

SEQ ID NO: 8671 - DNA, 15 bp, Homo sapiens
ggtttcgccgtgtta

SEQ ID NO: 8672 - DNA, 15 bp, Homo sapiens
gggtttcgccgtgtt

SEQ ID NO: 8673 - DNA, 15 bp, Homo sapiens
ggggtttcgccgtgt

SEQ ID NO: 8674 - DNA, 15 bp, Homo sapiens
tggggtttcgccgtg

SEQ ID NO: 8675 - DNA, 15 bp, Homo sapiens
atggggtttcgccgt

SEQ ID NO: 8676 - DNA, 15 bp, Homo sapiens
gatggggtttcgccg

SEQ ID NO: 8677 - DNA, 15 bp, Homo sapiens
agatggggtttcgcc

SEQ ID NO: 8678 - DNA, 15 bp, Homo sapiens
gagatggggtttcgc

SEQ ID NO: 8679 - DNA, 15 bp, Homo sapiens
agagatggggtttcg

SEQ ID NO: 8680 - DNA, 15 bp, Homo sapiens
tagagatggggtttc

SEQ ID NO: 8681 - DNA, 15 bp, Homo sapiens
atagagatggggttt

SEQ ID NO: 8682 - DNA, 15 bp, Homo sapiens
aatagagatggggtt

SEQ ID NO: 8683 - DNA, 15 bp, Homo sapiens
taatagagatggggt

SEQ ID NO: 8684 - DNA, 15 bp, Homo sapiens
ttaatagagatgggg

SEQ ID NO: 8685 - DNA, 15 bp, Homo sapiens
tttaatagagatggg

SEQ ID NO: 8686 - DNA, 15 bp, Homo sapiens
ttttaatagagatgg

SEQ ID NO: 8687 - DNA, 15 bp, Homo sapiens
tttttaatagagatg

SEQ ID NO: 8688 - DNA, 15 bp, Homo sapiens
atttttaatagagat

SEQ ID NO: 8689 - DNA, 15 bp, Homo sapiens
tatttttaatagaga

SEQ ID NO: 8690 - DNA, 15 bp, Homo sapiens
gtatttttaatagag

SEQ ID NO: 8691 - DNA, 15 bp, Homo sapiens
tgtatttttaataga

SEQ ID NO: 8692 - DNA, 15 bp, Homo sapiens
ttgtatttttaatag

SEQ ID NO: 8693 - DNA, 15 bp, Homo sapiens
tttgtatttttaata

SEQ ID NO: 8694 - DNA, 15 bp, Homo sapiens
ttttgtatttttaat

SEQ ID NO: 8695 - DNA, 15 bp, Homo sapiens
tttttgtatttttaa

SEQ ID NO: 8696 - DNA, 15 bp, Homo sapiens
atttttgtattttta

SEQ ID NO: 8697 - DNA, 15 bp, Homo sapiens
aatttttgtattttt

SEQ ID NO: 8698 - DNA, 15 bp, Homo sapiens
taatttttgtatttt

SEQ ID NO: 8699 - DNA, 15 bp, Homo sapiens
ctaatttttgtattt

SEQ ID NO: 8700 - DNA, 15 bp, Homo sapiens
gctaatttttgtatt

SEQ ID NO: 8701 - DNA, 15 bp, Homo sapiens
agctaatttttgtat

SEQ ID NO: 8702 - DNA, 15 bp, Homo sapiens
cagctaatttttgta

SEQ ID NO: 8703 - DNA, 15 bp, Homo sapiens
ccagctaatttttgt

SEQ ID NO: 8704 - DNA, 15 bp, Homo sapiens
gccagctaatttttg

SEQ ID NO: 8705 - DNA, 15 bp, Homo sapiens
ggccagctaattttt

SEQ ID NO: 8706 - DNA, 15 bp, Homo sapiens
tggccagctaatttt

SEQ ID NO: 8707 - DNA, 15 bp, Homo sapiens
atggccagctaattt

SEQ ID NO: 8708 - DNA, 15 bp, Homo sapiens
catggccagctaatt

SEQ ID NO: 8709 - DNA, 15 bp, Homo sapiens
ccatggccagctaat

SEQ ID NO: 8710 - DNA, 15 bp, Homo sapiens
accatggccagctaa

SEQ ID NO: 8711 - DNA, 15 bp, Homo sapiens
caccatggccagcta

SEQ ID NO: 8712 - DNA, 15 bp, Homo sapiens
ccaccatggccagct

SEQ ID NO: 8713 - DNA, 15 bp, Homo sapiens
gccaccatggccagc

SEQ ID NO: 8714 - DNA, 15 bp, Homo sapiens
agccaccatggccag

SEQ ID NO: 8715 - DNA, 15 bp, Homo sapiens
aagccaccatggcca

SEQ ID NO: 8716 - DNA, 15 bp, Homo sapiens
caagccaccatggcc

SEQ ID NO: 8717 - DNA, 15 bp, Homo sapiens
tcaagccaccatggc

SEQ ID NO: 8718 - DNA, 15 bp, Homo sapiens
ctcaagccaccatgg

SEQ ID NO: 8719 - DNA, 15 bp, Homo sapiens
gctcaagccaccatg

SEQ ID NO: 8720 - DNA, 15 bp, Homo sapiens
cgctcaagccaccat

SEQ ID NO: 8721 - DNA, 15 bp, Homo sapiens
acgctcaagccacca

SEQ ID NO: 8722 - DNA, 15 bp, Homo sapiens
cacgctcaagccacc

SEQ ID NO: 8723 - DNA, 15 bp, Homo sapiens
acacgctcaagccac

SEQ ID NO: 8724 - DNA, 15 bp, Homo sapiens
tacacgctcaagcca

SEQ ID NO: 8725 - DNA, 15 bp, Homo sapiens
ctacacgctcaagcc

SEQ ID NO: 8726 - DNA, 15 bp, Homo sapiens
actacacgctcaagc

SEQ ID NO: 8727 - DNA, 15 bp, Homo sapiens
gactacacgctcaag

SEQ ID NO: 8728 - DNA, 15 bp, Homo sapiens
ggactacacgctcaa

SEQ ID NO: 8729 - DNA, 15 bp, Homo sapiens
gggactacacgctca

SEQ ID NO: 8730 - DNA, 15 bp, Homo sapiens
tgggactacacgctc

SEQ ID NO: 8731 - DNA, 15 bp, Homo sapiens
ctgggactacacgct

SEQ ID NO: 8732 - DNA, 15 bp, Homo sapiens
gctgggactacacgc

SEQ ID NO: 8733 - DNA, 15 bp, Homo sapiens
agctgggactacacg

SEQ ID NO: 8734 - DNA, 15 bp, Homo sapiens
tagctgggactacac

SEQ ID NO: 8735 - DNA, 15 bp, Homo sapiens
gtagctgggactaca

SEQ ID NO: 8736 - DNA, 15 bp, Homo sapiens
agtagctgggactac

SEQ ID NO: 8737 - DNA, 15 bp, Homo sapiens
gagtagctgggacta

SEQ ID NO: 8738 - DNA, 15 bp, Homo sapiens
cgagtagctgggact

SEQ ID NO: 8739 - DNA, 15 bp, Homo sapiens
ccgagtagctgggac

SEQ ID NO: 8740 - DNA, 15 bp, Homo sapiens
tccgagtagctggga

SEQ ID NO: 8741 - DNA, 15 bp, Homo sapiens
ttccgagtagctggg

SEQ ID NO: 8742 - DNA, 15 bp, Homo sapiens
cttccgagtagctgg

SEQ ID NO: 8743 - DNA, 15 bp, Homo sapiens
ccttccgagtagctg

SEQ ID NO: 8744 - DNA, 15 bp, Homo sapiens
gccttccgagtagct

SEQ ID NO: 8745 - DNA, 15 bp, Homo sapiens
agccttccgagtagc

SEQ ID NO: 8746 - DNA, 15 bp, Homo sapiens
cagccttccgagtag

SEQ ID NO: 8747 - DNA, 15 bp, Homo sapiens
tcagccttccgagta

SEQ ID NO: 8748 - DNA, 15 bp, Homo sapiens
ctcagccttccgagt

SEQ ID NO: 8749 - DNA, 15 bp, Homo sapiens
cctcagccttccgag

SEQ ID NO: 8750 - DNA, 15 bp, Homo sapiens
gcctcagccttccga

SEQ ID NO: 8751 - DNA, 15 bp, Homo sapiens
tgcctcagccttccg

SEQ ID NO: 8752 - DNA, 15 bp, Homo sapiens
ctgcctcagccttcc

SEQ ID NO: 8753 - DNA, 15 bp, Homo sapiens
cctgcctcagccttc

SEQ ID NO: 8754 - DNA, 15 bp, Homo sapiens
tcctgcctcagcctt

SEQ ID NO: 8755 - DNA, 15 bp, Homo sapiens
aggttcaagtgattc

SEQ ID NO: 8756 - DNA, 15 bp, Homo sapiens
caggttcaagtgatt

SEQ ID NO: 8757 - DNA, 15 bp, Homo sapiens
ccaggttcaagtgat

SEQ ID NO: 8758 - DNA, 15 bp, Homo sapiens
cccaggttcaagtga

SEQ ID NO: 8759 - DNA, 15 bp, Homo sapiens
tcccaggttcaagtg

SEQ ID NO: 8760 - DNA, 15 bp, Homo sapiens
ctcccaggttcaagt

SEQ ID NO: 8761 - DNA, 15 bp, Homo sapiens
cctcccaggttcaag

SEQ ID NO: 8762 - DNA, 15 bp, Homo sapiens
gcctcccaggttcaa

SEQ ID NO: 8763 - DNA, 15 bp, Homo sapiens
cgcctcccaggttca

SEQ ID NO: 8764 - DNA, 15 bp, Homo sapiens
ccgcctcccaggttc

SEQ ID NO: 8765 - DNA, 15 bp, Homo sapiens
tccgcctcccaggtt

SEQ ID NO: 8766 - DNA, 15 bp, Homo sapiens
ctccgcctcccaggt

SEQ ID NO: 8767 - DNA, 15 bp, Homo sapiens
cctccgcctcccagg

SEQ ID NO: 8768 - DNA, 15 bp, Homo sapiens
acctccgcctcccag

SEQ ID NO: 8769 - DNA, 15 bp, Homo sapiens
aacctccgcctccca

SEQ ID NO: 8770 - DNA, 15 bp, Homo sapiens
caacctccgcctccc

SEQ ID NO: 8771 - DNA, 15 bp, Homo sapiens
gcaacctccgcctcc

SEQ ID NO: 8772 - DNA, 15 bp, Homo sapiens
tgcaacctccgcctc

SEQ ID NO: 8773 - DNA, 15 bp, Homo sapiens
ctgcaacctccgcct

SEQ ID NO: 8774 - DNA, 15 bp, Homo sapiens
actgcaacctccgcc

SEQ ID NO: 8775 - DNA, 15 bp, Homo sapiens
cactgcaacctccgc

SEQ ID NO: 8776 - DNA, 15 bp, Homo sapiens
tcactgcaacctccg

SEQ ID NO: 8777 - DNA, 15 bp, Homo sapiens
ctcactgcaacctcc

SEQ ID NO: 8778 - DNA, 15 bp, Homo sapiens
gctcactgcaacctc

SEQ ID NO: 8779 - DNA, 15 bp, Homo sapiens
tggctcactgcaacc

SEQ ID NO: 8780 - DNA, 15 bp, Homo sapiens
gatcttggctcactg

SEQ ID NO: 8781 - DNA, 15 bp, Homo sapiens
tgatcttggctcact

SEQ ID NO: 8782 - DNA, 15 bp, Homo sapiens
gtgatcttggctcac

SEQ ID NO: 8783 - DNA, 15 bp, Homo sapiens
tgtgatcttggctca

SEQ ID NO: 8784 - DNA, 15 bp, Homo sapiens
gtgtgatcttggctc

SEQ ID NO: 8785 - DNA, 15 bp, Homo sapiens
ggtgtgatcttggct

SEQ ID NO: 8786 - DNA, 15 bp, Homo sapiens
tggtgtgatcttggc

SEQ ID NO: 8787 - DNA, 15 bp, Homo sapiens
gtggtgtgatcttgg

SEQ ID NO: 8788 - DNA, 15 bp, Homo sapiens
agtggtgtgatcttg

SEQ ID NO: 8789 - DNA, 15 bp, Homo sapiens
cagtggtgtgatctt

SEQ ID NO: 8790 - DNA, 15 bp, Homo sapiens
gcagtggtgtgatct

SEQ ID NO: 8791 - DNA, 15 bp, Homo sapiens
tgcagtggtgtgatc

SEQ ID NO: 8792 - DNA, 15 bp, Homo sapiens
gtgcagtggtgtgat

SEQ ID NO: 8793 - DNA, 15 bp, Homo sapiens
agtgcagtggtgtga

SEQ ID NO: 8794 - DNA, 15 bp, Homo sapiens
gagtgcagtggtgtg

SEQ ID NO: 8795 - DNA, 15 bp, Homo sapiens
ggagtgcagtggtgt

SEQ ID NO: 8796 - DNA, 15 bp, Homo sapiens
aggagtgcagtggtg

SEQ ID NO: 8797 - DNA, 15 bp, Homo sapiens
caggagtgcagtggt

SEQ ID NO: 8798 - DNA, 15 bp, Homo sapiens
acccaggcaggagtg

SEQ ID NO: 8799 - DNA, 15 bp, Homo sapiens
cacccaggcaggagt

SEQ ID NO: 8800 - DNA, 15 bp, Homo sapiens
tcacccaggcaggag

SEQ ID NO: 8801 - DNA, 15 bp, Homo sapiens
gtcacccaggcagga

SEQ ID NO: 8802 - DNA, 15 bp, Homo sapiens
tgtcacccaggcagg

SEQ ID NO: 8803 - DNA, 15 bp, Homo sapiens
ctgtcacccaggcag

SEQ ID NO: 8804 - DNA, 15 bp, Homo sapiens
tctgtcacccaggca

SEQ ID NO: 8805 - DNA, 15 bp, Homo sapiens
ctctgtcacccaggc

SEQ ID NO: 8806 - DNA, 15 bp, Homo sapiens
actctgtcacccagg

SEQ ID NO: 8807 - DNA, 15 bp, Homo sapiens
cactctgtcacccag

SEQ ID NO: 8808 - DNA, 15 bp, Homo sapiens
tcactctgtcaccca

SEQ ID NO: 8809 - DNA, 15 bp, Homo sapiens
ctcactctgtcaccc

SEQ ID NO: 8810 - DNA, 15 bp, Homo sapiens
tctcactctgtcacc

SEQ ID NO: 8811 - DNA, 15 bp, Homo sapiens
gtctcactctgtcac

SEQ ID NO: 8812 - DNA, 15 bp, Homo sapiens
cgagtctcactctgt

SEQ ID NO: 8813 - DNA, 15 bp, Homo sapiens
ccgagtctcactctg

SEQ ID NO: 8814 - DNA, 15 bp, Homo sapiens
accgagtctcactct

SEQ ID NO: 8815 - DNA, 15 bp, Homo sapiens
gaccgagtctcactc

SEQ ID NO: 8816 - DNA, 15 bp, Homo sapiens
agaccgagtctcact

SEQ ID NO: 8817 - DNA, 15 bp, Homo sapiens
gagaccgagtctcac

SEQ ID NO: 8818 - DNA, 15 bp, Homo sapiens
tgagaccgagtctca

SEQ ID NO: 8819 - DNA, 15 bp, Homo sapiens
ttgagaccgagtctc

SEQ ID NO: 8820 - DNA, 15 bp, Homo sapiens
tttgagaccgagtct

SEQ ID NO: 8821 - DNA, 15 bp, Homo sapiens
ttttgagaccgagtc

SEQ ID NO: 8822 - DNA, 15 bp, Homo sapiens
tttttgagaccgagt

SEQ ID NO: 8823 - DNA, 15 bp, Homo sapiens
ttttttgagaccgag

SEQ ID NO: 8824 - DNA, 15 bp, Homo sapiens
tttttttgagaccga

SEQ ID NO: 8825 - DNA, 15 bp, Homo sapiens
ttttttttgagaccg

SEQ ID NO: 8826 - DNA, 15 bp, Homo sapiens
tttttttttgagacc

SEQ ID NO: 8827 - DNA, 15 bp, Homo sapiens
ttttttttttgagac

SEQ ID NO: 8828 - DNA, 15 bp, Homo sapiens
tttttttttttgaga

SEQ ID NO: 8829 - DNA, 15 bp, Homo sapiens
ttttttttttttgag

SEQ ID NO: 8830 - DNA, 15 bp, Homo sapiens
tttttttttttttga

SEQ ID NO: 8831 - DNA, 15 bp, Homo sapiens
ttttttttttttttg

SEQ ID NO: 8832 - DNA, 15 bp, Homo sapiens
atacttttttttttt

SEQ ID NO: 8833 - DNA, 15 bp, Homo sapiens
gatactttttttttt

SEQ ID NO: 8834 - DNA, 15 bp, Homo sapiens
tgatacttttttttt

SEQ ID NO: 8835 - DNA, 15 bp, Homo sapiens
ctgatactttttttt

SEQ ID NO: 8836 - DNA, 15 bp, Homo sapiens
cctgatacttttttt

SEQ ID NO: 8837 - DNA, 15 bp, Homo sapiens
acctgatactttttt

SEQ ID NO: 8838 - DNA, 15 bp, Homo sapiens
tacctgatacttttt

SEQ ID NO: 8839 - DNA, 15 bp, Homo sapiens
ttacctgatactttt

SEQ ID NO: 8840 - DNA, 15 bp, Homo sapiens
tttacctgatacttt

SEQ ID NO: 8841 - DNA, 15 bp, Homo sapiens
ttttacctgatactt

SEQ ID NO: 8842 - DNA, 15 bp, Homo sapiens
tttttacctgatact

SEQ ID NO: 8843 - DNA, 15 bp, Homo sapiens
ttttttacctgatac

SEQ ID NO: 8844 - DNA, 15 bp, Homo sapiens
tttttttacctgata

SEQ ID NO: 8845 - DNA, 15 bp, Homo sapiens
atttttttacctgat

SEQ ID NO: 8846 - DNA, 15 bp, Homo sapiens
catttttttacctga

SEQ ID NO: 8847 - DNA, 15 bp, Homo sapiens
tcatttttttacctg

SEQ ID NO: 8848 - DNA, 15 bp, Homo sapiens
ttcatttttttacct

SEQ ID NO: 8849 - DNA, 15 bp, Homo sapiens
tttcatttttttacc

SEQ ID NO: 8850 - DNA, 15 bp, Homo sapiens
ctttcatttttttac

SEQ ID NO: 8851 - DNA, 15 bp, Homo sapiens
gctttcattttttta

SEQ ID NO: 8852 - DNA, 15 bp, Homo sapiens
agctttcattttttt

SEQ ID NO: 8853 - DNA, 15 bp, Homo sapiens
gagctttcatttttt

SEQ ID NO: 8854 - DNA, 15 bp, Homo sapiens
ggagctttcattttt

SEQ ID NO: 8855 - DNA, 15 bp, Homo sapiens
gggagctttcatttt

SEQ ID NO: 8856 - DNA, 15 bp, Homo sapiens
ggggagctttcattt

SEQ ID NO: 8857 - DNA, 15 bp, Homo sapiens
cggggagctttcatt

SEQ ID NO: 8858 - DNA, 15 bp, Homo sapiens
gcggggagctttcat

SEQ ID NO: 8859 - DNA, 15 bp, Homo sapiens
agcggggagctttca

SEQ ID NO: 8860 - DNA, 15 bp, Homo sapiens
aagcggggagctttc

SEQ ID NO: 8861 - DNA, 15 bp, Homo sapiens
taagcggggagcttt

SEQ ID NO: 8862 - DNA, 15 bp, Homo sapiens
ttaagcggggagctt

SEQ ID NO: 8863 - DNA, 15 bp, Homo sapiens
attaagcggggagct

SEQ ID NO: 8864 - DNA, 15 bp, Homo sapiens
gattaagcggggagc

SEQ ID NO: 8865 - DNA, 15 bp, Homo sapiens
agattaagcggggag

SEQ ID NO: 8866 - DNA, 15 bp, Homo sapiens
gagattaagcgggga

SEQ ID NO: 8867 - DNA, 15 bp, Homo sapiens
agagattaagcgggg

SEQ ID NO: 8868 - DNA, 15 bp, Homo sapiens
cagagattaagcggg

SEQ ID NO: 8869 - DNA, 15 bp, Homo sapiens
gcagagattaagcgg

SEQ ID NO: 8870 - DNA, 15 bp, Homo sapiens
agcagagattaagcg

SEQ ID NO: 8871 - DNA, 15 bp, Homo sapiens
gagcagagattaagc

SEQ ID NO: 8872 - DNA, 15 bp, Homo sapiens
ggagcagagattaag

SEQ ID NO: 8873 - DNA, 15 bp, Homo sapiens
gggagcagagattaa

SEQ ID NO: 8874 - DNA, 15 bp, Homo sapiens
tgggagcagagatta

SEQ ID NO: 8875 - DNA, 15 bp, Homo sapiens
gtgggagcagagatt

SEQ ID NO: 8876 - DNA, 15 bp, Homo sapiens
agtgggagcagagat

SEQ ID NO: 8877 - DNA, 15 bp, Homo sapiens
tagtgggagcagaga

SEQ ID NO: 8878 - DNA, 15 bp, Homo sapiens
gtagtgggagcagag

SEQ ID NO: 8879 - DNA, 15 bp, Homo sapiens
ggtagtgggagcaga

SEQ ID NO: 8880 - DNA, 15 bp, Homo sapiens
gggtagtgggagcag

SEQ ID NO: 8881 - DNA, 15 bp, Homo sapiens
tgggtagtgggagca

SEQ ID NO: 8882 - DNA, 15 bp, Homo sapiens
ctgggtagtgggagc

SEQ ID NO: 8883 - DNA, 15 bp, Homo sapiens
tctgggtagtgggag

SEQ ID NO: 8884 - DNA, 15 bp, Homo sapiens
ttctgggtagtggga

SEQ ID NO: 8885 - DNA, 15 bp, Homo sapiens
attctgggtagtggg

SEQ ID NO: 8886 - DNA, 15 bp, Homo sapiens
tattctgggtagtgg

SEQ ID NO: 8887 - DNA, 15 bp, Homo sapiens
ttattctgggtagtg

SEQ ID NO: 8888 - DNA, 15 bp, Homo sapiens
gttattctgggtagt

SEQ ID NO: 8889 - DNA, 15 bp, Homo sapiens
agttattctgggtag

SEQ ID NO: 8890 - DNA, 15 bp, Homo sapiens
cagttattctgggta

SEQ ID NO: 8891 - DNA, 15 bp, Homo sapiens
gcagttattctgggt

SEQ ID NO: 8892 - DNA, 15 bp, Homo sapiens
agcagttattctggg

SEQ ID NO: 8893 - DNA, 15 bp, Homo sapiens
cagcagttattctgg

SEQ ID NO: 8894 - DNA, 15 bp, Homo sapiens
acagcagttattctg

SEQ ID NO: 8895 - DNA, 15 bp, Homo sapiens
aacagcagttattct

SEQ ID NO: 8896 - DNA, 15 bp, Homo sapiens
taacagcagttattc

SEQ ID NO: 8897 - DNA, 15 bp, Homo sapiens
ttaacagcagttatt

SEQ ID NO: 8898 - DNA, 15 bp, Homo sapiens
attaacagcagttat

SEQ ID NO: 8899 - DNA, 15 bp, Homo sapiens
tattaacagcagtta

SEQ ID NO: 8900 - DNA, 15 bp, Homo sapiens
ctattaacagcagtt

SEQ ID NO: 8901 - DNA, 15 bp, Homo sapiens
gctattaacagcagt

SEQ ID NO: 8902 - DNA, 15 bp, Homo sapiens
agctattaacagcag

SEQ ID NO: 8903 - DNA, 15 bp, Homo sapiens
aagctattaacagca

SEQ ID NO: 8904 - DNA, 15 bp, Homo sapiens
taagctattaacagc

SEQ ID NO: 8905 - DNA, 15 bp, Homo sapiens
ttaagctattaacag

SEQ ID NO: 8906 - DNA, 15 bp, Homo sapiens
attaagctattaaca

SEQ ID NO: 8907 - DNA, 15 bp, Homo sapiens
cattaagctattaac

SEQ ID NO: 8908 - DNA, 15 bp, Homo sapiens
acattaagctattaa

SEQ ID NO: 8909 - DNA, 15 bp, Homo sapiens
tacattaagctatta

SEQ ID NO: 8910 - DNA, 15 bp, Homo sapiens
ctacattaagctatt

SEQ ID NO: 8911 - DNA, 15 bp, Homo sapiens
tctacattaagctat

SEQ ID NO: 8912 - DNA, 15 bp, Homo sapiens
atctacattaagcta

SEQ ID NO: 8913 - DNA, 15 bp, Homo sapiens
gatctacattaagct

SEQ ID NO: 8914 - DNA, 15 bp, Homo sapiens
ggatctacattaagc

SEQ ID NO: 8915 - DNA, 15 bp, Homo sapiens
aggatctacattaag

SEQ ID NO: 8916 - DNA, 15 bp, Homo sapiens
aaggatctacattaa

SEQ ID NO: 8917 - DNA, 15 bp, Homo sapiens
gaaggatctacatta

SEQ ID NO: 8918 - DNA, 15 bp, Homo sapiens
agaaggatctacatt

SEQ ID NO: 8919 - DNA, 15 bp, Homo sapiens
tagaaggatctacat

SEQ ID NO: 8920 - DNA, 15 bp, Homo sapiens
ttagaaggatctaca

SEQ ID NO: 8921 - DNA, 15 bp, Homo sapiens
cttagaaggatctac

SEQ ID NO: 8922 - DNA, 15 bp, Homo sapiens
acttagaaggatcta

SEQ ID NO: 8923 - DNA, 15 bp, Homo sapiens
gacttagaaggatct

SEQ ID NO: 8924 - DNA, 15 bp, Homo sapiens
agacttagaaggatc

SEQ ID NO: 8925 - DNA, 15 bp, Homo sapiens
aagacttagaaggat

SEQ ID NO: 8926 - DNA, 15 bp, Homo sapiens
gaagacttagaagga

SEQ ID NO: 8927 - DNA, 15 bp, Homo sapiens
agaagacttagaagg

SEQ ID NO: 8928 - DNA, 15 bp, Homo sapiens
tagaagacttagaag

SEQ ID NO: 8929 - DNA, 15 bp, Homo sapiens
ttagaagacttagaa

SEQ ID NO: 8930 - DNA, 15 bp, Homo sapiens
cttagaagacttaga

SEQ ID NO: 8931 - DNA, 15 bp, Homo sapiens
tcttagaagacttag

SEQ ID NO: 8932 - DNA, 15 bp, Homo sapiens
gtcttagaagactta

SEQ ID NO: 8933 - DNA, 15 bp, Homo sapiens
agtcttagaagactt

SEQ ID NO: 8934 - DNA, 15 bp, Homo sapiens
tagtcttagaagact

SEQ ID NO: 8935 - DNA, 15 bp, Homo sapiens
ttagtcttagaagac

SEQ ID NO: 8936 - DNA, 15 bp, Homo sapiens
tttagtcttagaaga

SEQ ID NO: 8937 - DNA, 15 bp, Homo sapiens
gtttagtcttagaag

SEQ ID NO: 8938 - DNA, 15 bp, Homo sapiens
agtttagtcttagaa

SEQ ID NO: 8939 - DNA, 15 bp, Homo sapiens
cagtttagtcttaga

SEQ ID NO: 8940 - DNA, 15 bp, Homo sapiens
acagtttagtcttag

SEQ ID NO: 8941 - DNA, 15 bp, Homo sapiens
cacagtttagtctta

SEQ ID NO: 8942 - DNA, 15 bp, Homo sapiens
acacagtttagtctt

SEQ ID NO: 8943 - DNA, 15 bp, Homo sapiens
tacacagtttagtct

SEQ ID NO: 8944 - DNA, 15 bp, Homo sapiens
gtacacagtttagtc

SEQ ID NO: 8945 - DNA, 15 bp, Homo sapiens
agtacacagtttagt

SEQ ID NO: 8946 - DNA, 15 bp, Homo sapiens
aagtacacagtttag

SEQ ID NO: 8947 - DNA, 15 bp, Homo sapiens
aaagtacacagttta

SEQ ID NO: 8948 - DNA, 15 bp, Homo sapiens
aaaagtacacagttt

SEQ ID NO: 8949 - DNA, 15 bp, Homo sapiens
aaaaagtacacagtt

SEQ ID NO: 8950 - DNA, 15 bp, Homo sapiens
caaaaagtacacagt

SEQ ID NO: 8951 - DNA, 15 bp, Homo sapiens
acaaaaagtacacag

SEQ ID NO: 8952 - DNA, 15 bp, Homo sapiens
cacaaaaagtacaca

SEQ ID NO: 8953 - DNA, 15 bp, Homo sapiens
acacaaaaagtacac

SEQ ID NO: 8954 - DNA, 15 bp, Homo sapiens
aacacaaaaagtaca

SEQ ID NO: 8955 - DNA, 15 bp, Homo sapiens
caacacaaaaagtac

SEQ ID NO: 8956 - DNA, 15 bp, Homo sapiens
acaacacaaaaagta

SEQ ID NO: 8957 - DNA, 15 bp, Homo sapiens
tacaacacaaaaagt

SEQ ID NO: 8958 - DNA, 15 bp, Homo sapiens
ttacaacacaaaaag

SEQ ID NO: 8959 - DNA, 15 bp, Homo sapiens
attacaacacaaaaa

SEQ ID NO: 8960 - DNA, 15 bp, Homo sapiens
aattacaacacaaaa

SEQ ID NO: 8961 - DNA, 15 bp, Homo sapiens
taattacaacacaaa

SEQ ID NO: 8962 - DNA, 15 bp, Homo sapiens
ttaattacaacacaa

SEQ ID NO: 8963 - DNA, 15 bp, Homo sapiens
gttaattacaacaca

SEQ ID NO: 8964 - DNA, 15 bp, Homo sapiens
tgttaattacaacac

SEQ ID NO: 8965 - DNA, 15 bp, Homo sapiens
ctgttaattacaaca

SEQ ID NO: 8966 - DNA, 15 bp, Homo sapiens
cctgttaattacaac

SEQ ID NO: 8967 - DNA, 15 bp, Homo sapiens
tcctgttaattacaa

SEQ ID NO: 8968 - DNA, 15 bp, Homo sapiens
ctcctgttaattaca

SEQ ID NO: 8969 - DNA, 15 bp, Homo sapiens
cctcctgttaattac

SEQ ID NO: 8970 - DNA, 15 bp, Homo sapiens
ccctcctgttaatta

SEQ ID NO: 8971 - DNA, 15 bp, Homo sapiens
accctcctgttaatt

SEQ ID NO: 8972 - DNA, 15 bp, Homo sapiens
aaccctcctgttaat

SEQ ID NO: 8973 - DNA, 15 bp, Homo sapiens
aaaccctcctgttaa

SEQ ID NO: 8974 - DNA, 15 bp, Homo sapiens
aaaaccctcctgtta

SEQ ID NO: 8975 - DNA, 15 bp, Homo sapiens
aaaaaccctcctgtt

SEQ ID NO: 8976 - DNA, 15 bp, Homo sapiens
caaaaaccctcctgt

SEQ ID NO: 8977 - DNA, 15 bp, Homo sapiens
acaaaaaccctcctg

SEQ ID NO: 8978 - DNA, 15 bp, Homo sapiens
aacaaaaaccctcct

SEQ ID NO: 8979 - DNA, 15 bp, Homo sapiens
aaacaaaaaccctcc

SEQ ID NO: 8980 - DNA, 15 bp, Homo sapiens
aaaacaaaaaccctc

SEQ ID NO: 8981 - DNA, 15 bp, Homo sapiens
caaaacaaaaaccct

SEQ ID NO: 8982 - DNA, 15 bp, Homo sapiens
acaaaacaaaaaccc

SEQ ID NO: 8983 - DNA, 15 bp, Homo sapiens
aacaaaacaaaaacc

SEQ ID NO: 8984 - DNA, 15 bp, Homo sapiens
aaacaaaacaaaaac

SEQ ID NO: 8985 - DNA, 15 bp, Homo sapiens
aaaacaaaacaaaaa

SEQ ID NO: 8986 - DNA, 15 bp, Homo sapiens
caaaacaaaacaaaa

SEQ ID NO: 8987 - DNA, 15 bp, Homo sapiens
acaaaacaaaacaaa

SEQ ID NO: 8988 - DNA, 15 bp, Homo sapiens
aacaaaacaaaacaa

SEQ ID NO: 8989 - DNA, 15 bp, Homo sapiens
aaacaaaacaaaaca

SEQ ID NO: 8990 - DNA, 15 bp, Homo sapiens
aaaacaaaacaaaac

SEQ ID NO: 8991 - DNA, 15 bp, Homo sapiens
aaaaacaaaacaaaa

SEQ ID NO: 8992 - DNA, 15 bp, Homo sapiens
aaaaaacaaaacaaa

SEQ ID NO: 8993 - DNA, 15 bp, Homo sapiens
gaaaaaacaaaacaa

SEQ ID NO: 8994 - DNA, 15 bp, Homo sapiens
agaaaaaacaaaaca

SEQ ID NO: 8995 - DNA, 15 bp, Homo sapiens
aagaaaaaacaaaac

SEQ ID NO: 8996 - DNA, 15 bp, Homo sapiens
aaagaaaaaacaaaa

SEQ ID NO: 8997 - DNA, 15 bp, Homo sapiens
aaaagaaaaaacaaa

SEQ ID NO: 8998 - DNA, 15 bp, Homo sapiens
aaaaagaaaaaacaa

SEQ ID NO: 8999 - DNA, 15 bp, Homo sapiens
aaaaaagaaaaaaca

SEQ ID NO: 9000 - DNA, 15 bp, Homo sapiens
aaaaaaagaaaaaac

SEQ ID NO: 9001 - DNA, 15 bp, Homo sapiens
caaaaaaagaaaaaa

SEQ ID NO: 9002 - DNA, 15 bp, Homo sapiens
tcaaaaaaagaaaaa

SEQ ID NO: 9003 - DNA, 15 bp, Homo sapiens
ctcaaaaaaagaaaa

SEQ ID NO: 9004 - DNA, 15 bp, Homo sapiens
tctcaaaaaaagaaa

SEQ ID NO: 9005 - DNA, 15 bp, Homo sapiens
atctcaaaaaaagaa

SEQ ID NO: 9006 - DNA, 15 bp, Homo sapiens
catctcaaaaaaaga

SEQ ID NO: 9007 - DNA, 15 bp, Homo sapiens
ccatctcaaaaaaag

SEQ ID NO: 9008 - DNA, 15 bp, Homo sapiens
atgacagagcaagac

SEQ ID NO: 9009 - DNA, 15 bp, Homo sapiens
gatgacagagcaaga

SEQ ID NO: 9010 - DNA, 15 bp, Homo sapiens
ggatgacagagcaag

SEQ ID NO: 9011 - DNA, 15 bp, Homo sapiens
tggatgacagagcaa

SEQ ID NO: 9012 - DNA, 15 bp, Homo sapiens
ctggatgacagagca

SEQ ID NO: 9013 - DNA, 15 bp, Homo sapiens
cctggatgacagagc

SEQ ID NO: 9014 - DNA, 15 bp, Homo sapiens
gcctggatgacagag

SEQ ID NO: 9015 - DNA, 15 bp, Homo sapiens
agcctggatgacaga

SEQ ID NO: 9016 - DNA, 15 bp, Homo sapiens
cagcctggatgacag

SEQ ID NO: 9017 - DNA, 15 bp, Homo sapiens
ccagcctggatgaca

SEQ ID NO: 9018 - DNA, 15 bp, Homo sapiens
tccagcctggatgac

SEQ ID NO: 9019 - DNA, 15 bp, Homo sapiens
ctccagcctggatga

SEQ ID NO: 9020 - DNA, 15 bp, Homo sapiens
actccagcctggatg

SEQ ID NO: 9021 - DNA, 15 bp, Homo sapiens
tactccagcctggat

SEQ ID NO: 9022 - DNA, 15 bp, Homo sapiens
gtactccagcctgga

SEQ ID NO: 9023 - DNA, 15 bp, Homo sapiens
tgtactccagcctgg

SEQ ID NO: 9024 - DNA, 15 bp, Homo sapiens
ctgtactccagcctg

SEQ ID NO: 9025 - DNA, 15 bp, Homo sapiens
actgtactccagcct

SEQ ID NO: 9026 - DNA, 15 bp, Homo sapiens
cactgtactccagcc

SEQ ID NO: 9027 - DNA, 15 bp, Homo sapiens
ccactgtactccagc

SEQ ID NO: 9028 - DNA, 15 bp, Homo sapiens
gccactgtactccag

SEQ ID NO: 9029 - DNA, 15 bp, Homo sapiens
tgccactgtactcca

SEQ ID NO: 9030 - DNA, 15 bp, Homo sapiens
gtgccactgtactcc

SEQ ID NO: 9031 - DNA, 15 bp, Homo sapiens
tgtgccactgtactc

SEQ ID NO: 9032 - DNA, 15 bp, Homo sapiens
ttgtgccactgtact

SEQ ID NO: 9033 - DNA, 15 bp, Homo sapiens
attgtgccactgtac

SEQ ID NO: 9034 - DNA, 15 bp, Homo sapiens
gattgtgccactgta

SEQ ID NO: 9035 - DNA, 15 bp, Homo sapiens
agattgtgccactgt

SEQ ID NO: 9036 - DNA, 15 bp, Homo sapiens
aagattgtgccactg

SEQ ID NO: 9037 - DNA, 15 bp, Homo sapiens
caagattgtgccact

SEQ ID NO: 9038 - DNA, 15 bp, Homo sapiens
ccaagattgtgccac

SEQ ID NO: 9039 - DNA, 15 bp, Homo sapiens
gccaagattgtgcca

SEQ ID NO: 9040 - DNA, 15 bp, Homo sapiens
agccaagattgtgcc

SEQ ID NO: 9041 - DNA, 15 bp, Homo sapiens
gagccaagattgtgc

SEQ ID NO: 9042 - DNA, 15 bp, Homo sapiens
tgagccaagattgtg

SEQ ID NO: 9043 - DNA, 15 bp, Homo sapiens
gtgagccaagattgt

SEQ ID NO: 9044 - DNA, 15 bp, Homo sapiens
agtgagccaagattg

SEQ ID NO: 9045 - DNA, 15 bp, Homo sapiens
cagtgagccaagatt

SEQ ID NO: 9046 - DNA, 15 bp, Homo sapiens
gcagtgagccaagat

SEQ ID NO: 9047 - DNA, 15 bp, Homo sapiens
tgcagtgagccaaga

SEQ ID NO: 9048 - DNA, 15 bp, Homo sapiens
ttgcagtgagccaag

SEQ ID NO: 9049 - DNA, 15 bp, Homo sapiens
gttgcagtgagccaa

SEQ ID NO: 9050 - DNA, 15 bp, Homo sapiens
ggttgcagtgagcca

SEQ ID NO: 9051 - DNA, 15 bp, Homo sapiens
acttgaacccaggag

SEQ ID NO: 9052 - DNA, 15 bp, Homo sapiens
cacttgaacccagga

SEQ ID NO: 9053 - DNA, 15 bp, Homo sapiens
tcacttgaacccagg

SEQ ID NO: 9054 - DNA, 15 bp, Homo sapiens
atcacttgaacccag

SEQ ID NO: 9055 - DNA, 15 bp, Homo sapiens
aatcacttgaaccca

SEQ ID NO: 9056 - DNA, 15 bp, Homo sapiens
gaatcacttgaaccc

SEQ ID NO: 9057 - DNA, 15 bp, Homo sapiens
agaatcacttgaacc

SEQ ID NO: 9058 - DNA, 15 bp, Homo sapiens
gagaatcacttgaac

SEQ ID NO: 9059 - DNA, 15 bp, Homo sapiens
ggagaatcacttgaa

SEQ ID NO: 9060 - DNA, 15 bp, Homo sapiens
aggagaatcacttga

SEQ ID NO: 9061 - DNA, 15 bp, Homo sapiens
caggagaatcacttg

SEQ ID NO: 9062 - DNA, 15 bp, Homo sapiens
gcaggagaatcactt

SEQ ID NO: 9063 - DNA, 15 bp, Homo sapiens
ggcaggagaatcact

SEQ ID NO: 9064 - DNA, 15 bp, Homo sapiens
aggcaggagaatcac

SEQ ID NO: 9065 - DNA, 15 bp, Homo sapiens
gaggcaggagaatca

SEQ ID NO: 9066 - DNA, 15 bp, Homo sapiens
ggtggcaggcgcctg

SEQ ID NO: 9067 - DNA, 15 bp, Homo sapiens
tggtggcaggcgcct

SEQ ID NO: 9068 - DNA, 15 bp, Homo sapiens
gtggtggcaggcgcc

SEQ ID NO: 9069 - DNA, 15 bp, Homo sapiens
tgtggtggcaggcgc

SEQ ID NO: 9070 - DNA, 15 bp, Homo sapiens
gtgtggtggcaggcg

SEQ ID NO: 9071 - DNA, 15 bp, Homo sapiens
ggtgtggtggcaggc

SEQ ID NO: 9072 - DNA, 15 bp, Homo sapiens
gggtgtggtggcagg

SEQ ID NO: 9073 - DNA, 15 bp, Homo sapiens
tgggtgtggtggcag

SEQ ID NO: 9074 - DNA, 15 bp, Homo sapiens
ctgggtgtggtggca

SEQ ID NO: 9075 - DNA, 15 bp, Homo sapiens
gctgggtgtggtggc

SEQ ID NO: 9076 - DNA, 15 bp, Homo sapiens
acccatctctactaa

SEQ ID NO: 9077 - DNA, 15 bp, Homo sapiens
aacccatctctacta

SEQ ID NO: 9078 - DNA, 15 bp, Homo sapiens
aaacccatctctact

SEQ ID NO: 9079 - DNA, 15 bp, Homo sapiens
gaaacccatctctac

SEQ ID NO: 9080 - DNA, 15 bp, Homo sapiens
tgaaacccatctcta

SEQ ID NO: 9081 - DNA, 15 bp, Homo sapiens
gtgaaacccatctct

SEQ ID NO: 9082 - DNA, 15 bp, Homo sapiens
ggtgaaacccatctc

SEQ ID NO: 9083 - DNA, 15 bp, Homo sapiens
tggtgaaacccatct

SEQ ID NO: 9084 - DNA, 15 bp, Homo sapiens
atggtgaaacccatc

SEQ ID NO: 9085 - DNA, 15 bp, Homo sapiens
catggtgaaacccat

SEQ ID NO: 9086 - DNA, 15 bp, Homo sapiens
acatggtgaaaccca

SEQ ID NO: 9087 - DNA, 15 bp, Homo sapiens
caccagcctggccaa

SEQ ID NO: 9088 - DNA, 15 bp, Homo sapiens
acaccagcctggcca

SEQ ID NO: 9089 - DNA, 15 bp, Homo sapiens
gacaccagcctggcc

SEQ ID NO: 9090 - DNA, 15 bp, Homo sapiens
cgacaccagcctggc

SEQ ID NO: 9091 - DNA, 15 bp, Homo sapiens
tcgacaccagcctgg

SEQ ID NO: 9092 - DNA, 15 bp, Homo sapiens
ttcgacaccagcctg

SEQ ID NO: 9093 - DNA, 15 bp, Homo sapiens
gttcgacaccagcct

SEQ ID NO: 9094 - DNA, 15 bp, Homo sapiens
agttcgacaccagcc

SEQ ID NO: 9095 - DNA, 15 bp, Homo sapiens
gagttcgacaccagc

SEQ ID NO: 9096 - DNA, 15 bp, Homo sapiens
ggagttcgacaccag

SEQ ID NO: 9097 - DNA, 15 bp, Homo sapiens
aggagttcgacacca

SEQ ID NO: 9098 - DNA, 15 bp, Homo sapiens
caggagttcgacacc

SEQ ID NO: 9099 - DNA, 15 bp, Homo sapiens
tcaggagttcgacac

SEQ ID NO: 9100 - DNA, 15 bp, Homo sapiens
gtcaggagttcgaca

SEQ ID NO: 9101 - DNA, 15 bp, Homo sapiens
ggtcaggagttcgac

SEQ ID NO: 9102 - DNA, 15 bp, Homo sapiens
ctgaggtcaggagtt

SEQ ID NO: 9103 - DNA, 15 bp, Homo sapiens
cctgaggtcaggagt

SEQ ID NO: 9104 - DNA, 15 bp, Homo sapiens
gcctgaggtcaggag

SEQ ID NO: 9105 - DNA, 15 bp, Homo sapiens
aggtggatcgcctga

SEQ ID NO: 9106 - DNA, 15 bp, Homo sapiens
caggtggatcgcctg

SEQ ID NO: 9107 - DNA, 15 bp, Homo sapiens
gcaggtggatcgcct

SEQ ID NO: 9108 - DNA, 15 bp, Homo sapiens
ggcaggtggatcgcc

SEQ ID NO: 9109 - DNA, 15 bp, Homo sapiens
aggcaggtggatcgc

SEQ ID NO: 9110 - DNA, 15 bp, Homo sapiens
aaggcaggtggatcg

SEQ ID NO: 9111 - DNA, 15 bp, Homo sapiens
acggtggctcacgcc

SEQ ID NO: 9112 - DNA, 15 bp, Homo sapiens
cacggtggctcacgc

SEQ ID NO: 9113 - DNA, 15 bp, Homo sapiens
gcacggtggctcacg

SEQ ID NO: 9114 - DNA, 15 bp, Homo sapiens
ggcacggtggctcac

SEQ ID NO: 9115 - DNA, 15 bp, Homo sapiens
aggcacggtggctca

SEQ ID NO: 9116 - DNA, 15 bp, Homo sapiens
caggcacggtggctc

SEQ ID NO: 9117 - DNA, 15 bp, Homo sapiens
ccaggcacggtggct

SEQ ID NO: 9118 - DNA, 15 bp, Homo sapiens
gccaggcacggtggc

SEQ ID NO: 9119 - DNA, 15 bp, Homo sapiens
ggccaggcacggtgg

SEQ ID NO: 9120 - DNA, 15 bp, Homo sapiens
aggccaggcacggtg

SEQ ID NO: 9121 - DNA, 15 bp, Homo sapiens
gaggccaggcacggt

SEQ ID NO: 9122 - DNA, 15 bp, Homo sapiens
tgaggccaggcacgg

SEQ ID NO: 9123 - DNA, 15 bp, Homo sapiens
ctgaggccaggcacg

SEQ ID NO: 9124 - DNA, 15 bp, Homo sapiens
cctgaggccaggcac

SEQ ID NO: 9125 - DNA, 15 bp, Homo sapiens
tcctgaggccaggca

SEQ ID NO: 9126 - DNA, 15 bp, Homo sapiens
atcctgaggccaggc

SEQ ID NO: 9127 - DNA, 15 bp, Homo sapiens
catcctgaggccagg

SEQ ID NO: 9128 - DNA, 15 bp, Homo sapiens
ccatcctgaggccag

SEQ ID NO: 9129 - DNA, 15 bp, Homo sapiens
accatcctgaggcca

SEQ ID NO: 9130 - DNA, 15 bp, Homo sapiens
caccatcctgaggcc

SEQ ID NO: 9131 - DNA, 15 bp, Homo sapiens
acaccatcctgaggc

SEQ ID NO: 9132 - DNA, 15 bp, Homo sapiens
aacaccatcctgagg

SEQ ID NO: 9133 - DNA, 15 bp, Homo sapiens
taacaccatcctgag

SEQ ID NO: 9134 - DNA, 15 bp, Homo sapiens
ataacaccatcctga

SEQ ID NO: 9135 - DNA, 15 bp, Homo sapiens
tataacaccatcctg

SEQ ID NO: 9136 - DNA, 15 bp, Homo sapiens
atataacaccatcct

SEQ ID NO: 9137 - DNA, 15 bp, Homo sapiens
tatataacaccatcc

SEQ ID NO: 9138 - DNA, 15 bp, Homo sapiens
atatataacaccatc

SEQ ID NO: 9139 - DNA, 15 bp, Homo sapiens
tatatataacaccat

SEQ ID NO: 9140 - DNA, 15 bp, Homo sapiens
gtatatataacacca

SEQ ID NO: 9141 - DNA, 15 bp, Homo sapiens
tgtatatataacacc

SEQ ID NO: 9142 - DNA, 15 bp, Homo sapiens
atgtatatataacac

SEQ ID NO: 9143 - DNA, 15 bp, Homo sapiens
tatgtatatataaca

SEQ ID NO: 9144 - DNA, 15 bp, Homo sapiens
atatgtatatataac

SEQ ID NO: 9145 - DNA, 15 bp, Homo sapiens
aatatgtatatataa

SEQ ID NO: 9146 - DNA, 15 bp, Homo sapiens
gaatatgtatatata

SEQ ID NO: 9147 - DNA, 15 bp, Homo sapiens
agaatatgtatatat

SEQ ID NO: 9148 - DNA, 15 bp, Homo sapiens
cagaatatgtatata

SEQ ID NO: 9149 - DNA, 15 bp, Homo sapiens
gcagaatatgtatat

SEQ ID NO: 9150 - DNA, 15 bp, Homo sapiens
tgcagaatatgtata

SEQ ID NO: 9151 - DNA, 15 bp, Homo sapiens
atgcagaatatgtat

SEQ ID NO: 9152 - DNA, 15 bp, Homo sapiens
aatgcagaatatgta

SEQ ID NO: 9153 - DNA, 15 bp, Homo sapiens
aaatgcagaatatgt

SEQ ID NO: 9154 - DNA, 15 bp, Homo sapiens
aaaatgcagaatatg

SEQ ID NO: 9155 - DNA, 15 bp, Homo sapiens
aaaaatgcagaatat

SEQ ID NO: 9156 - DNA, 15 bp, Homo sapiens
gaaaaatgcagaata

SEQ ID NO: 9157 - DNA, 15 bp, Homo sapiens
ggaaaaatgcagaat

SEQ ID NO: 9158 - DNA, 15 bp, Homo sapiens
tggaaaaatgcagaa

SEQ ID NO: 9159 - DNA, 15 bp, Homo sapiens
atggaaaaatgcaga

SEQ ID NO: 9160 - DNA, 15 bp, Homo sapiens
gatggaaaaatgcag

SEQ ID NO: 9161 - DNA, 15 bp, Homo sapiens
agatggaaaaatgca

SEQ ID NO: 9162 - DNA, 15 bp, Homo sapiens
gagatggaaaaatgc

SEQ ID NO: 9163 - DNA, 15 bp, Homo sapiens
tgagatggaaaaatg

SEQ ID NO: 9164 - DNA, 15 bp, Homo sapiens
atgagatggaaaaat

SEQ ID NO: 9165 - DNA, 15 bp, Homo sapiens
tatgagatggaaaaa

SEQ ID NO: 9166 - DNA, 15 bp, Homo sapiens
atatgagatggaaaa

SEQ ID NO: 9167 - DNA, 15 bp, Homo sapiens
tatatgagatggaaa

SEQ ID NO: 9168 - DNA, 15 bp, Homo sapiens
atatatgagatggaa

SEQ ID NO: 9169 - DNA, 15 bp, Homo sapiens
aatatatgagatgga

SEQ ID NO: 9170 - DNA, 15 bp, Homo sapiens
gaatatatgagatgg

SEQ ID NO: 9171 - DNA, 15 bp, Homo sapiens
tgaatatatgagatg

SEQ ID NO: 9172 - DNA, 15 bp, Homo sapiens
atgaatatatgagat

SEQ ID NO: 9173 - DNA, 15 bp, Homo sapiens
gatgaatatatgaga

SEQ ID NO: 9174 - DNA, 15 bp, Homo sapiens
agatgaatatatgag

SEQ ID NO: 9175 - DNA, 15 bp, Homo sapiens
gagatgaatatatga

SEQ ID NO: 9176 - DNA, 15 bp, Homo sapiens
agagatgaatatatg

SEQ ID NO: 9177 - DNA, 15 bp, Homo sapiens
cagagatgaatatat

SEQ ID NO: 9178 - DNA, 15 bp, Homo sapiens
gcagagatgaatata

SEQ ID NO: 9179 - DNA, 15 bp, Homo sapiens
ggcagagatgaatat

SEQ ID NO: 9180 - DNA, 15 bp, Homo sapiens
aggcagagatgaata

SEQ ID NO: 9181 - DNA, 15 bp, Homo sapiens
gaggcagagatgaat

SEQ ID NO: 9182 - DNA, 15 bp, Homo sapiens
tgaggcagagatgaa

SEQ ID NO: 9183 - DNA, 15 bp, Homo sapiens
atgaggcagagatga

SEQ ID NO: 9184 - DNA, 15 bp, Homo sapiens
aatgaggcagagatg

SEQ ID NO: 9185 - DNA, 15 bp, Homo sapiens
aaatgaggcagagat

SEQ ID NO: 9186 - DNA, 15 bp, Homo sapiens
gaaatgaggcagaga

SEQ ID NO: 9187 - DNA, 15 bp, Homo sapiens
agaaatgaggcagag

SEQ ID NO: 9188 - DNA, 15 bp, Homo sapiens
aagaaatgaggcaga

SEQ ID NO: 9189 - DNA, 15 bp, Homo sapiens
aaagaaatgaggcag

SEQ ID NO: 9190 - DNA, 15 bp, Homo sapiens
aaaagaaatgaggca

SEQ ID NO: 9191 - DNA, 15 bp, Homo sapiens
taaaagaaatgaggc

SEQ ID NO: 9192 - DNA, 15 bp, Homo sapiens
ttaaaagaaatgagg

SEQ ID NO: 9193 - DNA, 15 bp, Homo sapiens
tttaaaagaaatgag

SEQ ID NO: 9194 - DNA, 15 bp, Homo sapiens
atttaaaagaaatga

SEQ ID NO: 9195 - DNA, 15 bp, Homo sapiens
tatttaaaagaaatg

SEQ ID NO: 9196 - DNA, 15 bp, Homo sapiens
ctatttaaaagaaat

SEQ ID NO: 9197 - DNA, 15 bp, Homo sapiens
gctatttaaaagaaa

SEQ ID NO: 9198 - DNA, 15 bp, Homo sapiens
tgctatttaaaagaa

SEQ ID NO: 9199 - DNA, 15 bp, Homo sapiens
ctgctatttaaaaga

SEQ ID NO: 9200 - DNA, 15 bp, Homo sapiens
actgctatttaaaag

SEQ ID NO: 9201 - DNA, 15 bp, Homo sapiens
cactgctatttaaaa

SEQ ID NO: 9202 - DNA, 15 bp, Homo sapiens
acactgctatttaaa

SEQ ID NO: 9203 - DNA, 15 bp, Homo sapiens
tacactgctatttaa

SEQ ID NO: 9204 - DNA, 15 bp, Homo sapiens
ctacactgctattta

SEQ ID NO: 9205 - DNA, 15 bp, Homo sapiens
actacactgctattt

SEQ ID NO: 9206 - DNA, 15 bp, Homo sapiens
gactacactgctatt

SEQ ID NO: 9207 - DNA, 15 bp, Homo sapiens
ggactacactgctat

SEQ ID NO: 9208 - DNA, 15 bp, Homo sapiens
tggactacactgcta

SEQ ID NO: 9209 - DNA, 15 bp, Homo sapiens
ctggactacactgct

SEQ ID NO: 9210 - DNA, 15 bp, Homo sapiens
cctggactacactgc

SEQ ID NO: 9211 - DNA, 15 bp, Homo sapiens
ccctggactacactg

SEQ ID NO: 9212 - DNA, 15 bp, Homo sapiens
gccctggactacact

SEQ ID NO: 9213 - DNA, 15 bp, Homo sapiens
agccctggactacac

SEQ ID NO: 9214 - DNA, 15 bp, Homo sapiens
cagccctggactaca

SEQ ID NO: 9215 - DNA, 15 bp, Homo sapiens
tcagccctggactac

SEQ ID NO: 9216 - DNA, 15 bp, Homo sapiens
gtcagccctggacta

SEQ ID NO: 9217 - DNA, 15 bp, Homo sapiens
agtcagccctggact

SEQ ID NO: 9218 - DNA, 15 bp, Homo sapiens
aagtcagccctggac

SEQ ID NO: 9219 - DNA, 15 bp, Homo sapiens
taagtcagccctgga

SEQ ID NO: 9220 - DNA, 15 bp, Homo sapiens
gtaagtcagccctgg

SEQ ID NO: 9221 - DNA, 15 bp, Homo sapiens
ggtaagtcagccctg

SEQ ID NO: 9222 - DNA, 15 bp, Homo sapiens
cggtaagtcagccct

SEQ ID NO: 9223 - DNA, 15 bp, Homo sapiens
acggtaagtcagccc

SEQ ID NO: 9224 - DNA, 15 bp, Homo sapiens
gacggtaagtcagcc

SEQ ID NO: 9225 - DNA, 15 bp, Homo sapiens
tgacggtaagtcagc

SEQ ID NO: 9226 - DNA, 15 bp, Homo sapiens
atgacggtaagtcag

SEQ ID NO: 9227 - DNA, 15 bp, Homo sapiens
catgacggtaagtca

SEQ ID NO: 9228 - DNA, 15 bp, Homo sapiens
gcatgacggtaagtc

SEQ ID NO: 9229 - DNA, 15 bp, Homo sapiens
tgcatgacggtaagt

SEQ ID NO: 9230 - DNA, 15 bp, Homo sapiens
atgcatgacggtaag

SEQ ID NO: 9231 - DNA, 15 bp, Homo sapiens
aatgcatgacggtaa

SEQ ID NO: 9232 - DNA, 15 bp, Homo sapiens
aaatgcatgacggta

SEQ ID NO: 9233 - DNA, 15 bp, Homo sapiens
gaaatgcatgacggt

SEQ ID NO: 9234 - DNA, 15 bp, Homo sapiens
cgaaatgcatgacgg

SEQ ID NO: 9235 - DNA, 15 bp, Homo sapiens
acgaaatgcatgacg

SEQ ID NO: 9236 - DNA, 15 bp, Homo sapiens
aacgaaatgcatgac

SEQ ID NO: 9237 - DNA, 15 bp, Homo sapiens
caacgaaatgcatga

SEQ ID NO: 9238 - DNA, 15 bp, Homo sapiens
acaacgaaatgcatg

SEQ ID NO: 9239 - DNA, 15 bp, Homo sapiens
gacaacgaaatgcat

SEQ ID NO: 9240 - DNA, 15 bp, Homo sapiens
agacaacgaaatgca

SEQ ID NO: 9241 - DNA, 15 bp, Homo sapiens
gagacaacgaaatgc

SEQ ID NO: 9242 - DNA, 15 bp, Homo sapiens
agagacaacgaaatg

SEQ ID NO: 9243 - DNA, 15 bp, Homo sapiens
gagagacaacgaaat

SEQ ID NO: 9244 - DNA, 15 bp, Homo sapiens
agagagacaacgaaa

SEQ ID NO: 9245 - DNA, 15 bp, Homo sapiens
tagagagacaacgaa

SEQ ID NO: 9246 - DNA, 15 bp, Homo sapiens
atagagagacaacga

SEQ ID NO: 9247 - DNA, 15 bp, Homo sapiens
catagagagacaacg

SEQ ID NO: 9248 - DNA, 15 bp, Homo sapiens
acatagagagacaac

SEQ ID NO: 9249 - DNA, 15 bp, Homo sapiens
aacatagagagacaa

SEQ ID NO: 9250 - DNA, 15 bp, Homo sapiens
taacatagagagaca

SEQ ID NO: 9251 - DNA, 15 bp, Homo sapiens
ataacatagagagac

SEQ ID NO: 9252 - DNA, 15 bp, Homo sapiens
aataacatagagaga

SEQ ID NO: 9253 - DNA, 15 bp, Homo sapiens
taataacatagagag

SEQ ID NO: 9254 - DNA, 15 bp, Homo sapiens
ttaataacatagaga

SEQ ID NO: 9255 - DNA, 15 bp, Homo sapiens
tttaataacatagag

SEQ ID NO: 9256 - DNA, 15 bp, Homo sapiens
ttttaataacataga

SEQ ID NO: 9257 - DNA, 15 bp, Homo sapiens
tttttaataacatag

SEQ ID NO: 9258 - DNA, 15 bp, Homo sapiens
atttttaataacata

SEQ ID NO: 9259 - DNA, 15 bp, Homo sapiens
catttttaataacat

SEQ ID NO: 9260 - DNA, 15 bp, Homo sapiens
gcatttttaataaca

SEQ ID NO: 9261 - DNA, 15 bp, Homo sapiens
agcatttttaataac

SEQ ID NO: 9262 - DNA, 15 bp, Homo sapiens
tagcatttttaataa

SEQ ID NO: 9263 - DNA, 15 bp, Homo sapiens
gtagcatttttaata

SEQ ID NO: 9264 - DNA, 15 bp, Homo sapiens
tgtagcatttttaat

SEQ ID NO: 9265 - DNA, 15 bp, Homo sapiens
ctgtagcatttttaa

SEQ ID NO: 9266 - DNA, 15 bp, Homo sapiens
cctgtagcattttta

SEQ ID NO: 9267 - DNA, 15 bp, Homo sapiens
tcctgtagcattttt

SEQ ID NO: 9268 - DNA, 15 bp, Homo sapiens
atcctgtagcatttt

SEQ ID NO: 9269 - DNA, 15 bp, Homo sapiens
aatcctgtagcattt

SEQ ID NO: 9270 - DNA, 15 bp, Homo sapiens
caatcctgtagcatt

SEQ ID NO: 9271 - DNA, 15 bp, Homo sapiens
tcaatcctgtagcat

SEQ ID NO: 9272 - DNA, 15 bp, Homo sapiens
ttcaatcctgtagca

SEQ ID NO: 9273 - DNA, 15 bp, Homo sapiens
tttcaatcctgtagc

SEQ ID NO: 9274 - DNA, 15 bp, Homo sapiens
atttcaatcctgtag

SEQ ID NO: 9275 - DNA, 15 bp, Homo sapiens
aatttcaatcctgta

SEQ ID NO: 9276 - DNA, 15 bp, Homo sapiens
gaatttcaatcctgt

SEQ ID NO: 9277 - DNA, 15 bp, Homo sapiens
ggaatttcaatcctg

SEQ ID NO: 9278 - DNA, 15 bp, Homo sapiens
aggaatttcaatcct

SEQ ID NO: 9279 - DNA, 15 bp, Homo sapiens
gaggaatttcaatcc

SEQ ID NO: 9280 - DNA, 15 bp, Homo sapiens
tgaggaatttcaatc

SEQ ID NO: 9281 - DNA, 15 bp, Homo sapiens
atgaggaatttcaat

SEQ ID NO: 9282 - DNA, 15 bp, Homo sapiens
catgaggaatttcaa

SEQ ID NO: 9283 - DNA, 15 bp, Homo sapiens
acatgaggaatttca

SEQ ID NO: 9284 - DNA, 15 bp, Homo sapiens
cacatgaggaatttc

SEQ ID NO: 9285 - DNA, 15 bp, Homo sapiens
gcacatgaggaattt

SEQ ID NO: 9286 - DNA, 15 bp, Homo sapiens
ggcacatgaggaatt

SEQ ID NO: 9287 - DNA, 15 bp, Homo sapiens
tggcacatgaggaat

SEQ ID NO: 9288 - DNA, 15 bp, Homo sapiens
ctggcacatgaggaa

SEQ ID NO: 9289 - DNA, 15 bp, Homo sapiens
actggcacatgagga

SEQ ID NO: 9290 - DNA, 15 bp, Homo sapiens
gactggcacatgagg

SEQ ID NO: 9291 - DNA, 15 bp, Homo sapiens
tgactggcacatgag

SEQ ID NO: 9292 - DNA, 15 bp, Homo sapiens
atgactggcacatga

SEQ ID NO: 9293 - DNA, 15 bp, Homo sapiens
aatgactggcacatg

SEQ ID NO: 9294 - DNA, 15 bp, Homo sapiens
aaatgactggcacat

SEQ ID NO: 9295 - DNA, 15 bp, Homo sapiens
aaaatgactggcaca

SEQ ID NO: 9296 - DNA, 15 bp, Homo sapiens
caaaatgactggcac

SEQ ID NO: 9297 - DNA, 15 bp, Homo sapiens
tcaaaatgactggca

SEQ ID NO: 9298 - DNA, 15 bp, Homo sapiens
ttcaaaatgactggc

SEQ ID NO: 9299 - DNA, 15 bp, Homo sapiens
cttcaaaatgactgg

SEQ ID NO: 9300 - DNA, 15 bp, Homo sapiens
tcttcaaaatgactg

SEQ ID NO: 9301 - DNA, 15 bp, Homo sapiens
ttcttcaaaatgact

SEQ ID NO: 9302 - DNA, 15 bp, Homo sapiens
attcttcaaaatgac

SEQ ID NO: 9303 - DNA, 15 bp, Homo sapiens
cattcttcaaaatga

SEQ ID NO: 9304 - DNA, 15 bp, Homo sapiens
ccattcttcaaaatg

SEQ ID NO: 9305 - DNA, 15 bp, Homo sapiens
gccattcttcaaaat

SEQ ID NO: 9306 - DNA, 15 bp, Homo sapiens
agccattcttcaaaa

SEQ ID NO: 9307 - DNA, 15 bp, Homo sapiens
cagccattcttcaaa

SEQ ID NO: 9308 - DNA, 15 bp, Homo sapiens
gcagccattcttcaa

SEQ ID NO: 9309 - DNA, 15 bp, Homo sapiens
ggcagccattcttca

SEQ ID NO: 9310 - DNA, 15 bp, Homo sapiens
aggcagccattcttc

SEQ ID NO: 9311 - DNA, 15 bp, Homo sapiens
taggcagccattctt

SEQ ID NO: 9312 - DNA, 15 bp, Homo sapiens
ctaggcagccattct

SEQ ID NO: 9313 - DNA, 15 bp, Homo sapiens
tctaggcagccattc

SEQ ID NO: 9314 - DNA, 15 bp, Homo sapiens
gtctaggcagccatt

SEQ ID NO: 9315 - DNA, 15 bp, Homo sapiens
agtctaggcagccat

SEQ ID NO: 9316 - DNA, 15 bp, Homo sapiens
aagtctaggcagcca

SEQ ID NO: 9317 - DNA, 15 bp, Homo sapiens
caagtctaggcagcc

SEQ ID NO: 9318 - DNA, 15 bp, Homo sapiens
ccaagtctaggcagc

SEQ ID NO: 9319 - DNA, 15 bp, Homo sapiens
tccaagtctaggcag

SEQ ID NO: 9320 - DNA, 15 bp, Homo sapiens
ttccaagtctaggca

SEQ ID NO: 9321 - DNA, 15 bp, Homo sapiens
attccaagtctaggc

SEQ ID NO: 9322 - DNA, 15 bp, Homo sapiens
aattccaagtctagg

SEQ ID NO: 9323 - DNA, 15 bp, Homo sapiens
aaattccaagtctag

SEQ ID NO: 9324 - DNA, 15 bp, Homo sapiens
gaaattccaagtcta

SEQ ID NO: 9325 - DNA, 15 bp, Homo sapiens
agaaattccaagtct

SEQ ID NO: 9326 - DNA, 15 bp, Homo sapiens
cagaaattccaagtc

SEQ ID NO: 9327 - DNA, 15 bp, Homo sapiens
ccagaaattccaagt

SEQ ID NO: 9328 - DNA, 15 bp, Homo sapiens
accagaaattccaag

SEQ ID NO: 9329 - DNA, 15 bp, Homo sapiens
caccagaaattccaa

SEQ ID NO: 9330 - DNA, 15 bp, Homo sapiens
ccaccagaaattcca

SEQ ID NO: 9331 - DNA, 15 bp, Homo sapiens
tccaccagaaattcc

SEQ ID NO: 9332 - DNA, 15 bp, Homo sapiens
atccaccagaaattc

SEQ ID NO: 9333 - DNA, 15 bp, Homo sapiens
tatccaccagaaatt

SEQ ID NO: 9334 - DNA, 15 bp, Homo sapiens
gtatccaccagaaat

SEQ ID NO: 9335 - DNA, 15 bp, Homo sapiens
ggtatccaccagaaa

SEQ ID NO: 9336 - DNA, 15 bp, Homo sapiens
tggtatccaccagaa

SEQ ID NO: 9337 - DNA, 15 bp, Homo sapiens
gtggtatccaccaga

SEQ ID NO: 9338 - DNA, 15 bp, Homo sapiens
ggtggtatccaccag

SEQ ID NO: 9339 - DNA, 15 bp, Homo sapiens
tggtggtatccacca

SEQ ID NO: 9340 - DNA, 15 bp, Homo sapiens
gtggtggtatccacc

SEQ ID NO: 9341 - DNA, 15 bp, Homo sapiens
tgtggtggtatccac

SEQ ID NO: 9342 - DNA, 15 bp, Homo sapiens
atgtggtggtatcca

SEQ ID NO: 9343 - DNA, 15 bp, Homo sapiens
gatgtggtggtatcc

SEQ ID NO: 9344 - DNA, 15 bp, Homo sapiens
tgatgtggtggtatc

SEQ ID NO: 9345 - DNA, 15 bp, Homo sapiens
gtgatgtggtggtat

SEQ ID NO: 9346 - DNA, 15 bp, Homo sapiens
agtgatgtggtggta

SEQ ID NO: 9347 - DNA, 15 bp, Homo sapiens
cagtgatgtggtggt

SEQ ID NO: 9348 - DNA, 15 bp, Homo sapiens
acagtgatgtggtgg

SEQ ID NO: 9349 - DNA, 15 bp, Homo sapiens
gacagtgatgtggtg

SEQ ID NO: 9350 - DNA, 15 bp, Homo sapiens
ggacagtgatgtggt

SEQ ID NO: 9351 - DNA, 15 bp, Homo sapiens
tggacagtgatgtgg

SEQ ID NO: 9352 - DNA, 15 bp, Homo sapiens
ttggacagtgatgtg

SEQ ID NO: 9353 - DNA, 15 bp, Homo sapiens
tttggacagtgatgt

SEQ ID NO: 9354 - DNA, 15 bp, Homo sapiens
ttttggacagtgatg

SEQ ID NO: 9355 - DNA, 15 bp, Homo sapiens
attttggacagtgat

SEQ ID NO: 9356 - DNA, 15 bp, Homo sapiens
cattttggacagtga

SEQ ID NO: 9357 - DNA, 15 bp, Homo sapiens
ccattttggacagtg

SEQ ID NO: 9358 - DNA, 15 bp, Homo sapiens
gccattttggacagt

SEQ ID NO: 9359 - DNA, 15 bp, Homo sapiens
agccattttggacag

SEQ ID NO: 9360 - DNA, 15 bp, Homo sapiens
tagccattttggaca

SEQ ID NO: 9361 - DNA, 15 bp, Homo sapiens
atagccattttggac

SEQ ID NO: 9362 - DNA, 15 bp, Homo sapiens
gatagccattttgga

SEQ ID NO: 9363 - DNA, 15 bp, Homo sapiens
ggatagccattttgg

SEQ ID NO: 9364 - DNA, 15 bp, Homo sapiens
gggatagccattttg

SEQ ID NO: 9365 - DNA, 15 bp, Homo sapiens
tgggatagccatttt

SEQ ID NO: 9366 - DNA, 15 bp, Homo sapiens
ctgggatagccattt

SEQ ID NO: 9367 - DNA, 15 bp, Homo sapiens
actgggatagccatt

SEQ ID NO: 9368 - DNA, 15 bp, Homo sapiens
aactgggatagccat

SEQ ID NO: 9369 - DNA, 15 bp, Homo sapiens
gaactgggatagcca

SEQ ID NO: 9370 - DNA, 15 bp, Homo sapiens
ggaactgggatagcc

SEQ ID NO: 9371 - DNA, 15 bp, Homo sapiens
gggaactgggatagc

SEQ ID NO: 9372 - DNA, 15 bp, Homo sapiens
tgggaactgggatag

SEQ ID NO: 9373 - DNA, 15 bp, Homo sapiens
gtgggaactgggata

SEQ ID NO: 9374 - DNA, 15 bp, Homo sapiens
tgtgggaactgggat

SEQ ID NO: 9375 - DNA, 15 bp, Homo sapiens
ttgtgggaactggga

SEQ ID NO: 9376 - DNA, 15 bp, Homo sapiens
gttgtgggaactggg

SEQ ID NO: 9377 - DNA, 15 bp, Homo sapiens
tgttgtgggaactgg

SEQ ID NO: 9378 - DNA, 15 bp, Homo sapiens
ctgttgtgggaactg

SEQ ID NO: 9379 - DNA, 15 bp, Homo sapiens
actgttgtgggaact

SEQ ID NO: 9380 - DNA, 15 bp, Homo sapiens
gactgttgtgggaac

SEQ ID NO: 9381 - DNA, 15 bp, Homo sapiens
agactgttgtgggaa

SEQ ID NO: 9382 - DNA, 15 bp, Homo sapiens
cagactgttgtggga

SEQ ID NO: 9383 - DNA, 15 bp, Homo sapiens
tcagactgttgtggg

SEQ ID NO: 9384 - DNA, 15 bp, Homo sapiens
ctcagactgttgtgg

SEQ ID NO: 9385 - DNA, 15 bp, Homo sapiens
tctcagactgttgtg

SEQ ID NO: 9386 - DNA, 15 bp, Homo sapiens
ttctcagactgttgt

SEQ ID NO: 9387 - DNA, 15 bp, Homo sapiens
tttctcagactgttg

SEQ ID NO: 9388 - DNA, 15 bp, Homo sapiens
ctttctcagactgtt

SEQ ID NO: 9389 - DNA, 15 bp, Homo sapiens
actttctcagactgt

SEQ ID NO: 9390 - DNA, 15 bp, Homo sapiens
cactttctcagactg

SEQ ID NO: 9391 - DNA, 15 bp, Homo sapiens
gcactttctcagact

SEQ ID NO: 9392 - DNA, 15 bp, Homo sapiens
ggcactttctcagac

SEQ ID NO: 9393 - DNA, 15 bp, Homo sapiens
tggcactttctcaga

SEQ ID NO: 9394 - DNA, 15 bp, Homo sapiens
atggcactttctcag

SEQ ID NO: 9395 - DNA, 15 bp, Homo sapiens
aatggcactttctca

SEQ ID NO: 9396 - DNA, 15 bp, Homo sapiens
aaatggcactttctc

SEQ ID NO: 9397 - DNA, 15 bp, Homo sapiens
aaaatggcactttct

SEQ ID NO: 9398 - DNA, 15 bp, Homo sapiens
gaaaatggcactttc

SEQ ID NO: 9399 - DNA, 15 bp, Homo sapiens
ggaaaatggcacttt

SEQ ID NO: 9400 - DNA, 15 bp, Homo sapiens
gggaaaatggcactt

SEQ ID NO: 9401 - DNA, 15 bp, Homo sapiens
tgggaaaatggcact

SEQ ID NO: 9402 - DNA, 15 bp, Homo sapiens
atgggaaaatggcac

SEQ ID NO: 9403 - DNA, 15 bp, Homo sapiens
tatgggaaaatggca

SEQ ID NO: 9404 - DNA, 15 bp, Homo sapiens
atatgggaaaatggc

SEQ ID NO: 9405 - DNA, 15 bp, Homo sapiens
gatatgggaaaatgg

SEQ ID NO: 9406 - DNA, 15 bp, Homo sapiens
cgatatgggaaaatg

SEQ ID NO: 9407 - DNA, 15 bp, Homo sapiens
acgatatgggaaaat

SEQ ID NO: 9408 - DNA, 15 bp, Homo sapiens
gacgatatgggaaaa

SEQ ID NO: 9409 - DNA, 15 bp, Homo sapiens
ggacgatatgggaaa

SEQ ID NO: 9410 - DNA, 15 bp, Homo sapiens
gggacgatatgggaa

SEQ ID NO: 9411 - DNA, 15 bp, Homo sapiens
tgggacgatatggga

SEQ ID NO: 9412 - DNA, 15 bp, Homo sapiens
ctgggacgatatggg

SEQ ID NO: 9413 - DNA, 15 bp, Homo sapiens
tctgggacgatatgg

SEQ ID NO: 9414 - DNA, 15 bp, Homo sapiens
ttctgggacgatatg

SEQ ID NO: 9415 - DNA, 15 bp, Homo sapiens
attctgggacgatat

SEQ ID NO: 9416 - DNA, 15 bp, Homo sapiens
aattctgggacgata

SEQ ID NO: 9417 - DNA, 15 bp, Homo sapiens
caattctgggacgat

SEQ ID NO: 9418 - DNA, 15 bp, Homo sapiens
ccaattctgggacga

SEQ ID NO: 9419 - DNA, 15 bp, Homo sapiens
tccaattctgggacg

SEQ ID NO: 9420 - DNA, 15 bp, Homo sapiens
atccaattctgggac

SEQ ID NO: 9421 - DNA, 15 bp, Homo sapiens
tatccaattctggga

SEQ ID NO: 9422 - DNA, 15 bp, Homo sapiens
atatccaattctggg

SEQ ID NO: 9423 - DNA, 15 bp, Homo sapiens
tatatccaattctgg

SEQ ID NO: 9424 - DNA, 15 bp, Homo sapiens
gtatatccaattctg

SEQ ID NO: 9425 - DNA, 15 bp, Homo sapiens
tgtatatccaattct

SEQ ID NO: 9426 - DNA, 15 bp, Homo sapiens
atgtatatccaattc

SEQ ID NO: 9427 - DNA, 15 bp, Homo sapiens
gatgtatatccaatt

SEQ ID NO: 9428 - DNA, 15 bp, Homo sapiens
agatgtatatccaat

SEQ ID NO: 9429 - DNA, 15 bp, Homo sapiens
aagatgtatatccaa

SEQ ID NO: 9430 - DNA, 15 bp, Homo sapiens
aaagatgtatatcca

SEQ ID NO: 9431 - DNA, 15 bp, Homo sapiens
aaaagatgtatatcc

SEQ ID NO: 9432 - DNA, 15 bp, Homo sapiens
taaaagatgtatatc

SEQ ID NO: 9433 - DNA, 15 bp, Homo sapiens
ttaaaagatgtatat

SEQ ID NO: 9434 - DNA, 15 bp, Homo sapiens
tttaaaagatgtata

SEQ ID NO: 9435 - DNA, 15 bp, Homo sapiens
atttaaaagatgtat

SEQ ID NO: 9436 - DNA, 15 bp, Homo sapiens
aatttaaaagatgta

SEQ ID NO: 9437 - DNA, 15 bp, Homo sapiens
caatttaaaagatgt

SEQ ID NO: 9438 - DNA, 15 bp, Homo sapiens
ccaatttaaaagatg

SEQ ID NO: 9439 - DNA, 15 bp, Homo sapiens
accaatttaaaagat

SEQ ID NO: 9440 - DNA, 15 bp, Homo sapiens
caccaatttaaaaga

SEQ ID NO: 9441 - DNA, 15 bp, Homo sapiens
gcaccaatttaaaag

SEQ ID NO: 9442 - DNA, 15 bp, Homo sapiens
ggcaccaatttaaaa

SEQ ID NO: 9443 - DNA, 15 bp, Homo sapiens
cggcaccaatttaaa

SEQ ID NO: 9444 - DNA, 15 bp, Homo sapiens
gcggcaccaatttaa

SEQ ID NO: 9445 - DNA, 15 bp, Homo sapiens
agcggcaccaattta

SEQ ID NO: 9446 - DNA, 15 bp, Homo sapiens
aagcggcaccaattt

SEQ ID NO: 9447 - DNA, 15 bp, Homo sapiens
caagcggcaccaatt

SEQ ID NO: 9448 - DNA, 15 bp, Homo sapiens
ccaagcggcaccaat

SEQ ID NO: 9449 - DNA, 15 bp, Homo sapiens
tccaagcggcaccaa

SEQ ID NO: 9450 - DNA, 15 bp, Homo sapiens
atccaagcggcacca

SEQ ID NO: 9451 - DNA, 15 bp, Homo sapiens
aatccaagcggcacc

SEQ ID NO: 9452 - DNA, 15 bp, Homo sapiens
taatccaagcggcac

SEQ ID NO: 9453 - DNA, 15 bp, Homo sapiens
ataatccaagcggca

SEQ ID NO: 9454 - DNA, 15 bp, Homo sapiens
aataatccaagcggc

SEQ ID NO: 9455 - DNA, 15 bp, Homo sapiens
taataatccaagcgg

SEQ ID NO: 9456 - DNA, 15 bp, Homo sapiens
gtaataatccaagcg

SEQ ID NO: 9457 - DNA, 15 bp, Homo sapiens
agtaataatccaagc

SEQ ID NO: 9458 - DNA, 15 bp, Homo sapiens
cagtaataatccaag

SEQ ID NO: 9459 - DNA, 15 bp, Homo sapiens
tcagtaataatccaa

SEQ ID NO: 9460 - DNA, 15 bp, Homo sapiens
ctcagtaataatcca

SEQ ID NO: 9461 - DNA, 15 bp, Homo sapiens
cctcagtaataatcc

SEQ ID NO: 9462 - DNA, 15 bp, Homo sapiens
gcctcagtaataatc

SEQ ID NO: 9463 - DNA, 15 bp, Homo sapiens
agcctcagtaataat

SEQ ID NO: 9464 - DNA, 15 bp, Homo sapiens
tagcctcagtaataa

SEQ ID NO: 9465 - DNA, 15 bp, Homo sapiens
ttagcctcagtaata

SEQ ID NO: 9466 - DNA, 15 bp, Homo sapiens
tttagcctcagtaat

SEQ ID NO: 9467 - DNA, 15 bp, Homo sapiens
gtttagcctcagtaa

SEQ ID NO: 9468 - DNA, 15 bp, Homo sapiens
ggtttagcctcagta

SEQ ID NO: 9469 - DNA, 15 bp, Homo sapiens
aggtttagcctcagt

SEQ ID NO: 9470 - DNA, 15 bp, Homo sapiens
gaggtttagcctcag

SEQ ID NO: 9471 - DNA, 15 bp, Homo sapiens
tgaggtttagcctca

SEQ ID NO: 9472 - DNA, 15 bp, Homo sapiens
ttgaggtttagcctc

SEQ ID NO: 9473 - DNA, 15 bp, Homo sapiens
attgaggtttagcct

SEQ ID NO: 9474 - DNA, 15 bp, Homo sapiens
tattgaggtttagcc

SEQ ID NO: 9475 - DNA, 15 bp, Homo sapiens
ttattgaggtttagc

SEQ ID NO: 9476 - DNA, 15 bp, Homo sapiens
attattgaggtttag

SEQ ID NO: 9477 - DNA, 15 bp, Homo sapiens
gattattgaggttta

SEQ ID NO: 9478 - DNA, 15 bp, Homo sapiens
tgattattgaggttt

SEQ ID NO: 9479 - DNA, 15 bp, Homo sapiens
atgattattgaggtt

SEQ ID NO: 9480 - DNA, 15 bp, Homo sapiens
aatgattattgaggt

SEQ ID NO: 9481 - DNA, 15 bp, Homo sapiens
caatgattattgagg

SEQ ID NO: 9482 - DNA, 15 bp, Homo sapiens
acaatgattattgag

SEQ ID NO: 9483 - DNA, 15 bp, Homo sapiens
gacaatgattattga

SEQ ID NO: 9484 - DNA, 15 bp, Homo sapiens
tgacaatgattattg

SEQ ID NO: 9485 - DNA, 15 bp, Homo sapiens
atgacaatgattatt

SEQ ID NO: 9486 - DNA, 15 bp, Homo sapiens
tatgacaatgattat

SEQ ID NO: 9487 - DNA, 15 bp, Homo sapiens
ctatgacaatgatta

SEQ ID NO: 9488 - DNA, 15 bp, Homo sapiens
gctatgacaatgatt

SEQ ID NO: 9489 - DNA, 15 bp, Homo sapiens
agctatgacaatgat

SEQ ID NO: 9490 - DNA, 15 bp, Homo sapiens
gagctatgacaatga

SEQ ID NO: 9491 - DNA, 15 bp, Homo sapiens
agagctatgacaatg

SEQ ID NO: 9492 - DNA, 15 bp, Homo sapiens
aagagctatgacaat

SEQ ID NO: 9493 - DNA, 15 bp, Homo sapiens
taagagctatgacaa

SEQ ID NO: 9494 - DNA, 15 bp, Homo sapiens
ttaagagctatgaca

SEQ ID NO: 9495 - DNA, 15 bp, Homo sapiens
attaagagctatgac

SEQ ID NO: 9496 - DNA, 15 bp, Homo sapiens
cattaagagctatga

SEQ ID NO: 9497 - DNA, 15 bp, Homo sapiens
acattaagagctatg

SEQ ID NO: 9498 - DNA, 15 bp, Homo sapiens
tacattaagagctat

SEQ ID NO: 9499 - DNA, 15 bp, Homo sapiens
atacattaagagcta

SEQ ID NO: 9500 - DNA, 15 bp, Homo sapiens
aatacattaagagct

SEQ ID NO: 9501 - DNA, 15 bp, Homo sapiens
taatacattaagagc

SEQ ID NO: 9502 - DNA, 15 bp, Homo sapiens
ttaatacattaagag

SEQ ID NO: 9503 - DNA, 15 bp, Homo sapiens
tttaatacattaaga

SEQ ID NO: 9504 - DNA, 15 bp, Homo sapiens
ctttaatacattaag

SEQ ID NO: 9505 - DNA, 15 bp, Homo sapiens
tctttaatacattaa

SEQ ID NO: 9506 - DNA, 15 bp, Homo sapiens
atctttaatacatta

SEQ ID NO: 9507 - DNA, 15 bp, Homo sapiens
catctttaatacatt

SEQ ID NO: 9508 - DNA, 15 bp, Homo sapiens
acatctttaatacat

SEQ ID NO: 9509 - DNA, 15 bp, Homo sapiens
aacatctttaataca

SEQ ID NO: 9510 - DNA, 15 bp, Homo sapiens
taacatctttaatac

SEQ ID NO: 9511 - DNA, 15 bp, Homo sapiens
ttaacatctttaata

SEQ ID NO: 9512 - DNA, 15 bp, Homo sapiens
gttaacatctttaat

SEQ ID NO: 9513 - DNA, 15 bp, Homo sapiens
agttaacatctttaa

SEQ ID NO: 9514 - DNA, 15 bp, Homo sapiens
gagttaacatcttta

SEQ ID NO: 9515 - DNA, 15 bp, Homo sapiens
agagttaacatcttt

SEQ ID NO: 9516 - DNA, 15 bp, Homo sapiens
aagagttaacatctt

SEQ ID NO: 9517 - DNA, 15 bp, Homo sapiens
aaagagttaacatct

SEQ ID NO: 9518 - DNA, 15 bp, Homo sapiens
caaagagttaacatc

SEQ ID NO: 9519 - DNA, 15 bp, Homo sapiens
acaaagagttaacat

SEQ ID NO: 9520 - DNA, 15 bp, Homo sapiens
gacaaagagttaaca

SEQ ID NO: 9521 - DNA, 15 bp, Homo sapiens
tgacaaagagttaac

SEQ ID NO: 9522 - DNA, 15 bp, Homo sapiens
atgacaaagagttaa

SEQ ID NO: 9523 - DNA, 15 bp, Homo sapiens
catgacaaagagtta

SEQ ID NO: 9524 - DNA, 15 bp, Homo sapiens
gcatgacaaagagtt

SEQ ID NO: 9525 - DNA, 15 bp, Homo sapiens
tgcatgacaaagagt

SEQ ID NO: 9526 - DNA, 15 bp, Homo sapiens
ctgcatgacaaagag

SEQ ID NO: 9527 - DNA, 15 bp, Homo sapiens
tctgcatgacaaaga

SEQ ID NO: 9528 - DNA, 15 bp, Homo sapiens
atctgcatgacaaag

SEQ ID NO: 9529 - DNA, 15 bp, Homo sapiens
tatctgcatgacaaa

SEQ ID NO: 9530 - DNA, 15 bp, Homo sapiens
atatctgcatgacaa

SEQ ID NO: 9531 - DNA, 15 bp, Homo sapiens
aatatctgcatgaca

SEQ ID NO: 9532 - DNA, 15 bp, Homo sapiens
aaatatctgcatgac

SEQ ID NO: 9533 - DNA, 15 bp, Homo sapiens
aaaatatctgcatga

SEQ ID NO: 9534 - DNA, 15 bp, Homo sapiens
gaaaatatctgcatg

SEQ ID NO: 9535 - DNA, 15 bp, Homo sapiens
ggaaaatatctgcat

SEQ ID NO: 9536 - DNA, 15 bp, Homo sapiens
aggaaaatatctgca

SEQ ID NO: 9537 - DNA, 15 bp, Homo sapiens
caggaaaatatctgc

SEQ ID NO: 9538 - DNA, 15 bp, Homo sapiens
acaggaaaatatctg

SEQ ID NO: 9539 - DNA, 15 bp, Homo sapiens
aacaggaaaatatct

SEQ ID NO: 9540 - DNA, 15 bp, Homo sapiens
aaacaggaaaatatc

SEQ ID NO: 9541 - DNA, 15 bp, Homo sapiens
aaaacaggaaaatat

SEQ ID NO: 9542 - DNA, 15 bp, Homo sapiens
caaaacaggaaaata

SEQ ID NO: 9543 - DNA, 15 bp, Homo sapiens
acaaaacaggaaaat

SEQ ID NO: 9544 - DNA, 15 bp, Homo sapiens
gacaaaacaggaaaa

SEQ ID NO: 9545 - DNA, 15 bp, Homo sapiens
agacaaaacaggaaa

SEQ ID NO: 9546 - DNA, 15 bp, Homo sapiens
aagacaaaacaggaa

SEQ ID NO: 9547 - DNA, 15 bp, Homo sapiens
taagacaaaacagga

SEQ ID NO: 9548 - DNA, 15 bp, Homo sapiens
gtaagacaaaacagg

SEQ ID NO: 9549 - DNA, 15 bp, Homo sapiens
cgtaagacaaaacag

SEQ ID NO: 9550 - DNA, 15 bp, Homo sapiens
acgtaagacaaaaca

SEQ ID NO: 9551 - DNA, 15 bp, Homo sapiens
gacgtaagacaaaac

SEQ ID NO: 9552 - DNA, 15 bp, Homo sapiens
agacgtaagacaaaa

SEQ ID NO: 9553 - DNA, 15 bp, Homo sapiens
aagacgtaagacaaa

SEQ ID NO: 9554 - DNA, 15 bp, Homo sapiens
caagacgtaagacaa

SEQ ID NO: 9555 - DNA, 15 bp, Homo sapiens
tcaagacgtaagaca

SEQ ID NO: 9556 - DNA, 15 bp, Homo sapiens
atcaagacgtaagac

SEQ ID NO: 9557 - DNA, 15 bp, Homo sapiens
aatcaagacgtaaga

SEQ ID NO: 9558 - DNA, 15 bp, Homo sapiens
gaatcaagacgtaag

SEQ ID NO: 9559 - DNA, 15 bp, Homo sapiens
agaatcaagacgtaa

SEQ ID NO: 9560 - DNA, 15 bp, Homo sapiens
aagaatcaagacgta

SEQ ID NO: 9561 - DNA, 15 bp, Homo sapiens
caagaatcaagacgt

SEQ ID NO: 9562 - DNA, 15 bp, Homo sapiens
acaagaatcaagacg

SEQ ID NO: 9563 - DNA, 15 bp, Homo sapiens
gacaagaatcaagac

SEQ ID NO: 9564 - DNA, 15 bp, Homo sapiens
agacaagaatcaaga

SEQ ID NO: 9565 - DNA, 15 bp, Homo sapiens
aagacaagaatcaag

SEQ ID NO: 9566 - DNA, 15 bp, Homo sapiens
aaagacaagaatcaa

SEQ ID NO: 9567 - DNA, 15 bp, Homo sapiens
gaaagacaagaatca

SEQ ID NO: 9568 - DNA, 15 bp, Homo sapiens
agaaagacaagaatc

SEQ ID NO: 9569 - DNA, 15 bp, Homo sapiens
cagaaagacaagaat

SEQ ID NO: 9570 - DNA, 15 bp, Homo sapiens
tcagaaagacaagaa

SEQ ID NO: 9571 - DNA, 15 bp, Homo sapiens
atcagaaagacaaga

SEQ ID NO: 9572 - DNA, 15 bp, Homo sapiens
tatcagaaagacaag

SEQ ID NO: 9573 - DNA, 15 bp, Homo sapiens
atatcagaaagacaa

SEQ ID NO: 9574 - DNA, 15 bp, Homo sapiens
tatatcagaaagaca

SEQ ID NO: 9575 - DNA, 15 bp, Homo sapiens
atatatcagaaagac

SEQ ID NO: 9576 - DNA, 15 bp, Homo sapiens
tatatatcagaaaga

SEQ ID NO: 9577 - DNA, 15 bp, Homo sapiens
ttatatatcagaaag

SEQ ID NO: 9578 - DNA, 15 bp, Homo sapiens
tttatatatcagaaa

SEQ ID NO: 9579 - DNA, 15 bp, Homo sapiens
ttttatatatcagaa

SEQ ID NO: 9580 - DNA, 15 bp, Homo sapiens
attttatatatcaga

SEQ ID NO: 9581 - DNA, 15 bp, Homo sapiens
aattttatatatcag

SEQ ID NO: 9582 - DNA, 15 bp, Homo sapiens
aaattttatatatca

SEQ ID NO: 9583 - DNA, 15 bp, Homo sapiens
taaattttatatatc

SEQ ID NO: 9584 - DNA, 15 bp, Homo sapiens
ataaattttatatat

SEQ ID NO: 9585 - DNA, 15 bp, Homo sapiens
cataaattttatata

SEQ ID NO: 9586 - DNA, 15 bp, Homo sapiens
acataaattttatat

SEQ ID NO: 9587 - DNA, 15 bp, Homo sapiens
aacataaattttata

SEQ ID NO: 9588 - DNA, 15 bp, Homo sapiens
taacataaattttat

SEQ ID NO: 9589 - DNA, 15 bp, Homo sapiens
ataacataaatttta

SEQ ID NO: 9590 - DNA, 15 bp, Homo sapiens
cataacataaatttt

SEQ ID NO: 9591 - DNA, 15 bp, Homo sapiens
tcataacataaattt

SEQ ID NO: 9592 - DNA, 15 bp, Homo sapiens
atcataacataaatt

SEQ ID NO: 9593 - DNA, 15 bp, Homo sapiens
aatcataacataaat

SEQ ID NO: 9594 - DNA, 15 bp, Homo sapiens
aaatcataacataaa

SEQ ID NO: 9595 - DNA, 15 bp, Homo sapiens
taaatcataacataa

SEQ ID NO: 9596 - DNA, 15 bp, Homo sapiens
ataaatcataacata

SEQ ID NO: 9597 - DNA, 15 bp, Homo sapiens
aataaatcataacat

SEQ ID NO: 9598 - DNA, 15 bp, Homo sapiens
gaataaatcataaca

SEQ ID NO: 9599 - DNA, 15 bp, Homo sapiens
agaataaatcataac

SEQ ID NO: 9600 - DNA, 15 bp, Homo sapiens
aagaataaatcataa

SEQ ID NO: 9601 - DNA, 15 bp, Homo sapiens
aaagaataaatcata

SEQ ID NO: 9602 - DNA, 15 bp, Homo sapiens
aaaagaataaatcat

SEQ ID NO: 9603 - DNA, 15 bp, Homo sapiens
caaaagaataaatca

SEQ ID NO: 9604 - DNA, 15 bp, Homo sapiens
gcaaaagaataaatc

SEQ ID NO: 9605 - DNA, 15 bp, Homo sapiens
agcaaaagaataaat

SEQ ID NO: 9606 - DNA, 15 bp, Homo sapiens
aagcaaaagaataaa

SEQ ID NO: 9607 - DNA, 15 bp, Homo sapiens
aaagcaaaagaataa

SEQ ID NO: 9608 - DNA, 15 bp, Homo sapiens
gaaagcaaaagaata

SEQ ID NO: 9609 - DNA, 15 bp, Homo sapiens
tgaaagcaaaagaat

SEQ ID NO: 9610 - DNA, 15 bp, Homo sapiens
atgaaagcaaaagaa

SEQ ID NO: 9611 - DNA, 15 bp, Homo sapiens
tatgaaagcaaaaga

SEQ ID NO: 9612 - DNA, 15 bp, Homo sapiens
gtatgaaagcaaaag

SEQ ID NO: 9613 - DNA, 15 bp, Homo sapiens
agtatgaaagcaaaa

SEQ ID NO: 9614 - DNA, 15 bp, Homo sapiens
tcctgggttcaaacg

SEQ ID NO: 9615 - DNA, 15 bp, Homo sapiens
ctcctgggttcaaac

SEQ ID NO: 9616 - DNA, 15 bp, Homo sapiens
cctcctgggttcaaa

SEQ ID NO: 9617 - DNA, 15 bp, Homo sapiens
ctctgcctcctgggt

SEQ ID NO: 9618 - DNA, 15 bp, Homo sapiens
cctctgcctcctggg

SEQ ID NO: 9619 - DNA, 15 bp, Homo sapiens
acctctgcctcctgg

SEQ ID NO: 9620 - DNA, 15 bp, Homo sapiens
aacctctgcctcctg

SEQ ID NO: 9621 - DNA, 15 bp, Homo sapiens
caacctctgcctcct

SEQ ID NO: 9622 - DNA, 15 bp, Homo sapiens
cgatcttggctcact

SEQ ID NO: 9623 - DNA, 15 bp, Homo sapiens
acgatcttggctcac

SEQ ID NO: 9624 - DNA, 15 bp, Homo sapiens
cacgatcttggctca

SEQ ID NO: 9625 - DNA, 15 bp, Homo sapiens
gcacgatcttggctc

SEQ ID NO: 9626 - DNA, 15 bp, Homo sapiens
ggcacgatcttggct

SEQ ID NO: 9627 - DNA, 15 bp, Homo sapiens
tggcacgatcttggc

SEQ ID NO: 9628 - DNA, 15 bp, Homo sapiens
atggcacgatcttgg

SEQ ID NO: 9629 - DNA, 15 bp, Homo sapiens
aatggcacgatcttg

SEQ ID NO: 9630 - DNA, 15 bp, Homo sapiens
caatggcacgatctt

SEQ ID NO: 9631 - DNA, 15 bp, Homo sapiens
gcaatggcacgatct

SEQ ID NO: 9632 - DNA, 15 bp, Homo sapiens
tgcaatggcacgatc

SEQ ID NO: 9633 - DNA, 15 bp, Homo sapiens
gtgcaatggcacgat

SEQ ID NO: 9634 - DNA, 15 bp, Homo sapiens
agtgcaatggcacga

SEQ ID NO: 9635 - DNA, 15 bp, Homo sapiens
gagtgcaatggcacg

SEQ ID NO: 9636 - DNA, 15 bp, Homo sapiens
ggagtgcaatggcac

SEQ ID NO: 9637 - DNA, 15 bp, Homo sapiens
tggagtgcaatggca

SEQ ID NO: 9638 - DNA, 15 bp, Homo sapiens
ctggagtgcaatggc

SEQ ID NO: 9639 - DNA, 15 bp, Homo sapiens
gctggagtgcaatgg

SEQ ID NO: 9640 - DNA, 15 bp, Homo sapiens
ggctggagtgcaatg

SEQ ID NO: 9641 - DNA, 15 bp, Homo sapiens
aggctggagtgcaat

SEQ ID NO: 9642 - DNA, 15 bp, Homo sapiens
caggctggagtgcaa

SEQ ID NO: 9643 - DNA, 15 bp, Homo sapiens
cgcccaggctggagt

SEQ ID NO: 9644 - DNA, 15 bp, Homo sapiens
tcgcccaggctggag

SEQ ID NO: 9645 - DNA, 15 bp, Homo sapiens
gtcgcccaggctgga

SEQ ID NO: 9646 - DNA, 15 bp, Homo sapiens
tgtcgcccaggctgg

SEQ ID NO: 9647 - DNA, 15 bp, Homo sapiens
ctgtcgcccaggctg

SEQ ID NO: 9648 - DNA, 15 bp, Homo sapiens
tctgtcgcccaggct

SEQ ID NO: 9649 - DNA, 15 bp, Homo sapiens
ctctgtcgcccaggc

SEQ ID NO: 9650 - DNA, 15 bp, Homo sapiens
actctgtcgcccagg

SEQ ID NO: 9651 - DNA, 15 bp, Homo sapiens
ggagtctcactctgt

SEQ ID NO: 9652 - DNA, 15 bp, Homo sapiens
tggagtctcactctg

SEQ ID NO: 9653 - DNA, 15 bp, Homo sapiens
atggagtctcactct

SEQ ID NO: 9654 - DNA, 15 bp, Homo sapiens
gatggagtctcactc

SEQ ID NO: 9655 - DNA, 15 bp, Homo sapiens
agatggagtctcact

SEQ ID NO: 9656 - DNA, 15 bp, Homo sapiens
gagatggagtctcac

SEQ ID NO: 9657 - DNA, 15 bp, Homo sapiens
tgagatggagtctca

SEQ ID NO: 9658 - DNA, 15 bp, Homo sapiens
ctgagatggagtctc

SEQ ID NO: 9659 - DNA, 15 bp, Homo sapiens
tctgagatggagtct

SEQ ID NO: 9660 - DNA, 15 bp, Homo sapiens
ttctgagatggagtc

SEQ ID NO: 9661 - DNA, 15 bp, Homo sapiens
tttctgagatggagt

SEQ ID NO: 9662 - DNA, 15 bp, Homo sapiens
ttttctgagatggag

SEQ ID NO: 9663 - DNA, 15 bp, Homo sapiens
tttttctgagatgga

SEQ ID NO: 9664 - DNA, 15 bp, Homo sapiens
atttttctgagatgg

SEQ ID NO: 9665 - DNA, 15 bp, Homo sapiens
tatttttctgagatg

SEQ ID NO: 9666 - DNA, 15 bp, Homo sapiens
ttatttttctgagat

SEQ ID NO: 9667 - DNA, 15 bp, Homo sapiens
attatttttctgaga

SEQ ID NO: 9668 - DNA, 15 bp, Homo sapiens
tattatttttctgag

SEQ ID NO: 9669 - DNA, 15 bp, Homo sapiens
ttattatttttctga

SEQ ID NO: 9670 - DNA, 15 bp, Homo sapiens
attattatttttctg

SEQ ID NO: 9671 - DNA, 15 bp, Homo sapiens
tattattatttttct

SEQ ID NO: 9672 - DNA, 15 bp, Homo sapiens
ctattattatttttc

SEQ ID NO: 9673 - DNA, 15 bp, Homo sapiens
tctattattattttt

SEQ ID NO: 9674 - DNA, 15 bp, Homo sapiens
ttctattattatttt

SEQ ID NO: 9675 - DNA, 15 bp, Homo sapiens
tttctattattattt

SEQ ID NO: 9676 - DNA, 15 bp, Homo sapiens
ttttctattattatt

SEQ ID NO: 9677 - DNA, 15 bp, Homo sapiens
tttttctattattat

SEQ ID NO: 9678 - DNA, 15 bp, Homo sapiens
ttttttctattatta

SEQ ID NO: 9679 - DNA, 15 bp, Homo sapiens
cttttttctattatt

SEQ ID NO: 9680 - DNA, 15 bp, Homo sapiens
acttttttctattat

SEQ ID NO: 9681 - DNA, 15 bp, Homo sapiens
aacttttttctatta

SEQ ID NO: 9682 - DNA, 15 bp, Homo sapiens
taacttttttctatt

SEQ ID NO: 9683 - DNA, 15 bp, Homo sapiens
ataacttttttctat

SEQ ID NO: 9684 - DNA, 15 bp, Homo sapiens
tataacttttttcta

SEQ ID NO: 9685 - DNA, 15 bp, Homo sapiens
atataacttttttct

SEQ ID NO: 9686 - DNA, 15 bp, Homo sapiens
catataacttttttc

SEQ ID NO: 9687 - DNA, 15 bp, Homo sapiens
ccatataactttttt

SEQ ID NO: 9688 - DNA, 15 bp, Homo sapiens
cccatataacttttt

SEQ ID NO: 9689 - DNA, 15 bp, Homo sapiens
ccccatataactttt

SEQ ID NO: 9690 - DNA, 15 bp, Homo sapiens
gccccatataacttt

SEQ ID NO: 9691 - DNA, 15 bp, Homo sapiens
agccccatataactt

SEQ ID NO: 9692 - DNA, 15 bp, Homo sapiens
cagccccatataact

SEQ ID NO: 9693 - DNA, 15 bp, Homo sapiens
ccagccccatataac

SEQ ID NO: 9694 - DNA, 15 bp, Homo sapiens
cccagccccatataa

SEQ ID NO: 9695 - DNA, 15 bp, Homo sapiens
gcccagccccatata

SEQ ID NO: 9696 - DNA, 15 bp, Homo sapiens
tgcccagccccatat

SEQ ID NO: 9697 - DNA, 15 bp, Homo sapiens
atgcccagccccata

SEQ ID NO: 9698 - DNA, 15 bp, Homo sapiens
catgcccagccccat

SEQ ID NO: 9699 - DNA, 15 bp, Homo sapiens
ccatgcccagcccca

SEQ ID NO: 9700 - DNA, 15 bp, Homo sapiens
accatgcccagcccc

SEQ ID NO: 9701 - DNA, 15 bp, Homo sapiens
caccatgcccagccc

SEQ ID NO: 9702 - DNA, 15 bp, Homo sapiens
ccaccatgcccagcc

SEQ ID NO: 9703 - DNA, 15 bp, Homo sapiens
gccaccatgcccagc

SEQ ID NO: 9704 - DNA, 15 bp, Homo sapiens
agccaccatgcccag

SEQ ID NO: 9705 - DNA, 15 bp, Homo sapiens
gagccaccatgccca

SEQ ID NO: 9706 - DNA, 15 bp, Homo sapiens
tgagccaccatgccc

SEQ ID NO: 9707 - DNA, 15 bp, Homo sapiens
ctgctgggattacag

SEQ ID NO: 9708 - DNA, 15 bp, Homo sapiens
actgctgggattaca

SEQ ID NO: 9709 - DNA, 15 bp, Homo sapiens
aactgctgggattac

SEQ ID NO: 9710 - DNA, 15 bp, Homo sapiens
aaactgctgggatta

SEQ ID NO: 9711 - DNA, 15 bp, Homo sapiens
caaactgctgggatt

SEQ ID NO: 9712 - DNA, 15 bp, Homo sapiens
ccaaactgctgggat

SEQ ID NO: 9713 - DNA, 15 bp, Homo sapiens
cccaaactgctggga

SEQ ID NO: 9714 - DNA, 15 bp, Homo sapiens
tcccaaactgctggg

SEQ ID NO: 9715 - DNA, 15 bp, Homo sapiens
ctcccaaactgctgg

SEQ ID NO: 9716 - DNA, 15 bp, Homo sapiens
cctcccaaactgctg

SEQ ID NO: 9717 - DNA, 15 bp, Homo sapiens
gcctcccaaactgct

SEQ ID NO: 9718 - DNA, 15 bp, Homo sapiens
agcctcccaaactgc

SEQ ID NO: 9719 - DNA, 15 bp, Homo sapiens
cagcctcccaaactg

SEQ ID NO: 9720 - DNA, 15 bp, Homo sapiens
tcagcctcccaaact

SEQ ID NO: 9721 - DNA, 15 bp, Homo sapiens
ctcagcctcccaaac

SEQ ID NO: 9722 - DNA, 15 bp, Homo sapiens
tgcctcagcctccca

SEQ ID NO: 9723 - DNA, 15 bp, Homo sapiens
gctgcctcagcctcc

SEQ ID NO: 9724 - DNA, 15 bp, Homo sapiens
agctgcctcagcctc

SEQ ID NO: 9725 - DNA, 15 bp, Homo sapiens
aagctgcctcagcct

SEQ ID NO: 9726 - DNA, 15 bp, Homo sapiens
caagctgcctcagcc

SEQ ID NO: 9727 - DNA, 15 bp, Homo sapiens
tcaagctgcctcagc

SEQ ID NO: 9728 - DNA, 15 bp, Homo sapiens
atcaagctgcctcag

SEQ ID NO: 9729 - DNA, 15 bp, Homo sapiens
gatcaagctgcctca

SEQ ID NO: 9730 - DNA, 15 bp, Homo sapiens
tgatcaagctgcctc

SEQ ID NO: 9731 - DNA, 15 bp, Homo sapiens
gtgatcaagctgcct

SEQ ID NO: 9732 - DNA, 15 bp, Homo sapiens
agtgatcaagctgcc

SEQ ID NO: 9733 - DNA, 15 bp, Homo sapiens
aagtgatcaagctgc

SEQ ID NO: 9734 - DNA, 15 bp, Homo sapiens
caagtgatcaagctg

SEQ ID NO: 9735 - DNA, 15 bp, Homo sapiens
tcaagtgatcaagct

SEQ ID NO: 9736 - DNA, 15 bp, Homo sapiens
ctcaagtgatcaagc

SEQ ID NO: 9737 - DNA, 15 bp, Homo sapiens
cctcaagtgatcaag

SEQ ID NO: 9738 - DNA, 15 bp, Homo sapiens
acctcaagtgatcaa

SEQ ID NO: 9739 - DNA, 15 bp, Homo sapiens
gacctcaagtgatca

SEQ ID NO: 9740 - DNA, 15 bp, Homo sapiens
tgacctcaagtgatc

SEQ ID NO: 9741 - DNA, 15 bp, Homo sapiens
ctgacctcaagtgat

SEQ ID NO: 9742 - DNA, 15 bp, Homo sapiens
cctgacctcaagtga

SEQ ID NO: 9743 - DNA, 15 bp, Homo sapiens
tcctgacctcaagtg

SEQ ID NO: 9744 - DNA, 15 bp, Homo sapiens
ttcctgacctcaagt

SEQ ID NO: 9745 - DNA, 15 bp, Homo sapiens
attcctgacctcaag

SEQ ID NO: 9746 - DNA, 15 bp, Homo sapiens
aattcctgacctcaa

SEQ ID NO: 9747 - DNA, 15 bp, Homo sapiens
gaattcctgacctca

SEQ ID NO: 9748 - DNA, 15 bp, Homo sapiens
cgaattcctgacctc

SEQ ID NO: 9749 - DNA, 15 bp, Homo sapiens
tcgaattcctgacct

SEQ ID NO: 9750 - DNA, 15 bp, Homo sapiens
ctcgaattcctgacc

SEQ ID NO: 9751 - DNA, 15 bp, Homo sapiens
tctcgaattcctgac

SEQ ID NO: 9752 - DNA, 15 bp, Homo sapiens
gtctcgaattcctga

SEQ ID NO: 9753 - DNA, 15 bp, Homo sapiens
agtctcgaattcctg

SEQ ID NO: 9754 - DNA, 15 bp, Homo sapiens
tagtctcgaattcct

SEQ ID NO: 9755 - DNA, 15 bp, Homo sapiens
ctagtctcgaattcc

SEQ ID NO: 9756 - DNA, 15 bp, Homo sapiens
gctagtctcgaattc

SEQ ID NO: 9757 - DNA, 15 bp, Homo sapiens
ggctagtctcgaatt

SEQ ID NO: 9758 - DNA, 15 bp, Homo sapiens
aggctagtctcgaat

SEQ ID NO: 9759 - DNA, 15 bp, Homo sapiens
gttggccaggctagt

SEQ ID NO: 9760 - DNA, 15 bp, Homo sapiens
tgttggccaggctag

SEQ ID NO: 9761 - DNA, 15 bp, Homo sapiens
atgttggccaggcta

SEQ ID NO: 9762 - DNA, 15 bp, Homo sapiens
catgttggccaggct

SEQ ID NO: 9763 - DNA, 15 bp, Homo sapiens
ccatgttggccaggc

SEQ ID NO: 9764 - DNA, 15 bp, Homo sapiens
accatgttggccagg

SEQ ID NO: 9765 - DNA, 15 bp, Homo sapiens
caccatgttggccag

SEQ ID NO: 9766 - DNA, 15 bp, Homo sapiens
tcaccatgttggcca

SEQ ID NO: 9767 - DNA, 15 bp, Homo sapiens
ttcaccatgttggcc

SEQ ID NO: 9768 - DNA, 15 bp, Homo sapiens
tttcaccatgttggc

SEQ ID NO: 9769 - DNA, 15 bp, Homo sapiens
gtttcaccatgttgg

SEQ ID NO: 9770 - DNA, 15 bp, Homo sapiens
ggagacggagtttca

SEQ ID NO: 9771 - DNA, 15 bp, Homo sapiens
tggagacggagtttc

SEQ ID NO: 9772 - DNA, 15 bp, Homo sapiens
gtggagacggagttt

SEQ ID NO: 9773 - DNA, 15 bp, Homo sapiens
agtggagacggagtt

SEQ ID NO: 9774 - DNA, 15 bp, Homo sapiens
tagtggagacggagt

SEQ ID NO: 9775 - DNA, 15 bp, Homo sapiens
ttagtggagacggag

SEQ ID NO: 9776 - DNA, 15 bp, Homo sapiens
tttagtggagacgga

SEQ ID NO: 9777 - DNA, 15 bp, Homo sapiens
ttttagtggagacgg

SEQ ID NO: 9778 - DNA, 15 bp, Homo sapiens
tttttagtggagacg

SEQ ID NO: 9779 - DNA, 15 bp, Homo sapiens
atttttagtggagac

SEQ ID NO: 9780 - DNA, 15 bp, Homo sapiens
tatttttagtggaga

SEQ ID NO: 9781 - DNA, 15 bp, Homo sapiens
gtatttttagtggag

SEQ ID NO: 9782 - DNA, 15 bp, Homo sapiens
tgtatttttagtgga

SEQ ID NO: 9783 - DNA, 15 bp, Homo sapiens
ttgtatttttagtgg

SEQ ID NO: 9784 - DNA, 15 bp, Homo sapiens
tttgtatttttagtg

SEQ ID NO: 9785 - DNA, 15 bp, Homo sapiens
ttggctaatttttgt

SEQ ID NO: 9786 - DNA, 15 bp, Homo sapiens
cttggctaatttttg

SEQ ID NO: 9787 - DNA, 15 bp, Homo sapiens
gcttggctaattttt

SEQ ID NO: 9788 - DNA, 15 bp, Homo sapiens
cgcttggctaatttt

SEQ ID NO: 9789 - DNA, 15 bp, Homo sapiens
acgcttggctaattt

SEQ ID NO: 9790 - DNA, 15 bp, Homo sapiens
cacgcttggctaatt

SEQ ID NO: 9791 - DNA, 15 bp, Homo sapiens
ccacgcttggctaat

SEQ ID NO: 9792 - DNA, 15 bp, Homo sapiens
accacgcttggctaa

SEQ ID NO: 9793 - DNA, 15 bp, Homo sapiens
caccacgcttggcta

SEQ ID NO: 9794 - DNA, 15 bp, Homo sapiens
ccaccacgcttggct

SEQ ID NO: 9795 - DNA, 15 bp, Homo sapiens
accaccacgcttggc

SEQ ID NO: 9796 - DNA, 15 bp, Homo sapiens
caccaccacgcttgg

SEQ ID NO: 9797 - DNA, 15 bp, Homo sapiens
gcaccaccacgcttg

SEQ ID NO: 9798 - DNA, 15 bp, Homo sapiens
cgcaccaccacgctt

SEQ ID NO: 9799 - DNA, 15 bp, Homo sapiens
acgcaccaccacgct

SEQ ID NO: 9800 - DNA, 15 bp, Homo sapiens
cacgcaccaccacgc

SEQ ID NO: 9801 - DNA, 15 bp, Homo sapiens
gcacgcaccaccacg

SEQ ID NO: 9802 - DNA, 15 bp, Homo sapiens
ggcacgcaccaccac

SEQ ID NO: 9803 - DNA, 15 bp, Homo sapiens
aggcacgcaccacca

SEQ ID NO: 9804 - DNA, 15 bp, Homo sapiens
caggcacgcaccacc

SEQ ID NO: 9805 - DNA, 15 bp, Homo sapiens
acaggcacgcaccac

SEQ ID NO: 9806 - DNA, 15 bp, Homo sapiens
tacaggcacgcacca

SEQ ID NO: 9807 - DNA, 15 bp, Homo sapiens
ctacaggcacgcacc

SEQ ID NO: 9808 - DNA, 15 bp, Homo sapiens
actacaggcacgcac

SEQ ID NO: 9809 - DNA, 15 bp, Homo sapiens
gactacaggcacgca

SEQ ID NO: 9810 - DNA, 15 bp, Homo sapiens
ggactacaggcacgc

SEQ ID NO: 9811 - DNA, 15 bp, Homo sapiens
gggactacaggcacg

SEQ ID NO: 9812 - DNA, 15 bp, Homo sapiens
tgggactacaggcac

SEQ ID NO: 9813 - DNA, 15 bp, Homo sapiens
aagtagctgggacta

SEQ ID NO: 9814 - DNA, 15 bp, Homo sapiens
caagtagctgggact

SEQ ID NO: 9815 - DNA, 15 bp, Homo sapiens
ccaagtagctgggac

SEQ ID NO: 9816 - DNA, 15 bp, Homo sapiens
cccaagtagctggga

SEQ ID NO: 9817 - DNA, 15 bp, Homo sapiens
tcccaagtagctggg

SEQ ID NO: 9818 - DNA, 15 bp, Homo sapiens
ttcccaagtagctgg

SEQ ID NO: 9819 - DNA, 15 bp, Homo sapiens
cttcccaagtagctg

SEQ ID NO: 9820 - DNA, 15 bp, Homo sapiens
gcttcccaagtagct

SEQ ID NO: 9821 - DNA, 15 bp, Homo sapiens
agcttcccaagtagc

SEQ ID NO: 9822 - DNA, 15 bp, Homo sapiens
cagcttcccaagtag

SEQ ID NO: 9823 - DNA, 15 bp, Homo sapiens
tcagcttcccaagta

SEQ ID NO: 9824 - DNA, 15 bp, Homo sapiens
ctcagcttcccaagt

SEQ ID NO: 9825 - DNA, 15 bp, Homo sapiens
cctcagcttcccaag

SEQ ID NO: 9826 - DNA, 15 bp, Homo sapiens
gcctcagcttcccaa

SEQ ID NO: 9827 - DNA, 15 bp, Homo sapiens
tgcctcagcttccca

SEQ ID NO: 9828 - DNA, 15 bp, Homo sapiens
ctgcctcagcttccc

SEQ ID NO: 9829 - DNA, 15 bp, Homo sapiens
cctgcctcagcttcc

SEQ ID NO: 9830 - DNA, 15 bp, Homo sapiens
tcctgcctcagcttc

SEQ ID NO: 9831 - DNA, 15 bp, Homo sapiens
ctcctgcctcagctt

SEQ ID NO: 9832 - DNA, 15 bp, Homo sapiens
tctcctgcctcagct

SEQ ID NO: 9833 - DNA, 15 bp, Homo sapiens
ggcgattctcctgcc

SEQ ID NO: 9834 - DNA, 15 bp, Homo sapiens
aggcgattctcctgc

SEQ ID NO: 9835 - DNA, 15 bp, Homo sapiens
caggcgattctcctg

SEQ ID NO: 9836 - DNA, 15 bp, Homo sapiens
tcaggcgattctcct

SEQ ID NO: 9837 - DNA, 15 bp, Homo sapiens
ttcaggcgattctcc

SEQ ID NO: 9838 - DNA, 15 bp, Homo sapiens
gttcaggcgattctc

SEQ ID NO: 9839 - DNA, 15 bp, Homo sapiens
aggttcaggcgattc

SEQ ID NO: 9840 - DNA, 15 bp, Homo sapiens
caggttcaggcgatt

SEQ ID NO: 9841 - DNA, 15 bp, Homo sapiens
ccaggttcaggcgat

SEQ ID NO: 9842 - DNA, 15 bp, Homo sapiens
cccaggttcaggcga

SEQ ID NO: 9843 - DNA, 15 bp, Homo sapiens
tcccaggttcaggcg

SEQ ID NO: 9844 - DNA, 15 bp, Homo sapiens
ctcccaggttcaggc

SEQ ID NO: 9845 - DNA, 15 bp, Homo sapiens
cctcccaggttcagg

SEQ ID NO: 9846 - DNA, 15 bp, Homo sapiens
gcctcccaggttcag

SEQ ID NO: 9847 - DNA, 15 bp, Homo sapiens
tgcctcccaggttca

SEQ ID NO: 9848 - DNA, 15 bp, Homo sapiens
ctgcctcccaggttc

SEQ ID NO: 9849 - DNA, 15 bp, Homo sapiens
tctgcctcccaggtt

SEQ ID NO: 9850 - DNA, 15 bp, Homo sapiens
ctctgcctcccaggt

SEQ ID NO: 9851 - DNA, 15 bp, Homo sapiens
cctctgcctcccagg

SEQ ID NO: 9852 - DNA, 15 bp, Homo sapiens
acctctgcctcccag

SEQ ID NO: 9853 - DNA, 15 bp, Homo sapiens
aacctctgcctccca

SEQ ID NO: 9854 - DNA, 15 bp, Homo sapiens
caacctctgcctccc

SEQ ID NO: 9855 - DNA, 15 bp, Homo sapiens
atgatcttggctcac

SEQ ID NO: 9856 - DNA, 15 bp, Homo sapiens
catgatcttggctca

SEQ ID NO: 9857 - DNA, 15 bp, Homo sapiens
gcatgatcttggctc

SEQ ID NO: 9858 - DNA, 15 bp, Homo sapiens
ggcatgatcttggct

SEQ ID NO: 9859 - DNA, 15 bp, Homo sapiens
cggcatgatcttggc

SEQ ID NO: 9860 - DNA, 15 bp, Homo sapiens
acggcatgatcttgg

SEQ ID NO: 9861 - DNA, 15 bp, Homo sapiens
aacggcatgatcttg

SEQ ID NO: 9862 - DNA, 15 bp, Homo sapiens
caacggcatgatctt

SEQ ID NO: 9863 - DNA, 15 bp, Homo sapiens
gcaacggcatgatct

SEQ ID NO: 9864 - DNA, 15 bp, Homo sapiens
tgcaacggcatgatc

SEQ ID NO: 9865 - DNA, 15 bp, Homo sapiens
gtgcaacggcatgat

SEQ ID NO: 9866 - DNA, 15 bp, Homo sapiens
agtgcaacggcatga

SEQ ID NO: 9867 - DNA, 15 bp, Homo sapiens
gagtgcaacggcatg

SEQ ID NO: 9868 - DNA, 15 bp, Homo sapiens
ggagtgcaacggcat

SEQ ID NO: 9869 - DNA, 15 bp, Homo sapiens
tggagtgcaacggca

SEQ ID NO: 9870 - DNA, 15 bp, Homo sapiens
ctggagtgcaacggc

SEQ ID NO: 9871 - DNA, 15 bp, Homo sapiens
gctggagtgcaacgg

SEQ ID NO: 9872 - DNA, 15 bp, Homo sapiens
ggctggagtgcaacg

SEQ ID NO: 9873 - DNA, 15 bp, Homo sapiens
aggctggagtgcaac

SEQ ID NO: 9874 - DNA, 15 bp, Homo sapiens
tccaggctggagtgc

SEQ ID NO: 9875 - DNA, 15 bp, Homo sapiens
gtccaggctggagtg

SEQ ID NO: 9876 - DNA, 15 bp, Homo sapiens
cgtccaggctggagt

SEQ ID NO: 9877 - DNA, 15 bp, Homo sapiens
tcgtccaggctggag

SEQ ID NO: 9878 - DNA, 15 bp, Homo sapiens
gtcgtccaggctgga

SEQ ID NO: 9879 - DNA, 15 bp, Homo sapiens
tgtcgtccaggctgg

SEQ ID NO: 9880 - DNA, 15 bp, Homo sapiens
ttgtcgtccaggctg

SEQ ID NO: 9881 - DNA, 15 bp, Homo sapiens
cttgtcgtccaggct

SEQ ID NO: 9882 - DNA, 15 bp, Homo sapiens
tcttgtcgtccaggc

SEQ ID NO: 9883 - DNA, 15 bp, Homo sapiens
ctcttgtcgtccagg

SEQ ID NO: 9884 - DNA, 15 bp, Homo sapiens
gctcttgtcgtccag

SEQ ID NO: 9885 - DNA, 15 bp, Homo sapiens
cgctcttgtcgtcca

SEQ ID NO: 9886 - DNA, 15 bp, Homo sapiens
ccgctcttgtcgtcc

SEQ ID NO: 9887 - DNA, 15 bp, Homo sapiens
tccgctcttgtcgtc

SEQ ID NO: 9888 - DNA, 15 bp, Homo sapiens
ttccgctcttgtcgt

SEQ ID NO: 9889 - DNA, 15 bp, Homo sapiens
gttccgctcttgtcg

SEQ ID NO: 9890 - DNA, 15 bp, Homo sapiens
agttccgctcttgtc

SEQ ID NO: 9891 - DNA, 15 bp, Homo sapiens
gagttccgctcttgt

SEQ ID NO: 9892 - DNA, 15 bp, Homo sapiens
ggagttccgctcttg

SEQ ID NO: 9893 - DNA, 15 bp, Homo sapiens
cggagttccgctctt

SEQ ID NO: 9894 - DNA, 15 bp, Homo sapiens
acggagttccgctct

SEQ ID NO: 9895 - DNA, 15 bp, Homo sapiens
gacggagttccgctc

SEQ ID NO: 9896 - DNA, 15 bp, Homo sapiens
agacggagttccgct

SEQ ID NO: 9897 - DNA, 15 bp, Homo sapiens
gagacggagttccgc

SEQ ID NO: 9898 - DNA, 15 bp, Homo sapiens
tgagacggagttccg

SEQ ID NO: 9899 - DNA, 15 bp, Homo sapiens
ttgagacggagttcc

SEQ ID NO: 9900 - DNA, 15 bp, Homo sapiens
tttgagacggagttc

SEQ ID NO: 9901 - DNA, 15 bp, Homo sapiens
ttttttgagacggag

SEQ ID NO: 9902 - DNA, 15 bp, Homo sapiens
tttttttgagacgga

SEQ ID NO: 9903 - DNA, 15 bp, Homo sapiens
ttttttttgagacgg

SEQ ID NO: 9904 - DNA, 15 bp, Homo sapiens
tttttttttgagacg

SEQ ID NO: 9905 - DNA, 15 bp, Homo sapiens
ctctttttttttttt

SEQ ID NO: 9906 - DNA, 15 bp, Homo sapiens
actcttttttttttt

SEQ ID NO: 9907 - DNA, 15 bp, Homo sapiens
aactctttttttttt

SEQ ID NO: 9908 - DNA, 15 bp, Homo sapiens
taactcttttttttt

SEQ ID NO: 9909 - DNA, 15 bp, Homo sapiens
ataactctttttttt

SEQ ID NO: 9910 - DNA, 15 bp, Homo sapiens
tataactcttttttt

SEQ ID NO: 9911 - DNA, 15 bp, Homo sapiens
atataactctttttt

SEQ ID NO: 9912 - DNA, 15 bp, Homo sapiens
aatataactcttttt

SEQ ID NO: 9913 - DNA, 15 bp, Homo sapiens
caatataactctttt

SEQ ID NO: 9914 - DNA, 15 bp, Homo sapiens
acaatataactcttt

SEQ ID NO: 9915 - DNA, 15 bp, Homo sapiens
tacaatataactctt

SEQ ID NO: 9916 - DNA, 15 bp, Homo sapiens
ttacaatataactct

SEQ ID NO: 9917 - DNA, 15 bp, Homo sapiens
tttacaatataactc

SEQ ID NO: 9918 - DNA, 15 bp, Homo sapiens
ctttacaatataact

SEQ ID NO: 9919 - DNA, 15 bp, Homo sapiens
actttacaatataac

SEQ ID NO: 9920 - DNA, 15 bp, Homo sapiens
tactttacaatataa

SEQ ID NO: 9921 - DNA, 15 bp, Homo sapiens
atactttacaatata

SEQ ID NO: 9922 - DNA, 15 bp, Homo sapiens
gatactttacaatat

SEQ ID NO: 9923 - DNA, 15 bp, Homo sapiens
agatactttacaata

SEQ ID NO: 9924 - DNA, 15 bp, Homo sapiens
gagatactttacaat

SEQ ID NO: 9925 - DNA, 15 bp, Homo sapiens
agagatactttacaa

SEQ ID NO: 9926 - DNA, 15 bp, Homo sapiens
cagagatactttaca

SEQ ID NO: 9927 - DNA, 15 bp, Homo sapiens
gcagagatactttac

SEQ ID NO: 9928 - DNA, 15 bp, Homo sapiens
agcagagatacttta

SEQ ID NO: 9929 - DNA, 15 bp, Homo sapiens
tagcagagatacttt

SEQ ID NO: 9930 - DNA, 15 bp, Homo sapiens
gtagcagagatactt

SEQ ID NO: 9931 - DNA, 15 bp, Homo sapiens
ggtagcagagatact

SEQ ID NO: 9932 - DNA, 15 bp, Homo sapiens
gggtagcagagatac

SEQ ID NO: 9933 - DNA, 15 bp, Homo sapiens
agggtagcagagata

SEQ ID NO: 9934 - DNA, 15 bp, Homo sapiens
cagggtagcagagat

SEQ ID NO: 9935 - DNA, 15 bp, Homo sapiens
gcagggtagcagaga

SEQ ID NO: 9936 - DNA, 15 bp, Homo sapiens
ggcagggtagcagag

SEQ ID NO: 9937 - DNA, 15 bp, Homo sapiens
gggcagggtagcaga

SEQ ID NO: 9938 - DNA, 15 bp, Homo sapiens
ggggcagggtagcag

SEQ ID NO: 9939 - DNA, 15 bp, Homo sapiens
tggggcagggtagca

SEQ ID NO: 9940 - DNA, 15 bp, Homo sapiens
ttggggcagggtagc

SEQ ID NO: 9941 - DNA, 15 bp, Homo sapiens
tttggggcagggtag

SEQ ID NO: 9942 - DNA, 15 bp, Homo sapiens
gtttggggcagggta

SEQ ID NO: 9943 - DNA, 15 bp, Homo sapiens
tgtttggggcagggt

SEQ ID NO: 9944 - DNA, 15 bp, Homo sapiens
atgtttggggcaggg

SEQ ID NO: 9945 - DNA, 15 bp, Homo sapiens
aatgtttggggcagg

SEQ ID NO: 9946 - DNA, 15 bp, Homo sapiens
gaatgtttggggcag

SEQ ID NO: 9947 - DNA, 15 bp, Homo sapiens
tgaatgtttggggca

SEQ ID NO: 9948 - DNA, 15 bp, Homo sapiens
atgaatgtttggggc

SEQ ID NO: 9949 - DNA, 15 bp, Homo sapiens
aatgaatgtttgggg

SEQ ID NO: 9950 - DNA, 15 bp, Homo sapiens
aaatgaatgtttggg

SEQ ID NO: 9951 - DNA, 15 bp, Homo sapiens
gaaatgaatgtttgg

SEQ ID NO: 9952 - DNA, 15 bp, Homo sapiens
agaaatgaatgtttg

SEQ ID NO: 9953 - DNA, 15 bp, Homo sapiens
aagaaatgaatgttt

SEQ ID NO: 9954 - DNA, 15 bp, Homo sapiens
aaagaaatgaatgtt

SEQ ID NO: 9955 - DNA, 15 bp, Homo sapiens
gaaagaaatgaatgt

SEQ ID NO: 9956 - DNA, 15 bp, Homo sapiens
ggaaagaaatgaatg

SEQ ID NO: 9957 - DNA, 15 bp, Homo sapiens
gggaaagaaatgaat

SEQ ID NO: 9958 - DNA, 15 bp, Homo sapiens
agggaaagaaatgaa

SEQ ID NO: 9959 - DNA, 15 bp, Homo sapiens
cagggaaagaaatga

SEQ ID NO: 9960 - DNA, 15 bp, Homo sapiens
ccagggaaagaaatg

SEQ ID NO: 9961 - DNA, 15 bp, Homo sapiens
tccagggaaagaaat

SEQ ID NO: 9962 - DNA, 15 bp, Homo sapiens
ctccagggaaagaaa

SEQ ID NO: 9963 - DNA, 15 bp, Homo sapiens
cctccagggaaagaa

SEQ ID NO: 9964 - DNA, 15 bp, Homo sapiens
gcctccagggaaaga

SEQ ID NO: 9965 - DNA, 15 bp, Homo sapiens
tgcctccagggaaag

SEQ ID NO: 9966 - DNA, 15 bp, Homo sapiens
ctgcctccagggaaa

SEQ ID NO: 9967 - DNA, 15 bp, Homo sapiens
gctgcctccagggaa

SEQ ID NO: 9968 - DNA, 15 bp, Homo sapiens
ggctgcctccaggga

SEQ ID NO: 9969 - DNA, 15 bp, Homo sapiens
tggctgcctccaggg

SEQ ID NO: 9970 - DNA, 15 bp, Homo sapiens
gtggctgcctccagg

SEQ ID NO: 9971 - DNA, 15 bp, Homo sapiens
agtggctgcctccag

SEQ ID NO: 9972 - DNA, 15 bp, Homo sapiens
tagtggctgcctcca

SEQ ID NO: 9973 - DNA, 15 bp, Homo sapiens
atagtggctgcctcc

SEQ ID NO: 9974 - DNA, 15 bp, Homo sapiens
aatagtggctgcctc

SEQ ID NO: 9975 - DNA, 15 bp, Homo sapiens
taatagtggctgcct

SEQ ID NO: 9976 - DNA, 15 bp, Homo sapiens
gtaatagtggctgcc

SEQ ID NO: 9977 - DNA, 15 bp, Homo sapiens
ggtaatagtggctgc

SEQ ID NO: 9978 - DNA, 15 bp, Homo sapiens
aggtaatagtggctg

SEQ ID NO: 9979 - DNA, 15 bp, Homo sapiens
caggtaatagtggct

SEQ ID NO: 9980 - DNA, 15 bp, Homo sapiens
acaggtaatagtggc

SEQ ID NO: 9981 - DNA, 15 bp, Homo sapiens
aacaggtaatagtgg

SEQ ID NO: 9982 - DNA, 15 bp, Homo sapiens
aaacaggtaatagtg

SEQ ID NO: 9983 - DNA, 15 bp, Homo sapiens
gaaacaggtaatagt

SEQ ID NO: 9984 - DNA, 15 bp, Homo sapiens
agaaacaggtaatag

SEQ ID NO: 9985 - DNA, 15 bp, Homo sapiens
aagaaacaggtaata

SEQ ID NO: 9986 - DNA, 15 bp, Homo sapiens
aaagaaacaggtaat

SEQ ID NO: 9987 - DNA, 15 bp, Homo sapiens
taaagaaacaggtaa

SEQ ID NO: 9988 - DNA, 15 bp, Homo sapiens
ttaaagaaacaggta

SEQ ID NO: 9989 - DNA, 15 bp, Homo sapiens
tttaaagaaacaggt

SEQ ID NO: 9990 - DNA, 15 bp, Homo sapiens
ttttaaagaaacagg

SEQ ID NO: 9991 - DNA, 15 bp, Homo sapiens
tttttaaagaaacag

SEQ ID NO: 9992 - DNA, 15 bp, Homo sapiens
ttttttaaagaaaca

SEQ ID NO: 9993 - DNA, 15 bp, Homo sapiens
tttttttaaagaaac

SEQ ID NO: 9994 - DNA, 15 bp, Homo sapiens
ttttttttaaagaaa

SEQ ID NO: 9995 - DNA, 15 bp, Homo sapiens
tttttttttaaagaa

SEQ ID NO: 9996 - DNA, 15 bp, Homo sapiens
atttttttttttttt

SEQ ID NO: 9997 - DNA, 15 bp, Homo sapiens
aattttttttttttt

SEQ ID NO: 9998 - DNA, 15 bp, Homo sapiens
caatttttttttttt

SEQ ID NO: 9999 - DNA, 15 bp, Homo sapiens
acaattttttttttt

SEQ ID NO: 10000 - DNA, 15 bp, Homo sapiens
cacaatttttttttt

SEQ ID NO: 10001 - DNA, 15 bp, Homo sapiens
ccacaattttttttt

SEQ ID NO: 10002 - DNA, 15 bp, Homo sapiens
gccacaatttttttt

SEQ ID NO: 10003 - DNA, 15 bp, Homo sapiens
ggccacaattttttt

SEQ ID NO: 10004 - DNA, 15 bp, Homo sapiens
cggccacaatttttt

SEQ ID NO: 10005 - DNA, 15 bp, Homo sapiens
ccggccacaattttt

SEQ ID NO: 10006 - DNA, 15 bp, Homo sapiens
cccggccacaatttt

SEQ ID NO: 10007 - DNA, 15 bp, Homo sapiens
gcccggccacaattt

SEQ ID NO: 10008 - DNA, 15 bp, Homo sapiens
tgcccggccacaatt

SEQ ID NO: 10009 - DNA, 15 bp, Homo sapiens
gtgcccggccacaat

SEQ ID NO: 10010 - DNA, 15 bp, Homo sapiens
cgtgcccggccacaa

SEQ ID NO: 10011 - DNA, 15 bp, Homo sapiens
ccgtgcccggccaca

SEQ ID NO: 10012 - DNA, 15 bp, Homo sapiens
accgtgcccggccac

SEQ ID NO: 10013 - DNA, 15 bp, Homo sapiens
caccgtgcccggcca

SEQ ID NO: 10014 - DNA, 15 bp, Homo sapiens
ccaccgtgcccggcc

SEQ ID NO: 10015 - DNA, 15 bp, Homo sapiens
gccaccgtgcccggc

SEQ ID NO: 10016 - DNA, 15 bp, Homo sapiens
agccaccgtgcccgg

SEQ ID NO: 10017 - DNA, 15 bp, Homo sapiens
gagccaccgtgcccg

SEQ ID NO: 10018 - DNA, 15 bp, Homo sapiens
tgagccaccgtgccc

SEQ ID NO: 10019 - DNA, 15 bp, Homo sapiens
gtgagccaccgtgcc

SEQ ID NO: 10020 - DNA, 15 bp, Homo sapiens
cgtgagccaccgtgc

SEQ ID NO: 10021 - DNA, 15 bp, Homo sapiens
gcgtgagccaccgtg

SEQ ID NO: 10022 - DNA, 15 bp, Homo sapiens
ggcgtgagccaccgt

SEQ ID NO: 10023 - DNA, 15 bp, Homo sapiens
caggcgtgagccacc

SEQ ID NO: 10024 - DNA, 15 bp, Homo sapiens
acaggcgtgagccac

SEQ ID NO: 10025 - DNA, 15 bp, Homo sapiens
tacaggcgtgagcca

SEQ ID NO: 10026 - DNA, 15 bp, Homo sapiens
ttacaggcgtgagcc

SEQ ID NO: 10027 - DNA, 15 bp, Homo sapiens
attacaggcgtgagc

SEQ ID NO: 10028 - DNA, 15 bp, Homo sapiens
gattacaggcgtgag

SEQ ID NO: 10029 - DNA, 15 bp, Homo sapiens
ggattacaggcgtga

SEQ ID NO: 10030 - DNA, 15 bp, Homo sapiens
aggattacaggcgtg

SEQ ID NO: 10031 - DNA, 15 bp, Homo sapiens
taggattacaggcgt

SEQ ID NO: 10032 - DNA, 15 bp, Homo sapiens
ctaggattacaggcg

SEQ ID NO: 10033 - DNA, 15 bp, Homo sapiens
tgctaggattacagg

SEQ ID NO: 10034 - DNA, 15 bp, Homo sapiens
gtgctaggattacag

SEQ ID NO: 10035 - DNA, 15 bp, Homo sapiens
agtgctaggattaca

SEQ ID NO: 10036 - DNA, 15 bp, Homo sapiens
aagtgctaggattac

SEQ ID NO: 10037 - DNA, 15 bp, Homo sapiens
aaagtgctaggatta

SEQ ID NO: 10038 - DNA, 15 bp, Homo sapiens
caaagtgctaggatt

SEQ ID NO: 10039 - DNA, 15 bp, Homo sapiens
ccaaagtgctaggat

SEQ ID NO: 10040 - DNA, 15 bp, Homo sapiens
cccaaagtgctagga

SEQ ID NO: 10041 - DNA, 15 bp, Homo sapiens
tcccaaagtgctagg

SEQ ID NO: 10042 - DNA, 15 bp, Homo sapiens
ctcccaaagtgctag

SEQ ID NO: 10043 - DNA, 15 bp, Homo sapiens
cctcccaaagtgcta

SEQ ID NO: 10044 - DNA, 15 bp, Homo sapiens
ccacctcccaaagtg

SEQ ID NO: 10045 - DNA, 15 bp, Homo sapiens
tccacctcccaaagt

SEQ ID NO: 10046 - DNA, 15 bp, Homo sapiens
ctccacctcccaaag

SEQ ID NO: 10047 - DNA, 15 bp, Homo sapiens
cctccacctcccaaa

SEQ ID NO: 10048 - DNA, 15 bp, Homo sapiens
acctccacctcccaa

SEQ ID NO: 10049 - DNA, 15 bp, Homo sapiens
cacctccacctccca

SEQ ID NO: 10050 - DNA, 15 bp, Homo sapiens
ccacctccacctccc

SEQ ID NO: 10051 - DNA, 15 bp, Homo sapiens
cccacctccacctcc

SEQ ID NO: 10052 - DNA, 15 bp, Homo sapiens
acccacctccacctc

SEQ ID NO: 10053 - DNA, 15 bp, Homo sapiens
cacccacctccacct

SEQ ID NO: 10054 - DNA, 15 bp, Homo sapiens
ccacccacctccacc

SEQ ID NO: 10055 - DNA, 15 bp, Homo sapiens
tccacccacctccac

SEQ ID NO: 10056 - DNA, 15 bp, Homo sapiens
atccacccacctcca

SEQ ID NO: 10057 - DNA, 15 bp, Homo sapiens
gatccacccacctcc

SEQ ID NO: 10058 - DNA, 15 bp, Homo sapiens
atgatccacccacct

SEQ ID NO: 10059 - DNA, 15 bp, Homo sapiens
catgatccacccacc

SEQ ID NO: 10060 - DNA, 15 bp, Homo sapiens
tcatgatccacccac

SEQ ID NO: 10061 - DNA, 15 bp, Homo sapiens
ctcatgatccaccca

SEQ ID NO: 10062 - DNA, 15 bp, Homo sapiens
cctcatgatccaccc

SEQ ID NO: 10063 - DNA, 15 bp, Homo sapiens
acctcatgatccacc

SEQ ID NO: 10064 - DNA, 15 bp, Homo sapiens
gacctcatgatccac

SEQ ID NO: 10065 - DNA, 15 bp, Homo sapiens
tgacctcatgatcca

SEQ ID NO: 10066 - DNA, 15 bp, Homo sapiens
ttgacctcatgatcc

SEQ ID NO: 10067 - DNA, 15 bp, Homo sapiens
cttgacctcatgatc

SEQ ID NO: 10068 - DNA, 15 bp, Homo sapiens
tcttgacctcatgat

SEQ ID NO: 10069 - DNA, 15 bp, Homo sapiens
ctcttgacctcatga

SEQ ID NO: 10070 - DNA, 15 bp, Homo sapiens
tctcttgacctcatg

SEQ ID NO: 10071 - DNA, 15 bp, Homo sapiens
atctcttgacctcat

SEQ ID NO: 10072 - DNA, 15 bp, Homo sapiens
gatctcttgacctca

SEQ ID NO: 10073 - DNA, 15 bp, Homo sapiens
cgatctcttgacctc

SEQ ID NO: 10074 - DNA, 15 bp, Homo sapiens
tcgatctcttgacct

SEQ ID NO: 10075 - DNA, 15 bp, Homo sapiens
ctcgatctcttgacc

SEQ ID NO: 10076 - DNA, 15 bp, Homo sapiens
tctcgatctcttgac

SEQ ID NO: 10077 - DNA, 15 bp, Homo sapiens
gtctcgatctcttga

SEQ ID NO: 10078 - DNA, 15 bp, Homo sapiens
ggtctcgatctcttg

SEQ ID NO: 10079 - DNA, 15 bp, Homo sapiens
tggtctcgatctctt

SEQ ID NO: 10080 - DNA, 15 bp, Homo sapiens
atggtctcgatctct

SEQ ID NO: 10081 - DNA, 15 bp, Homo sapiens
gatggtctcgatctc

SEQ ID NO: 10082 - DNA, 15 bp, Homo sapiens
agatggtctcgatct

SEQ ID NO: 10083 - DNA, 15 bp, Homo sapiens
aagatggtctcgatc

SEQ ID NO: 10084 - DNA, 15 bp, Homo sapiens
caagatggtctcgat

SEQ ID NO: 10085 - DNA, 15 bp, Homo sapiens
ccaagatggtctcga

SEQ ID NO: 10086 - DNA, 15 bp, Homo sapiens
gccaagatggtctcg

SEQ ID NO: 10087 - DNA, 15 bp, Homo sapiens
ggccaagatggtctc

SEQ ID NO: 10088 - DNA, 15 bp, Homo sapiens
tggccaagatggtct

SEQ ID NO: 10089 - DNA, 15 bp, Homo sapiens
ttggccaagatggtc

SEQ ID NO: 10090 - DNA, 15 bp, Homo sapiens
gttggccaagatggt

SEQ ID NO: 10091 - DNA, 15 bp, Homo sapiens
tgttggccaagatgg

SEQ ID NO: 10092 - DNA, 15 bp, Homo sapiens
atgttggccaagatg

SEQ ID NO: 10093 - DNA, 15 bp, Homo sapiens
catgttggccaagat

SEQ ID NO: 10094 - DNA, 15 bp, Homo sapiens
ccatgttggccaaga

SEQ ID NO: 10095 - DNA, 15 bp, Homo sapiens
accatgttggccaag

SEQ ID NO: 10096 - DNA, 15 bp, Homo sapiens
taccatgttggccaa

SEQ ID NO: 10097 - DNA, 15 bp, Homo sapiens
ttaccatgttggcca

SEQ ID NO: 10098 - DNA, 15 bp, Homo sapiens
tttaccatgttggcc

SEQ ID NO: 10099 - DNA, 15 bp, Homo sapiens
ttttaccatgttggc

SEQ ID NO: 10100 - DNA, 15 bp, Homo sapiens
gttttaccatgttgg

SEQ ID NO: 10101 - DNA, 15 bp, Homo sapiens
ggttttaccatgttg

SEQ ID NO: 10102 - DNA, 15 bp, Homo sapiens
gggttttaccatgtt

SEQ ID NO: 10103 - DNA, 15 bp, Homo sapiens
ggggttttaccatgt

SEQ ID NO: 10104 - DNA, 15 bp, Homo sapiens
tggggttttaccatg

SEQ ID NO: 10105 - DNA, 15 bp, Homo sapiens
atggggttttaccat

SEQ ID NO: 10106 - DNA, 15 bp, Homo sapiens
gatggggttttacca

SEQ ID NO: 10107 - DNA, 15 bp, Homo sapiens
agatggggttttacc

SEQ ID NO: 10108 - DNA, 15 bp, Homo sapiens
gagatggggttttac

SEQ ID NO: 10109 - DNA, 15 bp, Homo sapiens
agagatggggtttta

SEQ ID NO: 10110 - DNA, 15 bp, Homo sapiens
tagagatggggtttt

SEQ ID NO: 10111 - DNA, 15 bp, Homo sapiens
gtagagatggggttt

SEQ ID NO: 10112 - DNA, 15 bp, Homo sapiens
agtagagatggggtt

SEQ ID NO: 10113 - DNA, 15 bp, Homo sapiens
tagtagagatggggt

SEQ ID NO: 10114 - DNA, 15 bp, Homo sapiens
ttagtagagatgggg

SEQ ID NO: 10115 - DNA, 15 bp, Homo sapiens
tttagtagagatggg

SEQ ID NO: 10116 - DNA, 15 bp, Homo sapiens
ttttagtagagatgg

SEQ ID NO: 10117 - DNA, 15 bp, Homo sapiens
tttttagtagagatg

SEQ ID NO: 10118 - DNA, 15 bp, Homo sapiens
atttttagtagagat

SEQ ID NO: 10119 - DNA, 15 bp, Homo sapiens
ttttttgtattttta

SEQ ID NO: 10120 - DNA, 15 bp, Homo sapiens
attttttgtattttt

SEQ ID NO: 10121 - DNA, 15 bp, Homo sapiens
aattttttgtatttt

SEQ ID NO: 10122 - DNA, 15 bp, Homo sapiens
taattttttgtattt

SEQ ID NO: 10123 - DNA, 15 bp, Homo sapiens
ctaattttttgtatt

SEQ ID NO: 10124 - DNA, 15 bp, Homo sapiens
gctaattttttgtat

SEQ ID NO: 10125 - DNA, 15 bp, Homo sapiens
ggctaattttttgta

SEQ ID NO: 10126 - DNA, 15 bp, Homo sapiens
cggctaattttttgt

SEQ ID NO: 10127 - DNA, 15 bp, Homo sapiens
ccggctaattttttg

SEQ ID NO: 10128 - DNA, 15 bp, Homo sapiens
cccggctaatttttt

SEQ ID NO: 10129 - DNA, 15 bp, Homo sapiens
gcccggctaattttt

SEQ ID NO: 10130 - DNA, 15 bp, Homo sapiens
tgcccggctaatttt

SEQ ID NO: 10131 - DNA, 15 bp, Homo sapiens
atgcccggctaattt

SEQ ID NO: 10132 - DNA, 15 bp, Homo sapiens
catgcccggctaatt

SEQ ID NO: 10133 - DNA, 15 bp, Homo sapiens
ccatgcccggctaat

SEQ ID NO: 10134 - DNA, 15 bp, Homo sapiens
accatgcccggctaa

SEQ ID NO: 10135 - DNA, 15 bp, Homo sapiens
caccatgcccggcta

SEQ ID NO: 10136 - DNA, 15 bp, Homo sapiens
ccaccatgcccggct

SEQ ID NO: 10137 - DNA, 15 bp, Homo sapiens
gccaccatgcccggc

SEQ ID NO: 10138 - DNA, 15 bp, Homo sapiens
cgccaccatgcccgg

SEQ ID NO: 10139 - DNA, 15 bp, Homo sapiens
ccgccaccatgcccg

SEQ ID NO: 10140 - DNA, 15 bp, Homo sapiens
cccgccaccatgccc

SEQ ID NO: 10141 - DNA, 15 bp, Homo sapiens
gcccgccaccatgcc

SEQ ID NO: 10142 - DNA, 15 bp, Homo sapiens
tgcccgccaccatgc

SEQ ID NO: 10143 - DNA, 15 bp, Homo sapiens
gtgcccgccaccatg

SEQ ID NO: 10144 - DNA, 15 bp, Homo sapiens
ggtgcccgccaccat

SEQ ID NO: 10145 - DNA, 15 bp, Homo sapiens
ctacaggtgcccgcc

SEQ ID NO: 10146 - DNA, 15 bp, Homo sapiens
actacaggtgcccgc

SEQ ID NO: 10147 - DNA, 15 bp, Homo sapiens
gactacaggtgcccg

SEQ ID NO: 10148 - DNA, 15 bp, Homo sapiens
ggactacaggtgccc

SEQ ID NO: 10149 - DNA, 15 bp, Homo sapiens
gggactacaggtgcc

SEQ ID NO: 10150 - DNA, 15 bp, Homo sapiens
tgggactacaggtgc

SEQ ID NO: 10151 - DNA, 15 bp, Homo sapiens
ctgggactacaggtg

SEQ ID NO: 10152 - DNA, 15 bp, Homo sapiens
gctgggactacaggt

SEQ ID NO: 10153 - DNA, 15 bp, Homo sapiens
caggttcaagcgatt

SEQ ID NO: 10154 - DNA, 15 bp, Homo sapiens
ccaggttcaagcgat

SEQ ID NO: 10155 - DNA, 15 bp, Homo sapiens
cccaggttcaagcga

SEQ ID NO: 10156 - DNA, 15 bp, Homo sapiens
tcccaggttcaagcg

SEQ ID NO: 10157 - DNA, 15 bp, Homo sapiens
ctcccaggttcaagc

SEQ ID NO: 10158 - DNA, 15 bp, Homo sapiens
ttcactgcaacctct

SEQ ID NO: 10159 - DNA, 15 bp, Homo sapiens
gttcactgcaacctc

SEQ ID NO: 10160 - DNA, 15 bp, Homo sapiens
agttcactgcaacct

SEQ ID NO: 10161 - DNA, 15 bp, Homo sapiens
cagttcactgcaacc

SEQ ID NO: 10162 - DNA, 15 bp, Homo sapiens
tcagttcactgcaac

SEQ ID NO: 10163 - DNA, 15 bp, Homo sapiens
ctcagttcactgcaa

SEQ ID NO: 10164 - DNA, 15 bp, Homo sapiens
tctcagttcactgca

SEQ ID NO: 10165 - DNA, 15 bp, Homo sapiens
atctcagttcactgc

SEQ ID NO: 10166 - DNA, 15 bp, Homo sapiens
gatctcagttcactg

SEQ ID NO: 10167 - DNA, 15 bp, Homo sapiens
tgatctcagttcact

SEQ ID NO: 10168 - DNA, 15 bp, Homo sapiens
gtgatctcagttcac

SEQ ID NO: 10169 - DNA, 15 bp, Homo sapiens
cgtgatctcagttca

SEQ ID NO: 10170 - DNA, 15 bp, Homo sapiens
gcgtgatctcagttc

SEQ ID NO: 10171 - DNA, 15 bp, Homo sapiens
ggcgtgatctcagtt

SEQ ID NO: 10172 - DNA, 15 bp, Homo sapiens
cggcgtgatctcagt

SEQ ID NO: 10173 - DNA, 15 bp, Homo sapiens
gcggcgtgatctcag

SEQ ID NO: 10174 - DNA, 15 bp, Homo sapiens
agcggcgtgatctca

SEQ ID NO: 10175 - DNA, 15 bp, Homo sapiens
cagcggcgtgatctc

SEQ ID NO: 10176 - DNA, 15 bp, Homo sapiens
gcagcggcgtgatct

SEQ ID NO: 10177 - DNA, 15 bp, Homo sapiens
tgcagcggcgtgatc

SEQ ID NO: 10178 - DNA, 15 bp, Homo sapiens
gtgcagcggcgtgat

SEQ ID NO: 10179 - DNA, 15 bp, Homo sapiens
agtgcagcggcgtga

SEQ ID NO: 10180 - DNA, 15 bp, Homo sapiens
gagtgcagcggcgtg

SEQ ID NO: 10181 - DNA, 15 bp, Homo sapiens
ggagtgcagcggcgt

SEQ ID NO: 10182 - DNA, 15 bp, Homo sapiens
tggagtgcagcggcg

SEQ ID NO: 10183 - DNA, 15 bp, Homo sapiens
ctggagtgcagcggc

SEQ ID NO: 10184 - DNA, 15 bp, Homo sapiens
gctggagtgcagcgg

SEQ ID NO: 10185 - DNA, 15 bp, Homo sapiens
ggctggagtgcagcg

SEQ ID NO: 10186 - DNA, 15 bp, Homo sapiens
aggctggagtgcagc

SEQ ID NO: 10187 - DNA, 15 bp, Homo sapiens
gccaggctggagtgc

SEQ ID NO: 10188 - DNA, 15 bp, Homo sapiens
tgccaggctggagtg

SEQ ID NO: 10189 - DNA, 15 bp, Homo sapiens
ttgccaggctggagt

SEQ ID NO: 10190 - DNA, 15 bp, Homo sapiens
gttgccaggctggag

SEQ ID NO: 10191 - DNA, 15 bp, Homo sapiens
tgttgccaggctgga

SEQ ID NO: 10192 - DNA, 15 bp, Homo sapiens
ctgttgccaggctgg

SEQ ID NO: 10193 - DNA, 15 bp, Homo sapiens
tctgttgccaggctg

SEQ ID NO: 10194 - DNA, 15 bp, Homo sapiens
ttctgttgccaggct

SEQ ID NO: 10195 - DNA, 15 bp, Homo sapiens
attctgttgccaggc

SEQ ID NO: 10196 - DNA, 15 bp, Homo sapiens
cattctgttgccagg

SEQ ID NO: 10197 - DNA, 15 bp, Homo sapiens
tcattctgttgccag

SEQ ID NO: 10198 - DNA, 15 bp, Homo sapiens
ctcattctgttgcca

SEQ ID NO: 10199 - DNA, 15 bp, Homo sapiens
tctcattctgttgcc

SEQ ID NO: 10200 - DNA, 15 bp, Homo sapiens
gtctcattctgttgc

SEQ ID NO: 10201 - DNA, 15 bp, Homo sapiens
agtctcattctgttg

SEQ ID NO: 10202 - DNA, 15 bp, Homo sapiens
gagtctcattctgtt

SEQ ID NO: 10203 - DNA, 15 bp, Homo sapiens
ggagtctcattctgt

SEQ ID NO: 10204 - DNA, 15 bp, Homo sapiens
tggagtctcattctg

SEQ ID NO: 10205 - DNA, 15 bp, Homo sapiens
atggagtctcattct

SEQ ID NO: 10206 - DNA, 15 bp, Homo sapiens
gatggagtctcattc

SEQ ID NO: 10207 - DNA, 15 bp, Homo sapiens
agatggagtctcatt

SEQ ID NO: 10208 - DNA, 15 bp, Homo sapiens
gagatggagtctcat

SEQ ID NO: 10209 - DNA, 15 bp, Homo sapiens
ttgagatggagtctc

SEQ ID NO: 10210 - DNA, 15 bp, Homo sapiens
tttgagatggagtct

SEQ ID NO: 10211 - DNA, 15 bp, Homo sapiens
ttttgagatggagtc

SEQ ID NO: 10212 - DNA, 15 bp, Homo sapiens
tttttgagatggagt

SEQ ID NO: 10213 - DNA, 15 bp, Homo sapiens
ttttttgagatggag

SEQ ID NO: 10214 - DNA, 15 bp, Homo sapiens
tttttttgagatgga

SEQ ID NO: 10215 - DNA, 15 bp, Homo sapiens
ttttttttgagatgg

SEQ ID NO: 10216 - DNA, 15 bp, Homo sapiens
tttttttttgagatg

SEQ ID NO: 10217 - DNA, 15 bp, Homo sapiens
ttttttttttgagat

SEQ ID NO: 10218 - DNA, 15 bp, Homo sapiens
cttttttttttgaga

SEQ ID NO: 10219 - DNA, 15 bp, Homo sapiens
gcttttttttttgag

SEQ ID NO: 10220 - DNA, 15 bp, Homo sapiens
cgcttttttttttga

SEQ ID NO: 10221 - DNA, 15 bp, Homo sapiens
acgcttttttttttg

SEQ ID NO: 10222 - DNA, 15 bp, Homo sapiens
cacgctttttttttt

SEQ ID NO: 10223 - DNA, 15 bp, Homo sapiens
acacgcttttttttt

SEQ ID NO: 10224 - DNA, 15 bp, Homo sapiens
cacacgctttttttt

SEQ ID NO: 10225 - DNA, 15 bp, Homo sapiens
acacacgcttttttt

SEQ ID NO: 10226 - DNA, 15 bp, Homo sapiens
cacacacgctttttt

SEQ ID NO: 10227 - DNA, 15 bp, Homo sapiens
acacacacgcttttt

SEQ ID NO: 10228 - DNA, 15 bp, Homo sapiens
tacacacacgctttt

SEQ ID NO: 10229 - DNA, 15 bp, Homo sapiens
gtacacacacgcttt

SEQ ID NO: 10230 - DNA, 15 bp, Homo sapiens
ggtacacacacgctt

SEQ ID NO: 10231 - DNA, 15 bp, Homo sapiens
gggtacacacacgct

SEQ ID NO: 10232 - DNA, 15 bp, Homo sapiens
cgggtacacacacgc

SEQ ID NO: 10233 - DNA, 15 bp, Homo sapiens
acgggtacacacacg

SEQ ID NO: 10234 - DNA, 15 bp, Homo sapiens
cacgggtacacacac

SEQ ID NO: 10235 - DNA, 15 bp, Homo sapiens
acacgggtacacaca

SEQ ID NO: 10236 - DNA, 15 bp, Homo sapiens
cacacgggtacacac

SEQ ID NO: 10237 - DNA, 15 bp, Homo sapiens
acacacgggtacaca

SEQ ID NO: 10238 - DNA, 15 bp, Homo sapiens
aacacacgggtacac

SEQ ID NO: 10239 - DNA, 15 bp, Homo sapiens
taacacacgggtaca

SEQ ID NO: 10240 - DNA, 15 bp, Homo sapiens
ttaacacacgggtac

SEQ ID NO: 10241 - DNA, 15 bp, Homo sapiens
tttaacacacgggta

SEQ ID NO: 10242 - DNA, 15 bp, Homo sapiens
atttaacacacgggt

SEQ ID NO: 10243 - DNA, 15 bp, Homo sapiens
aatttaacacacggg

SEQ ID NO: 10244 - DNA, 15 bp, Homo sapiens
aaatttaacacacgg

SEQ ID NO: 10245 - DNA, 15 bp, Homo sapiens
aaaatttaacacacg

SEQ ID NO: 10246 - DNA, 15 bp, Homo sapiens
aaaaatttaacacac

SEQ ID NO: 10247 - DNA, 15 bp, Homo sapiens
taaaaatttaacaca

SEQ ID NO: 10248 - DNA, 15 bp, Homo sapiens
ataaaaatttaacac

SEQ ID NO: 10249 - DNA, 15 bp, Homo sapiens
aataaaaatttaaca

SEQ ID NO: 10250 - DNA, 15 bp, Homo sapiens
taataaaaatttaac

SEQ ID NO: 10251 - DNA, 15 bp, Homo sapiens
ataataaaaatttaa

SEQ ID NO: 10252 - DNA, 15 bp, Homo sapiens
tataataaaaattta

SEQ ID NO: 10253 - DNA, 15 bp, Homo sapiens
ttataataaaaattt

SEQ ID NO: 10254 - DNA, 15 bp, Homo sapiens
tttataataaaaatt

SEQ ID NO: 10255 - DNA, 15 bp, Homo sapiens
ttttataataaaaat

SEQ ID NO: 10256 - DNA, 15 bp, Homo sapiens
attttataataaaaa

SEQ ID NO: 10257 - DNA, 15 bp, Homo sapiens
tattttataataaaa

SEQ ID NO: 10258 - DNA, 15 bp, Homo sapiens
atattttataataaa

SEQ ID NO: 10259 - DNA, 15 bp, Homo sapiens
tatattttataataa

SEQ ID NO: 10260 - DNA, 15 bp, Homo sapiens
atatattttataata

SEQ ID NO: 10261 - DNA, 15 bp, Homo sapiens
tatatattttataat

SEQ ID NO: 10262 - DNA, 15 bp, Homo sapiens
atatatattttataa

SEQ ID NO: 10263 - DNA, 15 bp, Homo sapiens
tatatatattttata

SEQ ID NO: 10264 - DNA, 15 bp, Homo sapiens
ttatatatattttat

SEQ ID NO: 10265 - DNA, 15 bp, Homo sapiens
gttatatatatttta

SEQ ID NO: 10266 - DNA, 15 bp, Homo sapiens
tgttatatatatttt

SEQ ID NO: 10267 - DNA, 15 bp, Homo sapiens
ctgttatatatattt

SEQ ID NO: 10268 - DNA, 15 bp, Homo sapiens
cctgttatatatatt

SEQ ID NO: 10269 - DNA, 15 bp, Homo sapiens
gcctgttatatatat

SEQ ID NO: 10270 - DNA, 15 bp, Homo sapiens
agcctgttatatata

SEQ ID NO: 10271 - DNA, 15 bp, Homo sapiens
cagcctgttatatat

SEQ ID NO: 10272 - DNA, 15 bp, Homo sapiens
ccagcctgttatata

SEQ ID NO: 10273 - DNA, 15 bp, Homo sapiens
cccagcctgttatat

SEQ ID NO: 10274 - DNA, 15 bp, Homo sapiens
gcccagcctgttata

SEQ ID NO: 10275 - DNA, 15 bp, Homo sapiens
cgcccagcctgttat

SEQ ID NO: 10276 - DNA, 15 bp, Homo sapiens
acgcccagcctgtta

SEQ ID NO: 10277 - DNA, 15 bp, Homo sapiens
cacgcccagcctgtt

SEQ ID NO: 10278 - DNA, 15 bp, Homo sapiens
ccacgcccagcctgt

SEQ ID NO: 10279 - DNA, 15 bp, Homo sapiens
accacgcccagcctg

SEQ ID NO: 10280 - DNA, 15 bp, Homo sapiens
caccacgcccagcct

SEQ ID NO: 10281 - DNA, 15 bp, Homo sapiens
ccaccacgcccagcc

SEQ ID NO: 10282 - DNA, 15 bp, Homo sapiens
gccaccacgcccagc

SEQ ID NO: 10283 - DNA, 15 bp, Homo sapiens
agccaccacgcccag

SEQ ID NO: 10284 - DNA, 15 bp, Homo sapiens
gagccaccacgccca

SEQ ID NO: 10285 - DNA, 15 bp, Homo sapiens
tgagccaccacgccc

SEQ ID NO: 10286 - DNA, 15 bp, Homo sapiens
gtgagccaccacgcc

SEQ ID NO: 10287 - DNA, 15 bp, Homo sapiens
ggcgtgagccaccac

SEQ ID NO: 10288 - DNA, 15 bp, Homo sapiens
aggcgtgagccacca

SEQ ID NO: 10289 - DNA, 15 bp, Homo sapiens
gggattacaggcgtg

SEQ ID NO: 10290 - DNA, 15 bp, Homo sapiens
tgggattacaggcgt

SEQ ID NO: 10291 - DNA, 15 bp, Homo sapiens
ctgggattacaggcg

SEQ ID NO: 10292 - DNA, 15 bp, Homo sapiens
ggcctcccaaagtgc

SEQ ID NO: 10293 - DNA, 15 bp, Homo sapiens
cggcctcccaaagtg

SEQ ID NO: 10294 - DNA, 15 bp, Homo sapiens
gcctcggcctcccaa

SEQ ID NO: 10295 - DNA, 15 bp, Homo sapiens
tgcctcggcctccca

SEQ ID NO: 10296 - DNA, 15 bp, Homo sapiens
ctgcctcggcctccc

SEQ ID NO: 10297 - DNA, 15 bp, Homo sapiens
cctgcctcggcctcc

SEQ ID NO: 10298 - DNA, 15 bp, Homo sapiens
gcctgcctcggcctc

SEQ ID NO: 10299 - DNA, 15 bp, Homo sapiens
agcctgcctcggcct

SEQ ID NO: 10300 - DNA, 15 bp, Homo sapiens
cagcctgcctcggcc

SEQ ID NO: 10301 - DNA, 15 bp, Homo sapiens
tcagcctgcctcggc

SEQ ID NO: 10302 - DNA, 15 bp, Homo sapiens
atcagcctgcctcgg

SEQ ID NO: 10303 - DNA, 15 bp, Homo sapiens
gatcagcctgcctcg

SEQ ID NO: 10304 - DNA, 15 bp, Homo sapiens
tgatcagcctgcctc

SEQ ID NO: 10305 - DNA, 15 bp, Homo sapiens
gtgatcagcctgcct

SEQ ID NO: 10306 - DNA, 15 bp, Homo sapiens
cgtgatcagcctgcc

SEQ ID NO: 10307 - DNA, 15 bp, Homo sapiens
tcgtgatcagcctgc

SEQ ID NO: 10308 - DNA, 15 bp, Homo sapiens
ctcgtgatcagcctg

SEQ ID NO: 10309 - DNA, 15 bp, Homo sapiens
cctcgtgatcagcct

SEQ ID NO: 10310 - DNA, 15 bp, Homo sapiens
acctcgtgatcagcc

SEQ ID NO: 10311 - DNA, 15 bp, Homo sapiens
gacctcgtgatcagc

SEQ ID NO: 10312 - DNA, 15 bp, Homo sapiens
tgacctcgtgatcag

SEQ ID NO: 10313 - DNA, 15 bp, Homo sapiens
ctgacctcgtgatca

SEQ ID NO: 10314 - DNA, 15 bp, Homo sapiens
cctgacctcgtgatc

SEQ ID NO: 10315 - DNA, 15 bp, Homo sapiens
tcctgacctcgtgat

SEQ ID NO: 10316 - DNA, 15 bp, Homo sapiens
ctcctgacctcgtga

SEQ ID NO: 10317 - DNA, 15 bp, Homo sapiens
tctcctgacctcgtg

SEQ ID NO: 10318 - DNA, 15 bp, Homo sapiens
atctcctgacctcgt

SEQ ID NO: 10319 - DNA, 15 bp, Homo sapiens
gatctcctgacctcg

SEQ ID NO: 10320 - DNA, 15 bp, Homo sapiens
cgatctcctgacctc

SEQ ID NO: 10321 - DNA, 15 bp, Homo sapiens
tcgatctcctgacct

SEQ ID NO: 10322 - DNA, 15 bp, Homo sapiens
ctcgatctcctgacc

SEQ ID NO: 10323 - DNA, 15 bp, Homo sapiens
tctcgatctcctgac

SEQ ID NO: 10324 - DNA, 15 bp, Homo sapiens
gtctcgatctcctga

SEQ ID NO: 10325 - DNA, 15 bp, Homo sapiens
ggtctcgatctcctg

SEQ ID NO: 10326 - DNA, 15 bp, Homo sapiens
tggtctcgatctcct

SEQ ID NO: 10327 - DNA, 15 bp, Homo sapiens
atggtctcgatctcc

SEQ ID NO: 10328 - DNA, 15 bp, Homo sapiens
ggatggtctcgatct

SEQ ID NO: 10329 - DNA, 15 bp, Homo sapiens
aggatggtctcgatc

SEQ ID NO: 10330 - DNA, 15 bp, Homo sapiens
caggatggtctcgat

SEQ ID NO: 10331 - DNA, 15 bp, Homo sapiens
ccaggatggtctcga

SEQ ID NO: 10332 - DNA, 15 bp, Homo sapiens
gccaggatggtctcg

SEQ ID NO: 10333 - DNA, 15 bp, Homo sapiens
cgccaggatggtctc

SEQ ID NO: 10334 - DNA, 15 bp, Homo sapiens
tcgccaggatggtct

SEQ ID NO: 10335 - DNA, 15 bp, Homo sapiens
ctcgccaggatggtc

SEQ ID NO: 10336 - DNA, 15 bp, Homo sapiens
gctcgccaggatggt

SEQ ID NO: 10337 - DNA, 15 bp, Homo sapiens
tgctcgccaggatgg

SEQ ID NO: 10338 - DNA, 15 bp, Homo sapiens
gtgctcgccaggatg

SEQ ID NO: 10339 - DNA, 15 bp, Homo sapiens
cgtgctcgccaggat

SEQ ID NO: 10340 - DNA, 15 bp, Homo sapiens
ccgtgctcgccagga

SEQ ID NO: 10341 - DNA, 15 bp, Homo sapiens
accgtgctcgccagg

SEQ ID NO: 10342 - DNA, 15 bp, Homo sapiens
caccgtgctcgccag

SEQ ID NO: 10343 - DNA, 15 bp, Homo sapiens
tcaccgtgctcgcca

SEQ ID NO: 10344 - DNA, 15 bp, Homo sapiens
ttcaccgtgctcgcc

SEQ ID NO: 10345 - DNA, 15 bp, Homo sapiens
tttcaccgtgctcgc

SEQ ID NO: 10346 - DNA, 15 bp, Homo sapiens
gtttcaccgtgctcg

SEQ ID NO: 10347 - DNA, 15 bp, Homo sapiens
ggtttcaccgtgctc

SEQ ID NO: 10348 - DNA, 15 bp, Homo sapiens
aggtttcaccgtgct

SEQ ID NO: 10349 - DNA, 15 bp, Homo sapiens
gaggtttcaccgtgc

SEQ ID NO: 10350 - DNA, 15 bp, Homo sapiens
cgaggtttcaccgtg

SEQ ID NO: 10351 - DNA, 15 bp, Homo sapiens
acgaggtttcaccgt

SEQ ID NO: 10352 - DNA, 15 bp, Homo sapiens
gacgaggtttcaccg

SEQ ID NO: 10353 - DNA, 15 bp, Homo sapiens
agacgaggtttcacc

SEQ ID NO: 10354 - DNA, 15 bp, Homo sapiens
aagacgaggtttcac

SEQ ID NO: 10355 - DNA, 15 bp, Homo sapiens
aaagacgaggtttca

SEQ ID NO: 10356 - DNA, 15 bp, Homo sapiens
taaagacgaggtttc

SEQ ID NO: 10357 - DNA, 15 bp, Homo sapiens
gtaaagacgaggttt

SEQ ID NO: 10358 - DNA, 15 bp, Homo sapiens
agtaaagacgaggtt

SEQ ID NO: 10359 - DNA, 15 bp, Homo sapiens
tagtaaagacgaggt

SEQ ID NO: 10360 - DNA, 15 bp, Homo sapiens
ttagtaaagacgagg

SEQ ID NO: 10361 - DNA, 15 bp, Homo sapiens
tttagtaaagacgag

SEQ ID NO: 10362 - DNA, 15 bp, Homo sapiens
ttttagtaaagacga

SEQ ID NO: 10363 - DNA, 15 bp, Homo sapiens
tttttagtaaagacg

SEQ ID NO: 10364 - DNA, 15 bp, Homo sapiens
atttttagtaaagac

SEQ ID NO: 10365 - DNA, 15 bp, Homo sapiens
tatttttagtaaaga

SEQ ID NO: 10366 - DNA, 15 bp, Homo sapiens
gtatttttagtaaag

SEQ ID NO: 10367 - DNA, 15 bp, Homo sapiens
tgtatttttagtaaa

SEQ ID NO: 10368 - DNA, 15 bp, Homo sapiens
ttgtatttttagtaa

SEQ ID NO: 10369 - DNA, 15 bp, Homo sapiens
cgcccgccaccatgc

SEQ ID NO: 10370 - DNA, 15 bp, Homo sapiens
gcgcccgccaccatg

SEQ ID NO: 10371 - DNA, 15 bp, Homo sapiens
ggcgcccgccaccat

SEQ ID NO: 10372 - DNA, 15 bp, Homo sapiens
aggcgcccgccacca

SEQ ID NO: 10373 - DNA, 15 bp, Homo sapiens
caggcgcccgccacc

SEQ ID NO: 10374 - DNA, 15 bp, Homo sapiens
acaggcgcccgccac

SEQ ID NO: 10375 - DNA, 15 bp, Homo sapiens
tacaggcgcccgcca

SEQ ID NO: 10376 - DNA, 15 bp, Homo sapiens
ctacaggcgcccgcc

SEQ ID NO: 10377 - DNA, 15 bp, Homo sapiens
actacaggcgcccgc

SEQ ID NO: 10378 - DNA, 15 bp, Homo sapiens
gactacaggcgcccg

SEQ ID NO: 10379 - DNA, 15 bp, Homo sapiens
ggactacaggcgccc

SEQ ID NO: 10380 - DNA, 15 bp, Homo sapiens
gggactacaggcgcc

SEQ ID NO: 10381 - DNA, 15 bp, Homo sapiens
tgggactacaggcgc

SEQ ID NO: 10382 - DNA, 15 bp, Homo sapiens
agagtagctgggact

SEQ ID NO: 10383 - DNA, 15 bp, Homo sapiens
cagagtagctgggac

SEQ ID NO: 10384 - DNA, 15 bp, Homo sapiens
tcagagtagctggga

SEQ ID NO: 10385 - DNA, 15 bp, Homo sapiens
ctcagagtagctggg

SEQ ID NO: 10386 - DNA, 15 bp, Homo sapiens
tctcagagtagctgg

SEQ ID NO: 10387 - DNA, 15 bp, Homo sapiens
ctctcagagtagctg

SEQ ID NO: 10388 - DNA, 15 bp, Homo sapiens
gctctcagagtagct

SEQ ID NO: 10389 - DNA, 15 bp, Homo sapiens
ggctctcagagtagc

SEQ ID NO: 10390 - DNA, 15 bp, Homo sapiens
aggctctcagagtag

SEQ ID NO: 10391 - DNA, 15 bp, Homo sapiens
caggctctcagagta

SEQ ID NO: 10392 - DNA, 15 bp, Homo sapiens
tcaggctctcagagt

SEQ ID NO: 10393 - DNA, 15 bp, Homo sapiens
ctcaggctctcagag

SEQ ID NO: 10394 - DNA, 15 bp, Homo sapiens
cctcaggctctcaga

SEQ ID NO: 10395 - DNA, 15 bp, Homo sapiens
gcctcaggctctcag

SEQ ID NO: 10396 - DNA, 15 bp, Homo sapiens
tgcctcaggctctca

SEQ ID NO: 10397 - DNA, 15 bp, Homo sapiens
ctgcctcaggctctc

SEQ ID NO: 10398 - DNA, 15 bp, Homo sapiens
cctgcctcaggctct

SEQ ID NO: 10399 - DNA, 15 bp, Homo sapiens
tcctgcctcaggctc

SEQ ID NO: 10400 - DNA, 15 bp, Homo sapiens
ctcctgcctcaggct

SEQ ID NO: 10401 - DNA, 15 bp, Homo sapiens
tctcctgcctcaggc

SEQ ID NO: 10402 - DNA, 15 bp, Homo sapiens
ttctcctgcctcagg

SEQ ID NO: 10403 - DNA, 15 bp, Homo sapiens
cattctcctgcctca

SEQ ID NO: 10404 - DNA, 15 bp, Homo sapiens
ccattctcctgcctc

SEQ ID NO: 10405 - DNA, 15 bp, Homo sapiens
gccattctcctgcct

SEQ ID NO: 10406 - DNA, 15 bp, Homo sapiens
cgccattctcctgcc

SEQ ID NO: 10407 - DNA, 15 bp, Homo sapiens
acgccattctcctgc

SEQ ID NO: 10408 - DNA, 15 bp, Homo sapiens
cacgccattctcctg

SEQ ID NO: 10409 - DNA, 15 bp, Homo sapiens
tcacgccattctcct

SEQ ID NO: 10410 - DNA, 15 bp, Homo sapiens
ttcacgccattctcc

SEQ ID NO: 10411 - DNA, 15 bp, Homo sapiens
gttcacgccattctc

SEQ ID NO: 10412 - DNA, 15 bp, Homo sapiens
ggttcacgccattct

SEQ ID NO: 10413 - DNA, 15 bp, Homo sapiens
gggttcacgccattc

SEQ ID NO: 10414 - DNA, 15 bp, Homo sapiens
tgggttcacgccatt

SEQ ID NO: 10415 - DNA, 15 bp, Homo sapiens
ctgggttcacgccat

SEQ ID NO: 10416 - DNA, 15 bp, Homo sapiens
cctgggttcacgcca

SEQ ID NO: 10417 - DNA, 15 bp, Homo sapiens
tcctgggttcacgcc

SEQ ID NO: 10418 - DNA, 15 bp, Homo sapiens
ctcctgggttcacgc

SEQ ID NO: 10419 - DNA, 15 bp, Homo sapiens
cctcctgggttcacg

SEQ ID NO: 10420 - DNA, 15 bp, Homo sapiens
gcctcctgggttcac

SEQ ID NO: 10421 - DNA, 15 bp, Homo sapiens
cgcctcctgggttca

SEQ ID NO: 10422 - DNA, 15 bp, Homo sapiens
ccgcctcctgggttc

SEQ ID NO: 10423 - DNA, 15 bp, Homo sapiens
tccgcctcctgggtt

SEQ ID NO: 10424 - DNA, 15 bp, Homo sapiens
ctccgcctcctgggt

SEQ ID NO: 10425 - DNA, 15 bp, Homo sapiens
gctccgcctcctggg

SEQ ID NO: 10426 - DNA, 15 bp, Homo sapiens
agctccgcctcctgg

SEQ ID NO: 10427 - DNA, 15 bp, Homo sapiens
aagctccgcctcctg

SEQ ID NO: 10428 - DNA, 15 bp, Homo sapiens
caagctccgcctcct

SEQ ID NO: 10429 - DNA, 15 bp, Homo sapiens
gcaagctccgcctcc

SEQ ID NO: 10430 - DNA, 15 bp, Homo sapiens
tgcaagctccgcctc

SEQ ID NO: 10431 - DNA, 15 bp, Homo sapiens
ctgcaagctccgcct

SEQ ID NO: 10432 - DNA, 15 bp, Homo sapiens
actgcaagctccgcc

SEQ ID NO: 10433 - DNA, 15 bp, Homo sapiens
cactgcaagctccgc

SEQ ID NO: 10434 - DNA, 15 bp, Homo sapiens
tcactgcaagctccg

SEQ ID NO: 10435 - DNA, 15 bp, Homo sapiens
ctcactgcaagctcc

SEQ ID NO: 10436 - DNA, 15 bp, Homo sapiens
gctcactgcaagctc

SEQ ID NO: 10437 - DNA, 15 bp, Homo sapiens
ggctcactgcaagct

SEQ ID NO: 10438 - DNA, 15 bp, Homo sapiens
cggctcactgcaagc

SEQ ID NO: 10439 - DNA, 15 bp, Homo sapiens
tcggctcactgcaag

SEQ ID NO: 10440 - DNA, 15 bp, Homo sapiens
gatctcggctcactg

SEQ ID NO: 10441 - DNA, 15 bp, Homo sapiens
cgatctcggctcact

SEQ ID NO: 10442 - DNA, 15 bp, Homo sapiens
gcgatctcggctcac

SEQ ID NO: 10443 - DNA, 15 bp, Homo sapiens
cgcgatctcggctca

SEQ ID NO: 10444 - DNA, 15 bp, Homo sapiens
acgcgatctcggctc

SEQ ID NO: 10445 - DNA, 15 bp, Homo sapiens
gacgcgatctcggct

SEQ ID NO: 10446 - DNA, 15 bp, Homo sapiens
tgacgcgatctcggc

SEQ ID NO: 10447 - DNA, 15 bp, Homo sapiens
gtgacgcgatctcgg

SEQ ID NO: 10448 - DNA, 15 bp, Homo sapiens
agtgacgcgatctcg

SEQ ID NO: 10449 - DNA, 15 bp, Homo sapiens
cagtgacgcgatctc

SEQ ID NO: 10450 - DNA, 15 bp, Homo sapiens
gcagtgacgcgatct

SEQ ID NO: 10451 - DNA, 15 bp, Homo sapiens
tgcagtgacgcgatc

SEQ ID NO: 10452 - DNA, 15 bp, Homo sapiens
gtgcagtgacgcgat

SEQ ID NO: 10453 - DNA, 15 bp, Homo sapiens
agtgcagtgacgcga

SEQ ID NO: 10454 - DNA, 15 bp, Homo sapiens
gagtgcagtgacgcg

SEQ ID NO: 10455 - DNA, 15 bp, Homo sapiens
ggagtgcagtgacgc

SEQ ID NO: 10456 - DNA, 15 bp, Homo sapiens
tggagtgcagtgacg

SEQ ID NO: 10457 - DNA, 15 bp, Homo sapiens
ctggagtgcagtgac

SEQ ID NO: 10458 - DNA, 15 bp, Homo sapiens
gctggagtgcagtga

SEQ ID NO: 10459 - DNA, 15 bp, Homo sapiens
gtctgtcgcccaggc

SEQ ID NO: 10460 - DNA, 15 bp, Homo sapiens
ggtctgtcgcccagg

SEQ ID NO: 10461 - DNA, 15 bp, Homo sapiens
cggtctgtcgcccag

SEQ ID NO: 10462 - DNA, 15 bp, Homo sapiens
tcggtctgtcgccca

SEQ ID NO: 10463 - DNA, 15 bp, Homo sapiens
ctcggtctgtcgccc

SEQ ID NO: 10464 - DNA, 15 bp, Homo sapiens
tctcggtctgtcgcc

SEQ ID NO: 10465 - DNA, 15 bp, Homo sapiens
gtctcggtctgtcgc

SEQ ID NO: 10466 - DNA, 15 bp, Homo sapiens
agtctcggtctgtcg

SEQ ID NO: 10467 - DNA, 15 bp, Homo sapiens
gagtctcggtctgtc

SEQ ID NO: 10468 - DNA, 15 bp, Homo sapiens
ggagtctcggtctgt

SEQ ID NO: 10469 - DNA, 15 bp, Homo sapiens
cggagtctcggtctg

SEQ ID NO: 10470 - DNA, 15 bp, Homo sapiens
acggagtctcggtct

SEQ ID NO: 10471 - DNA, 15 bp, Homo sapiens
gacggagtctcggtc

SEQ ID NO: 10472 - DNA, 15 bp, Homo sapiens
agacggagtctcggt

SEQ ID NO: 10473 - DNA, 15 bp, Homo sapiens
gagacggagtctcgg

SEQ ID NO: 10474 - DNA, 15 bp, Homo sapiens
tgagacggagtctcg

SEQ ID NO: 10475 - DNA, 15 bp, Homo sapiens
ttgagacggagtctc

SEQ ID NO: 10476 - DNA, 15 bp, Homo sapiens
tttgagacggagtct

SEQ ID NO: 10477 - DNA, 15 bp, Homo sapiens
ttttgagacggagtc

SEQ ID NO: 10478 - DNA, 15 bp, Homo sapiens
attttttgagacgga

SEQ ID NO: 10479 - DNA, 15 bp, Homo sapiens
tattttttgagacgg

SEQ ID NO: 10480 - DNA, 15 bp, Homo sapiens
atattttttgagacg

SEQ ID NO: 10481 - DNA, 15 bp, Homo sapiens
tatattttttgagac

SEQ ID NO: 10482 - DNA, 15 bp, Homo sapiens
atatattttttgaga

SEQ ID NO: 10483 - DNA, 15 bp, Homo sapiens
tatatattttttgag

SEQ ID NO: 10484 - DNA, 15 bp, Homo sapiens
atatatattttttga

SEQ ID NO: 10485 - DNA, 15 bp, Homo sapiens
gatatatattttttg

SEQ ID NO: 10486 - DNA, 15 bp, Homo sapiens
cgatatatatttttt

SEQ ID NO: 10487 - DNA, 15 bp, Homo sapiens
tcgatatatattttt

SEQ ID NO: 10488 - DNA, 15 bp, Homo sapiens
atcgatatatatttt

SEQ ID NO: 10489 - DNA, 15 bp, Homo sapiens
tatcgatatatattt

SEQ ID NO: 10490 - DNA, 15 bp, Homo sapiens
atatcgatatatatt

SEQ ID NO: 10491 - DNA, 15 bp, Homo sapiens
tatatcgatatatat

SEQ ID NO: 10492 - DNA, 15 bp, Homo sapiens
atatatcgatatata

SEQ ID NO: 10493 - DNA, 15 bp, Homo sapiens
tatatatcgatatat

SEQ ID NO: 10494 - DNA, 15 bp, Homo sapiens
atatatatcgatata

SEQ ID NO: 10495 - DNA, 15 bp, Homo sapiens
tatatatatcgatat

SEQ ID NO: 10496 - DNA, 15 bp, Homo sapiens
ttatatatatcgata

SEQ ID NO: 10497 - DNA, 15 bp, Homo sapiens
gttatatatatcgat

SEQ ID NO: 10498 - DNA, 15 bp, Homo sapiens
tgttatatatatcga

SEQ ID NO: 10499 - DNA, 15 bp, Homo sapiens
ttgttatatatatcg

SEQ ID NO: 10500 - DNA, 15 bp, Homo sapiens
attgttatatatatc

SEQ ID NO: 10501 - DNA, 15 bp, Homo sapiens
aattgttatatatat

SEQ ID NO: 10502 - DNA, 15 bp, Homo sapiens
aaattgttatatata

SEQ ID NO: 10503 - DNA, 15 bp, Homo sapiens
taaattgttatatat

SEQ ID NO: 10504 - DNA, 15 bp, Homo sapiens
gtaaattgttatata

SEQ ID NO: 10505 - DNA, 15 bp, Homo sapiens
tgtaaattgttatat

SEQ ID NO: 10506 - DNA, 15 bp, Homo sapiens
ctgtaaattgttata

SEQ ID NO: 10507 - DNA, 15 bp, Homo sapiens
actgtaaattgttat

SEQ ID NO: 10508 - DNA, 15 bp, Homo sapiens
aactgtaaattgtta

SEQ ID NO: 10509 - DNA, 15 bp, Homo sapiens
aaactgtaaattgtt

SEQ ID NO: 10510 - DNA, 15 bp, Homo sapiens
aaaactgtaaattgt

SEQ ID NO: 10511 - DNA, 15 bp, Homo sapiens
taaaactgtaaattg

SEQ ID NO: 10512 - DNA, 15 bp, Homo sapiens
ttaaaactgtaaatt

SEQ ID NO: 10513 - DNA, 15 bp, Homo sapiens
attaaaactgtaaat

SEQ ID NO: 10514 - DNA, 15 bp, Homo sapiens
gattaaaactgtaaa

SEQ ID NO: 10515 - DNA, 15 bp, Homo sapiens
tgattaaaactgtaa

SEQ ID NO: 10516 - DNA, 15 bp, Homo sapiens
atgattaaaactgta

SEQ ID NO: 10517 - DNA, 15 bp, Homo sapiens
gatgattaaaactgt

SEQ ID NO: 10518 - DNA, 15 bp, Homo sapiens
agatgattaaaactg

SEQ ID NO: 10519 - DNA, 15 bp, Homo sapiens
aagatgattaaaact

SEQ ID NO: 10520 - DNA, 15 bp, Homo sapiens
taagatgattaaaac

SEQ ID NO: 10521 - DNA, 15 bp, Homo sapiens
ttaagatgattaaaa

SEQ ID NO: 10522 - DNA, 15 bp, Homo sapiens
gttaagatgattaaa

SEQ ID NO: 10523 - DNA, 15 bp, Homo sapiens
agttaagatgattaa

SEQ ID NO: 10524 - DNA, 15 bp, Homo sapiens
cagttaagatgatta

SEQ ID NO: 10525 - DNA, 15 bp, Homo sapiens
acagttaagatgatt

SEQ ID NO: 10526 - DNA, 15 bp, Homo sapiens
tacagttaagatgat

SEQ ID NO: 10527 - DNA, 15 bp, Homo sapiens
gtacagttaagatga

SEQ ID NO: 10528 - DNA, 15 bp, Homo sapiens
tgtacagttaagatg

SEQ ID NO: 10529 - DNA, 15 bp, Homo sapiens
ctgtacagttaagat

SEQ ID NO: 10530 - DNA, 15 bp, Homo sapiens
actgtacagttaaga

SEQ ID NO: 10531 - DNA, 15 bp, Homo sapiens
aactgtacagttaag

SEQ ID NO: 10532 - DNA, 15 bp, Homo sapiens
gaactgtacagttaa

SEQ ID NO: 10533 - DNA, 15 bp, Homo sapiens
tgaactgtacagtta

SEQ ID NO: 10534 - DNA, 15 bp, Homo sapiens
ctgaactgtacagtt

SEQ ID NO: 10535 - DNA, 15 bp, Homo sapiens
actgaactgtacagt

SEQ ID NO: 10536 - DNA, 15 bp, Homo sapiens
cactgaactgtacag

SEQ ID NO: 10537 - DNA, 15 bp, Homo sapiens
ccactgaactgtaca

SEQ ID NO: 10538 - DNA, 15 bp, Homo sapiens
gccactgaactgtac

SEQ ID NO: 10539 - DNA, 15 bp, Homo sapiens
tgccactgaactgta

SEQ ID NO: 10540 - DNA, 15 bp, Homo sapiens
gtgccactgaactgt

SEQ ID NO: 10541 - DNA, 15 bp, Homo sapiens
agtgccactgaactg

SEQ ID NO: 10542 - DNA, 15 bp, Homo sapiens
cagtgccactgaact

SEQ ID NO: 10543 - DNA, 15 bp, Homo sapiens
tcagtgccactgaac

SEQ ID NO: 10544 - DNA, 15 bp, Homo sapiens
ctcagtgccactgaa

SEQ ID NO: 10545 - DNA, 15 bp, Homo sapiens
actcagtgccactga

SEQ ID NO: 10546 - DNA, 15 bp, Homo sapiens
tactcagtgccactg

SEQ ID NO: 10547 - DNA, 15 bp, Homo sapiens
gtactcagtgccact

SEQ ID NO: 10548 - DNA, 15 bp, Homo sapiens
tgtactcagtgccac

SEQ ID NO: 10549 - DNA, 15 bp, Homo sapiens
atgtactcagtgcca

SEQ ID NO: 10550 - DNA, 15 bp, Homo sapiens
aatgtactcagtgcc

SEQ ID NO: 10551 - DNA, 15 bp, Homo sapiens
gaatgtactcagtgc

SEQ ID NO: 10552 - DNA, 15 bp, Homo sapiens
tgaatgtactcagtg

SEQ ID NO: 10553 - DNA, 15 bp, Homo sapiens
gtgaatgtactcagt

SEQ ID NO: 10554 - DNA, 15 bp, Homo sapiens
tgtgaatgtactcag

SEQ ID NO: 10555 - DNA, 15 bp, Homo sapiens
atgtgaatgtactca

SEQ ID NO: 10556 - DNA, 15 bp, Homo sapiens
aatgtgaatgtactc

SEQ ID NO: 10557 - DNA, 15 bp, Homo sapiens
caatgtgaatgtact

SEQ ID NO: 10558 - DNA, 15 bp, Homo sapiens
acaatgtgaatgtac

SEQ ID NO: 10559 - DNA, 15 bp, Homo sapiens
aacaatgtgaatgta

SEQ ID NO: 10560 - DNA, 15 bp, Homo sapiens
caacaatgtgaatgt

SEQ ID NO: 10561 - DNA, 15 bp, Homo sapiens
acaacaatgtgaatg

SEQ ID NO: 10562 - DNA, 15 bp, Homo sapiens
tacaacaatgtgaat

SEQ ID NO: 10563 - DNA, 15 bp, Homo sapiens
gtacaacaatgtgaa

SEQ ID NO: 10564 - DNA, 15 bp, Homo sapiens
tgtacaacaatgtga

SEQ ID NO: 10565 - DNA, 15 bp, Homo sapiens
ctgtacaacaatgtg

SEQ ID NO: 10566 - DNA, 15 bp, Homo sapiens
gctgtacaacaatgt

SEQ ID NO: 10567 - DNA, 15 bp, Homo sapiens
ggctgtacaacaatg

SEQ ID NO: 10568 - DNA, 15 bp, Homo sapiens
tggctgtacaacaat

SEQ ID NO: 10569 - DNA, 15 bp, Homo sapiens
atggctgtacaacaa

SEQ ID NO: 10570 - DNA, 15 bp, Homo sapiens
aatggctgtacaaca

SEQ ID NO: 10571 - DNA, 15 bp, Homo sapiens
taatggctgtacaac

SEQ ID NO: 10572 - DNA, 15 bp, Homo sapiens
gtaatggctgtacaa

SEQ ID NO: 10573 - DNA, 15 bp, Homo sapiens
agtaatggctgtaca

SEQ ID NO: 10574 - DNA, 15 bp, Homo sapiens
tagtaatggctgtac

SEQ ID NO: 10575 - DNA, 15 bp, Homo sapiens
gtagtaatggctgta

SEQ ID NO: 10576 - DNA, 15 bp, Homo sapiens
ggtagtaatggctgt

SEQ ID NO: 10577 - DNA, 15 bp, Homo sapiens
tggtagtaatggctg

SEQ ID NO: 10578 - DNA, 15 bp, Homo sapiens
atggtagtaatggct

SEQ ID NO: 10579 - DNA, 15 bp, Homo sapiens
gatggtagtaatggc

SEQ ID NO: 10580 - DNA, 15 bp, Homo sapiens
ggatggtagtaatgg

SEQ ID NO: 10581 - DNA, 15 bp, Homo sapiens
tggatggtagtaatg

SEQ ID NO: 10582 - DNA, 15 bp, Homo sapiens
atggatggtagtaat

SEQ ID NO: 10583 - DNA, 15 bp, Homo sapiens
gatggatggtagtaa

SEQ ID NO: 10584 - DNA, 15 bp, Homo sapiens
agatggatggtagta

SEQ ID NO: 10585 - DNA, 15 bp, Homo sapiens
gagatggatggtagt

SEQ ID NO: 10586 - DNA, 15 bp, Homo sapiens
agagatggatggtag

SEQ ID NO: 10587 - DNA, 15 bp, Homo sapiens
tagagatggatggta

SEQ ID NO: 10588 - DNA, 15 bp, Homo sapiens
gtagagatggatggt

SEQ ID NO: 10589 - DNA, 15 bp, Homo sapiens
tgtagagatggatgg

SEQ ID NO: 10590 - DNA, 15 bp, Homo sapiens
ttgtagagatggatg

SEQ ID NO: 10591 - DNA, 15 bp, Homo sapiens
gttgtagagatggat

SEQ ID NO: 10592 - DNA, 15 bp, Homo sapiens
ggttgtagagatgga

SEQ ID NO: 10593 - DNA, 15 bp, Homo sapiens
aggttgtagagatgg

SEQ ID NO: 10594 - DNA, 15 bp, Homo sapiens
aaggttgtagagatg

SEQ ID NO: 10595 - DNA, 15 bp, Homo sapiens
aaaggttgtagagat

SEQ ID NO: 10596 - DNA, 15 bp, Homo sapiens
gaaaggttgtagaga

SEQ ID NO: 10597 - DNA, 15 bp, Homo sapiens
cgaaaggttgtagag

SEQ ID NO: 10598 - DNA, 15 bp, Homo sapiens
acgaaaggttgtaga

SEQ ID NO: 10599 - DNA, 15 bp, Homo sapiens
gacgaaaggttgtag

SEQ ID NO: 10600 - DNA, 15 bp, Homo sapiens
agacgaaaggttgta

SEQ ID NO: 10601 - DNA, 15 bp, Homo sapiens
aagacgaaaggttgt

SEQ ID NO: 10602 - DNA, 15 bp, Homo sapiens
caagacgaaaggttg

SEQ ID NO: 10603 - DNA, 15 bp, Homo sapiens
gcaagacgaaaggtt

SEQ ID NO: 10604 - DNA, 15 bp, Homo sapiens
tgcaagacgaaaggt

SEQ ID NO: 10605 - DNA, 15 bp, Homo sapiens
ttgcaagacgaaagg

SEQ ID NO: 10606 - DNA, 15 bp, Homo sapiens
tttgcaagacgaaag

SEQ ID NO: 10607 - DNA, 15 bp, Homo sapiens
ttttgcaagacgaaa

SEQ ID NO: 10608 - DNA, 15 bp, Homo sapiens
gttttgcaagacgaa

SEQ ID NO: 10609 - DNA, 15 bp, Homo sapiens
agttttgcaagacga

SEQ ID NO: 10610 - DNA, 15 bp, Homo sapiens
cagttttgcaagacg

SEQ ID NO: 10611 - DNA, 15 bp, Homo sapiens
tcagttttgcaagac

SEQ ID NO: 10612 - DNA, 15 bp, Homo sapiens
ttcagttttgcaaga

SEQ ID NO: 10613 - DNA, 15 bp, Homo sapiens
tttcagttttgcaag

SEQ ID NO: 10614 - DNA, 15 bp, Homo sapiens
atttcagttttgcaa

SEQ ID NO: 10615 - DNA, 15 bp, Homo sapiens
aatttcagttttgca

SEQ ID NO: 10616 - DNA, 15 bp, Homo sapiens
aaatttcagttttgc

SEQ ID NO: 10617 - DNA, 15 bp, Homo sapiens
gaaatttcagttttg

SEQ ID NO: 10618 - DNA, 15 bp, Homo sapiens
tgaaatttcagtttt

SEQ ID NO: 10619 - DNA, 15 bp, Homo sapiens
atgaaatttcagttt

SEQ ID NO: 10620 - DNA, 15 bp, Homo sapiens
tatgaaatttcagtt

SEQ ID NO: 10621 - DNA, 15 bp, Homo sapiens
gtatgaaatttcagt

SEQ ID NO: 10622 - DNA, 15 bp, Homo sapiens
ggtatgaaatttcag

SEQ ID NO: 10623 - DNA, 15 bp, Homo sapiens
aggtatgaaatttca

SEQ ID NO: 10624 - DNA, 15 bp, Homo sapiens
taggtatgaaatttc

SEQ ID NO: 10625 - DNA, 15 bp, Homo sapiens
ataggtatgaaattt

SEQ ID NO: 10626 - DNA, 15 bp, Homo sapiens
aataggtatgaaatt

SEQ ID NO: 10627 - DNA, 15 bp, Homo sapiens
taataggtatgaaat

SEQ ID NO: 10628 - DNA, 15 bp, Homo sapiens
ttaataggtatgaaa

SEQ ID NO: 10629 - DNA, 15 bp, Homo sapiens
tttaataggtatgaa

SEQ ID NO: 10630 - DNA, 15 bp, Homo sapiens
gtttaataggtatga

SEQ ID NO: 10631 - DNA, 15 bp, Homo sapiens
tgtttaataggtatg

SEQ ID NO: 10632 - DNA, 15 bp, Homo sapiens
gtgtttaataggtat

SEQ ID NO: 10633 - DNA, 15 bp, Homo sapiens
agtgtttaataggta

SEQ ID NO: 10634 - DNA, 15 bp, Homo sapiens
tagtgtttaataggt

SEQ ID NO: 10635 - DNA, 15 bp, Homo sapiens
ttagtgtttaatagg

SEQ ID NO: 10636 - DNA, 15 bp, Homo sapiens
gttagtgtttaatag

SEQ ID NO: 10637 - DNA, 15 bp, Homo sapiens
agttagtgtttaata

SEQ ID NO: 10638 - DNA, 15 bp, Homo sapiens
gagttagtgtttaat

SEQ ID NO: 10639 - DNA, 15 bp, Homo sapiens
ggagttagtgtttaa

SEQ ID NO: 10640 - DNA, 15 bp, Homo sapiens
gggagttagtgttta

SEQ ID NO: 10641 - DNA, 15 bp, Homo sapiens
tgggagttagtgttt

SEQ ID NO: 10642 - DNA, 15 bp, Homo sapiens
gtgggagttagtgtt

SEQ ID NO: 10643 - DNA, 15 bp, Homo sapiens
agtgggagttagtgt

SEQ ID NO: 10644 - DNA, 15 bp, Homo sapiens
aagtgggagttagtg

SEQ ID NO: 10645 - DNA, 15 bp, Homo sapiens
gaagtgggagttagt

SEQ ID NO: 10646 - DNA, 15 bp, Homo sapiens
agaagtgggagttag

SEQ ID NO: 10647 - DNA, 15 bp, Homo sapiens
gagaagtgggagtta

SEQ ID NO: 10648 - DNA, 15 bp, Homo sapiens
ggagaagtgggagtt

SEQ ID NO: 10649 - DNA, 15 bp, Homo sapiens
gggagaagtgggagt

SEQ ID NO: 10650 - DNA, 15 bp, Homo sapiens
ggggagaagtgggag

SEQ ID NO: 10651 - DNA, 15 bp, Homo sapiens
aggggagaagtggga

SEQ ID NO: 10652 - DNA, 15 bp, Homo sapiens
aaggggagaagtggg

SEQ ID NO: 10653 - DNA, 15 bp, Homo sapiens
aaaggggagaagtgg

SEQ ID NO: 10654 - DNA, 15 bp, Homo sapiens
gaaaggggagaagtg

SEQ ID NO: 10655 - DNA, 15 bp, Homo sapiens
ggaaaggggagaagt

SEQ ID NO: 10656 - DNA, 15 bp, Homo sapiens
gggaaaggggagaag

SEQ ID NO: 10657 - DNA, 15 bp, Homo sapiens
ggggaaaggggagaa

SEQ ID NO: 10658 - DNA, 15 bp, Homo sapiens
gggggaaaggggaga

SEQ ID NO: 10659 - DNA, 15 bp, Homo sapiens
tgggggaaaggggag

SEQ ID NO: 10660 - DNA, 15 bp, Homo sapiens
gtgggggaaagggga

SEQ ID NO: 10661 - DNA, 15 bp, Homo sapiens
ggtgggggaaagggg

SEQ ID NO: 10662 - DNA, 15 bp, Homo sapiens
gggtgggggaaaggg

SEQ ID NO: 10663 - DNA, 15 bp, Homo sapiens
ggggtgggggaaagg

SEQ ID NO: 10664 - DNA, 15 bp, Homo sapiens
tggggtgggggaaag

SEQ ID NO: 10665 - DNA, 15 bp, Homo sapiens
gtggggtgggggaaa

SEQ ID NO: 10666 - DNA, 15 bp, Homo sapiens
ggtggggtgggggaa

SEQ ID NO: 10667 - DNA, 15 bp, Homo sapiens
gggtggggtggggga

SEQ ID NO: 10668 - DNA, 15 bp, Homo sapiens
agggtggggtggggg

SEQ ID NO: 10669 - DNA, 15 bp, Homo sapiens
gagggtggggtgggg

SEQ ID NO: 10670 - DNA, 15 bp, Homo sapiens
agagggtggggtggg

SEQ ID NO: 10671 - DNA, 15 bp, Homo sapiens
cagagggtggggtgg

SEQ ID NO: 10672 - DNA, 15 bp, Homo sapiens
ccagagggtggggtg

SEQ ID NO: 10673 - DNA, 15 bp, Homo sapiens
gccagagggtggggt

SEQ ID NO: 10674 - DNA, 15 bp, Homo sapiens
tgccagagggtgggg

SEQ ID NO: 10675 - DNA, 15 bp, Homo sapiens
ttgccagagggtggg

SEQ ID NO: 10676 - DNA, 15 bp, Homo sapiens
gttgccagagggtgg

SEQ ID NO: 10677 - DNA, 15 bp, Homo sapiens
agttgccagagggtg

SEQ ID NO: 10678 - DNA, 15 bp, Homo sapiens
tagttgccagagggt

SEQ ID NO: 10679 - DNA, 15 bp, Homo sapiens
gtagttgccagaggg

SEQ ID NO: 10680 - DNA, 15 bp, Homo sapiens
agtagttgccagagg

SEQ ID NO: 10681 - DNA, 15 bp, Homo sapiens
tagtagttgccagag

SEQ ID NO: 10682 - DNA, 15 bp, Homo sapiens
atagtagttgccaga

SEQ ID NO: 10683 - DNA, 15 bp, Homo sapiens
aatagtagttgccag

SEQ ID NO: 10684 - DNA, 15 bp, Homo sapiens
gaatagtagttgcca

SEQ ID NO: 10685 - DNA, 15 bp, Homo sapiens
agaatagtagttgcc

SEQ ID NO: 10686 - DNA, 15 bp, Homo sapiens
tagaatagtagttgc

SEQ ID NO: 10687 - DNA, 15 bp, Homo sapiens
gtagaatagtagttg

SEQ ID NO: 10688 - DNA, 15 bp, Homo sapiens
agtagaatagtagtt

SEQ ID NO: 10689 - DNA, 15 bp, Homo sapiens
gagtagaatagtagt

SEQ ID NO: 10690 - DNA, 15 bp, Homo sapiens
agagtagaatagtag

SEQ ID NO: 10691 - DNA, 15 bp, Homo sapiens
aagagtagaatagta

SEQ ID NO: 10692 - DNA, 15 bp, Homo sapiens
aaagagtagaatagt

SEQ ID NO: 10693 - DNA, 15 bp, Homo sapiens
caaagagtagaatag

SEQ ID NO: 10694 - DNA, 15 bp, Homo sapiens
acaaagagtagaata

SEQ ID NO: 10695 - DNA, 15 bp, Homo sapiens
gacaaagagtagaat

SEQ ID NO: 10696 - DNA, 15 bp, Homo sapiens
agacaaagagtagaa

SEQ ID NO: 10697 - DNA, 15 bp, Homo sapiens
gagacaaagagtaga

SEQ ID NO: 10698 - DNA, 15 bp, Homo sapiens
agagacaaagagtag

SEQ ID NO: 10699 - DNA, 15 bp, Homo sapiens
tagagacaaagagta

SEQ ID NO: 10700 - DNA, 15 bp, Homo sapiens
atagagacaaagagt

SEQ ID NO: 10701 - DNA, 15 bp, Homo sapiens
aatagagacaaagag

SEQ ID NO: 10702 - DNA, 15 bp, Homo sapiens
ccaatagagacaaag

SEQ ID NO: 10703 - DNA, 15 bp, Homo sapiens
tccaatagagacaaa

SEQ ID NO: 10704 - DNA, 15 bp, Homo sapiens
gtccaatagagacaa

SEQ ID NO: 10705 - DNA, 15 bp, Homo sapiens
tgtccaatagagaca

SEQ ID NO: 10706 - DNA, 15 bp, Homo sapiens
atgtccaatagagac

SEQ ID NO: 10707 - DNA, 15 bp, Homo sapiens
tatgtccaatagaga

SEQ ID NO: 10708 - DNA, 15 bp, Homo sapiens
atatgtccaatagag

SEQ ID NO: 10709 - DNA, 15 bp, Homo sapiens
aatatgtccaataga

SEQ ID NO: 10710 - DNA, 15 bp, Homo sapiens
aaatatgtccaatag

SEQ ID NO: 10711 - DNA, 15 bp, Homo sapiens
aaaatatgtccaata

SEQ ID NO: 10712 - DNA, 15 bp, Homo sapiens
aaaaatatgtccaat

SEQ ID NO: 10713 - DNA, 15 bp, Homo sapiens
caaaaatatgtccaa

SEQ ID NO: 10714 - DNA, 15 bp, Homo sapiens
acaaaaatatgtcca

SEQ ID NO: 10715 - DNA, 15 bp, Homo sapiens
cacaaaaatatgtcc

SEQ ID NO: 10716 - DNA, 15 bp, Homo sapiens
acacaaaaatatgtc

SEQ ID NO: 10717 - DNA, 15 bp, Homo sapiens
cacacaaaaatatgt

SEQ ID NO: 10718 - DNA, 15 bp, Homo sapiens
acacacaaaaatatg

SEQ ID NO: 10719 - DNA, 15 bp, Homo sapiens
aacacacaaaaatat

SEQ ID NO: 10720 - DNA, 15 bp, Homo sapiens
aaacacacaaaaata

SEQ ID NO: 10721 - DNA, 15 bp, Homo sapiens
taaacacacaaaaat

SEQ ID NO: 10722 - DNA, 15 bp, Homo sapiens
ctaaacacacaaaaa

SEQ ID NO: 10723 - DNA, 15 bp, Homo sapiens
cctaaacacacaaaa

SEQ ID NO: 10724 - DNA, 15 bp, Homo sapiens
acctaaacacacaaa

SEQ ID NO: 10725 - DNA, 15 bp, Homo sapiens
aacctaaacacacaa

SEQ ID NO: 10726 - DNA, 15 bp, Homo sapiens
aaacctaaacacaca

SEQ ID NO: 10727 - DNA, 15 bp, Homo sapiens
caaacctaaacacac

SEQ ID NO: 10728 - DNA, 15 bp, Homo sapiens
acaaacctaaacaca

SEQ ID NO: 10729 - DNA, 15 bp, Homo sapiens
cacaaacctaaacac

SEQ ID NO: 10730 - DNA, 15 bp, Homo sapiens
acacaaacctaaaca

SEQ ID NO: 10731 - DNA, 15 bp, Homo sapiens
tacacaaacctaaac

SEQ ID NO: 10732 - DNA, 15 bp, Homo sapiens
atacacaaacctaaa

SEQ ID NO: 10733 - DNA, 15 bp, Homo sapiens
tatacacaaacctaa

SEQ ID NO: 10734 - DNA, 15 bp, Homo sapiens
atatacacaaaccta

SEQ ID NO: 10735 - DNA, 15 bp, Homo sapiens
tatatacacaaacct

SEQ ID NO: 10736 - DNA, 15 bp, Homo sapiens
atatatacacaaacc

SEQ ID NO: 10737 - DNA, 15 bp, Homo sapiens
aatatatacacaaac

SEQ ID NO: 10738 - DNA, 15 bp, Homo sapiens
aaatatatacacaaa

SEQ ID NO: 10739 - DNA, 15 bp, Homo sapiens
aaaatatatacacaa

SEQ ID NO: 10740 - DNA, 15 bp, Homo sapiens
taaaatatatacaca

SEQ ID NO: 10741 - DNA, 15 bp, Homo sapiens
gtaaaatatatacac

SEQ ID NO: 10742 - DNA, 15 bp, Homo sapiens
tgtaaaatatataca

SEQ ID NO: 10743 - DNA, 15 bp, Homo sapiens
atgtaaaatatatac

SEQ ID NO: 10744 - DNA, 15 bp, Homo sapiens
catgtaaaatatata

SEQ ID NO: 10745 - DNA, 15 bp, Homo sapiens
acatgtaaaatatat

SEQ ID NO: 10746 - DNA, 15 bp, Homo sapiens
cacatgtaaaatata

SEQ ID NO: 10747 - DNA, 15 bp, Homo sapiens
acacatgtaaaatat

SEQ ID NO: 10748 - DNA, 15 bp, Homo sapiens
cacacatgtaaaata

SEQ ID NO: 10749 - DNA, 15 bp, Homo sapiens
acacacatgtaaaat

SEQ ID NO: 10750 - DNA, 15 bp, Homo sapiens
tacacacatgtaaaa

SEQ ID NO: 10751 - DNA, 15 bp, Homo sapiens
atacacacatgtaaa

SEQ ID NO: 10752 - DNA, 15 bp, Homo sapiens
tatacacacatgtaa

SEQ ID NO: 10753 - DNA, 15 bp, Homo sapiens
ttatacacacatgta

SEQ ID NO: 10754 - DNA, 15 bp, Homo sapiens
tttatacacacatgt

SEQ ID NO: 10755 - DNA, 15 bp, Homo sapiens
atttatacacacatg

SEQ ID NO: 10756 - DNA, 15 bp, Homo sapiens
tatttatacacacat

SEQ ID NO: 10757 - DNA, 15 bp, Homo sapiens
gtatttatacacaca

SEQ ID NO: 10758 - DNA, 15 bp, Homo sapiens
tgtatttatacacac

SEQ ID NO: 10759 - DNA, 15 bp, Homo sapiens
gtgtatttatacaca

SEQ ID NO: 10760 - DNA, 15 bp, Homo sapiens
tgtgtatttatacac

SEQ ID NO: 10761 - DNA, 15 bp, Homo sapiens
ttgtgtatttataca

SEQ ID NO: 10762 - DNA, 15 bp, Homo sapiens
cttgtgtatttatac

SEQ ID NO: 10763 - DNA, 15 bp, Homo sapiens
ccttgtgtatttata

SEQ ID NO: 10764 - DNA, 15 bp, Homo sapiens
cccttgtgtatttat

SEQ ID NO: 10765 - DNA, 15 bp, Homo sapiens
acccttgtgtattta

SEQ ID NO: 10766 - DNA, 15 bp, Homo sapiens
tacccttgtgtattt

SEQ ID NO: 10767 - DNA, 15 bp, Homo sapiens
atacccttgtgtatt

SEQ ID NO: 10768 - DNA, 15 bp, Homo sapiens
catacccttgtgtat

SEQ ID NO: 10769 - DNA, 15 bp, Homo sapiens
acatacccttgtgta

SEQ ID NO: 10770 - DNA, 15 bp, Homo sapiens
cacatacccttgtgt

SEQ ID NO: 10771 - DNA, 15 bp, Homo sapiens
ccacatacccttgtg

SEQ ID NO: 10772 - DNA, 15 bp, Homo sapiens
cccacatacccttgt

SEQ ID NO: 10773 - DNA, 15 bp, Homo sapiens
gcccacatacccttg

SEQ ID NO: 10774 - DNA, 15 bp, Homo sapiens
cgcccacataccctt

SEQ ID NO: 10775 - DNA, 15 bp, Homo sapiens
acgcccacataccct

SEQ ID NO: 10776 - DNA, 15 bp, Homo sapiens
aacgcccacataccc

SEQ ID NO: 10777 - DNA, 15 bp, Homo sapiens
caacgcccacatacc

SEQ ID NO: 10778 - DNA, 15 bp, Homo sapiens
acaacgcccacatac

SEQ ID NO: 10779 - DNA, 15 bp, Homo sapiens
cacaacgcccacata

SEQ ID NO: 10780 - DNA, 15 bp, Homo sapiens
acacaacgcccacat

SEQ ID NO: 10781 - DNA, 15 bp, Homo sapiens
aacacaacgcccaca

SEQ ID NO: 10782 - DNA, 15 bp, Homo sapiens
aaacacaacgcccac

SEQ ID NO: 10783 - DNA, 15 bp, Homo sapiens
aaaacacaacgccca

SEQ ID NO: 10784 - DNA, 15 bp, Homo sapiens
aaaaacacaacgccc

SEQ ID NO: 10785 - DNA, 15 bp, Homo sapiens
taaaaacacaacgcc

SEQ ID NO: 10786 - DNA, 15 bp, Homo sapiens
gtaaaaacacaacgc

SEQ ID NO: 10787 - DNA, 15 bp, Homo sapiens
tgtaaaaacacaacg

SEQ ID NO: 10788 - DNA, 15 bp, Homo sapiens
gtgtaaaaacacaac

SEQ ID NO: 10789 - DNA, 15 bp, Homo sapiens
tgtgtaaaaacacaa

SEQ ID NO: 10790 - DNA, 15 bp, Homo sapiens
atgtgtaaaaacaca

SEQ ID NO: 10791 - DNA, 15 bp, Homo sapiens
tatgtgtaaaaacac

SEQ ID NO: 10792 - DNA, 15 bp, Homo sapiens
gtatgtgtaaaaaca

SEQ ID NO: 10793 - DNA, 15 bp, Homo sapiens
agtatgtgtaaaaac

SEQ ID NO: 10794 - DNA, 15 bp, Homo sapiens
tagtatgtgtaaaaa

SEQ ID NO: 10795 - DNA, 15 bp, Homo sapiens
atagtatgtgtaaaa

SEQ ID NO: 10796 - DNA, 15 bp, Homo sapiens
tatagtatgtgtaaa

SEQ ID NO: 10797 - DNA, 15 bp, Homo sapiens
ttatagtatgtgtaa

SEQ ID NO: 10798 - DNA, 15 bp, Homo sapiens
tttatagtatgtgta

SEQ ID NO: 10799 - DNA, 15 bp, Homo sapiens
ttttatagtatgtgt

SEQ ID NO: 10800 - DNA, 15 bp, Homo sapiens
attttatagtatgtg

SEQ ID NO: 10801 - DNA, 15 bp, Homo sapiens
tattttatagtatgt

SEQ ID NO: 10802 - DNA, 15 bp, Homo sapiens
atattttatagtatg

SEQ ID NO: 10803 - DNA, 15 bp, Homo sapiens
aatattttatagtat

SEQ ID NO: 10804 - DNA, 15 bp, Homo sapiens
caatattttatagta

SEQ ID NO: 10805 - DNA, 15 bp, Homo sapiens
acaatattttatagt

SEQ ID NO: 10806 - DNA, 15 bp, Homo sapiens
cacaatattttatag

SEQ ID NO: 10807 - DNA, 15 bp, Homo sapiens
gcacaatattttata

SEQ ID NO: 10808 - DNA, 15 bp, Homo sapiens
tgcacaatattttat

SEQ ID NO: 10809 - DNA, 15 bp, Homo sapiens
gtgcacaatatttta

SEQ ID NO: 10810 - DNA, 15 bp, Homo sapiens
tgtgcacaatatttt

SEQ ID NO: 10811 - DNA, 15 bp, Homo sapiens
atgtgcacaatattt

SEQ ID NO: 10812 - DNA, 15 bp, Homo sapiens
aatgtgcacaatatt

SEQ ID NO: 10813 - DNA, 15 bp, Homo sapiens
aaatgtgcacaatat

SEQ ID NO: 10814 - DNA, 15 bp, Homo sapiens
caaatgtgcacaata

SEQ ID NO: 10815 - DNA, 15 bp, Homo sapiens
acaaatgtgcacaat

SEQ ID NO: 10816 - DNA, 15 bp, Homo sapiens
aacaaatgtgcacaa

SEQ ID NO: 10817 - DNA, 15 bp, Homo sapiens
aaacaaatgtgcaca

SEQ ID NO: 10818 - DNA, 15 bp, Homo sapiens
taaacaaatgtgcac

SEQ ID NO: 10819 - DNA, 15 bp, Homo sapiens
ataaacaaatgtgca

SEQ ID NO: 10820 - DNA, 15 bp, Homo sapiens
aataaacaaatgtgc

SEQ ID NO: 10821 - DNA, 15 bp, Homo sapiens
aaataaacaaatgtg

SEQ ID NO: 10822 - DNA, 15 bp, Homo sapiens
aaaataaacaaatgt

SEQ ID NO: 10823 - DNA, 15 bp, Homo sapiens
taaaataaacaaatg

SEQ ID NO: 10824 - DNA, 15 bp, Homo sapiens
ttaaaataaacaaat

SEQ ID NO: 10825 - DNA, 15 bp, Homo sapiens
attaaaataaacaaa

SEQ ID NO: 10826 - DNA, 15 bp, Homo sapiens
cattaaaataaacaa

SEQ ID NO: 10827 - DNA, 15 bp, Homo sapiens
acattaaaataaaca

SEQ ID NO: 10828 - DNA, 15 bp, Homo sapiens
tacattaaaataaac

SEQ ID NO: 10829 - DNA, 15 bp, Homo sapiens
atacattaaaataaa

SEQ ID NO: 10830 - DNA, 15 bp, Homo sapiens
gatacattaaaataa

SEQ ID NO: 10831 - DNA, 15 bp, Homo sapiens
ggatacattaaaata

SEQ ID NO: 10832 - DNA, 15 bp, Homo sapiens
aggatacattaaaat

SEQ ID NO: 10833 - DNA, 15 bp, Homo sapiens
caggatacattaaaa

SEQ ID NO: 10834 - DNA, 15 bp, Homo sapiens
acaggatacattaaa

SEQ ID NO: 10835 - DNA, 15 bp, Homo sapiens
tacaggatacattaa

SEQ ID NO: 10836 - DNA, 15 bp, Homo sapiens
ctacaggatacatta

SEQ ID NO: 10837 - DNA, 15 bp, Homo sapiens
tctacaggatacatt

SEQ ID NO: 10838 - DNA, 15 bp, Homo sapiens
atctacaggatacat

SEQ ID NO: 10839 - DNA, 15 bp, Homo sapiens
aatctacaggataca

SEQ ID NO: 10840 - DNA, 15 bp, Homo sapiens
taatctacaggatac

SEQ ID NO: 10841 - DNA, 15 bp, Homo sapiens
ataatctacaggata

SEQ ID NO: 10842 - DNA, 15 bp, Homo sapiens
aataatctacaggat

SEQ ID NO: 10843 - DNA, 15 bp, Homo sapiens
aaataatctacagga

SEQ ID NO: 10844 - DNA, 15 bp, Homo sapiens
taaataatctacagg

SEQ ID NO: 10845 - DNA, 15 bp, Homo sapiens
ctaaataatctacag

SEQ ID NO: 10846 - DNA, 15 bp, Homo sapiens
tctaaataatctaca

SEQ ID NO: 10847 - DNA, 15 bp, Homo sapiens
ttctaaataatctac

SEQ ID NO: 10848 - DNA, 15 bp, Homo sapiens
attctaaataatcta

SEQ ID NO: 10849 - DNA, 15 bp, Homo sapiens
gattctaaataatct

SEQ ID NO: 10850 - DNA, 15 bp, Homo sapiens
cgattctaaataatc

SEQ ID NO: 10851 - DNA, 15 bp, Homo sapiens
ccgattctaaataat

SEQ ID NO: 10852 - DNA, 15 bp, Homo sapiens
accgattctaaataa

SEQ ID NO: 10853 - DNA, 15 bp, Homo sapiens
aaccgattctaaata

SEQ ID NO: 10854 - DNA, 15 bp, Homo sapiens
gaaccgattctaaat

SEQ ID NO: 10855 - DNA, 15 bp, Homo sapiens
tgaaccgattctaaa

SEQ ID NO: 10856 - DNA, 15 bp, Homo sapiens
atgaaccgattctaa

SEQ ID NO: 10857 - DNA, 15 bp, Homo sapiens
tatgaaccgattcta

SEQ ID NO: 10858 - DNA, 15 bp, Homo sapiens
gtatgaaccgattct

SEQ ID NO: 10859 - DNA, 15 bp, Homo sapiens
tgtatgaaccgattc

SEQ ID NO: 10860 - DNA, 15 bp, Homo sapiens
ctgtatgaaccgatt

SEQ ID NO: 10861 - DNA, 15 bp, Homo sapiens
tctgtatgaaccgat

SEQ ID NO: 10862 - DNA, 15 bp, Homo sapiens
ctctgtatgaaccga

SEQ ID NO: 10863 - DNA, 15 bp, Homo sapiens
gctctgtatgaaccg

SEQ ID NO: 10864 - DNA, 15 bp, Homo sapiens
ggctctgtatgaacc

SEQ ID NO: 10865 - DNA, 15 bp, Homo sapiens
cggctctgtatgaac

SEQ ID NO: 10866 - DNA, 15 bp, Homo sapiens
acggctctgtatgaa

SEQ ID NO: 10867 - DNA, 15 bp, Homo sapiens
tacggctctgtatga

SEQ ID NO: 10868 - DNA, 15 bp, Homo sapiens
atacggctctgtatg

SEQ ID NO: 10869 - DNA, 15 bp, Homo sapiens
gatacggctctgtat

SEQ ID NO: 10870 - DNA, 15 bp, Homo sapiens
tgatacggctctgta

SEQ ID NO: 10871 - DNA, 15 bp, Homo sapiens
atgatacggctctgt

SEQ ID NO: 10872 - DNA, 15 bp, Homo sapiens
aatgatacggctctg

SEQ ID NO: 10873 - DNA, 15 bp, Homo sapiens
gaatgatacggctct

SEQ ID NO: 10874 - DNA, 15 bp, Homo sapiens
ggaatgatacggctc

SEQ ID NO: 10875 - DNA, 15 bp, Homo sapiens
aggaatgatacggct

SEQ ID NO: 10876 - DNA, 15 bp, Homo sapiens
aaggaatgatacggc

SEQ ID NO: 10877 - DNA, 15 bp, Homo sapiens
aaaggaatgatacgg

SEQ ID NO: 10878 - DNA, 15 bp, Homo sapiens
aaaaggaatgatacg

SEQ ID NO: 10879 - DNA, 15 bp, Homo sapiens
taaaaggaatgatac

SEQ ID NO: 10880 - DNA, 15 bp, Homo sapiens
ttaaaaggaatgata

SEQ ID NO: 10881 - DNA, 15 bp, Homo sapiens
cttaaaaggaatgat

SEQ ID NO: 10882 - DNA, 15 bp, Homo sapiens
ccttaaaaggaatga

SEQ ID NO: 10883 - DNA, 15 bp, Homo sapiens
cccttaaaaggaatg

SEQ ID NO: 10884 - DNA, 15 bp, Homo sapiens
acccttaaaaggaat

SEQ ID NO: 10885 - DNA, 15 bp, Homo sapiens
aacccttaaaaggaa

SEQ ID NO: 10886 - DNA, 15 bp, Homo sapiens
caacccttaaaagga

SEQ ID NO: 10887 - DNA, 15 bp, Homo sapiens
ccaacccttaaaagg

SEQ ID NO: 10888 - DNA, 15 bp, Homo sapiens
cccaacccttaaaag

SEQ ID NO: 10889 - DNA, 15 bp, Homo sapiens
acccaacccttaaaa

SEQ ID NO: 10890 - DNA, 15 bp, Homo sapiens
aacccaacccttaaa

SEQ ID NO: 10891 - DNA, 15 bp, Homo sapiens
aaacccaacccttaa

SEQ ID NO: 10892 - DNA, 15 bp, Homo sapiens
taaacccaaccctta

SEQ ID NO: 10893 - DNA, 15 bp, Homo sapiens
ttaaacccaaccctt

SEQ ID NO: 10894 - DNA, 15 bp, Homo sapiens
tttaaacccaaccct

SEQ ID NO: 10895 - DNA, 15 bp, Homo sapiens
atttaaacccaaccc

SEQ ID NO: 10896 - DNA, 15 bp, Homo sapiens
tatttaaacccaacc

SEQ ID NO: 10897 - DNA, 15 bp, Homo sapiens
ctatttaaacccaac

SEQ ID NO: 10898 - DNA, 15 bp, Homo sapiens
actatttaaacccaa

SEQ ID NO: 10899 - DNA, 15 bp, Homo sapiens
gactatttaaaccca

SEQ ID NO: 10900 - DNA, 15 bp, Homo sapiens
agactatttaaaccc

SEQ ID NO: 10901 - DNA, 15 bp, Homo sapiens
cagactatttaaacc

SEQ ID NO: 10902 - DNA, 15 bp, Homo sapiens
acagactatttaaac

SEQ ID NO: 10903 - DNA, 15 bp, Homo sapiens
aacagactatttaaa

SEQ ID NO: 10904 - DNA, 15 bp, Homo sapiens
taacagactatttaa

SEQ ID NO: 10905 - DNA, 15 bp, Homo sapiens
ataacagactattta

SEQ ID NO: 10906 - DNA, 15 bp, Homo sapiens
cataacagactattt

SEQ ID NO: 10907 - DNA, 15 bp, Homo sapiens
ccataacagactatt

SEQ ID NO: 10908 - DNA, 15 bp, Homo sapiens
tccataacagactat

SEQ ID NO: 10909 - DNA, 15 bp, Homo sapiens
atccataacagacta

SEQ ID NO: 10910 - DNA, 15 bp, Homo sapiens
catccataacagact

SEQ ID NO: 10911 - DNA, 15 bp, Homo sapiens
acatccataacagac

SEQ ID NO: 10912 - DNA, 15 bp, Homo sapiens
tacatccataacaga

SEQ ID NO: 10913 - DNA, 15 bp, Homo sapiens
gtacatccataacag

SEQ ID NO: 10914 - DNA, 15 bp, Homo sapiens
ggtacatccataaca

SEQ ID NO: 10915 - DNA, 15 bp, Homo sapiens
tggtacatccataac

SEQ ID NO: 10916 - DNA, 15 bp, Homo sapiens
gtggtacatccataa

SEQ ID NO: 10917 - DNA, 15 bp, Homo sapiens
tgtggtacatccata

SEQ ID NO: 10918 - DNA, 15 bp, Homo sapiens
ttgtggtacatccat

SEQ ID NO: 10919 - DNA, 15 bp, Homo sapiens
attgtggtacatcca

SEQ ID NO: 10920 - DNA, 15 bp, Homo sapiens
aattgtggtacatcc

SEQ ID NO: 10921 - DNA, 15 bp, Homo sapiens
aaattgtggtacatc

SEQ ID NO: 10922 - DNA, 15 bp, Homo sapiens
taaattgtggtacat

SEQ ID NO: 10923 - DNA, 15 bp, Homo sapiens
ataaattgtggtaca

SEQ ID NO: 10924 - DNA, 15 bp, Homo sapiens
aataaattgtggtac

SEQ ID NO: 10925 - DNA, 15 bp, Homo sapiens
aaataaattgtggta

SEQ ID NO: 10926 - DNA, 15 bp, Homo sapiens
taaataaattgtggt

SEQ ID NO: 10927 - DNA, 15 bp, Homo sapiens
ttaaataaattgtgg

SEQ ID NO: 10928 - DNA, 15 bp, Homo sapiens
gttaaataaattgtg

SEQ ID NO: 10929 - DNA, 15 bp, Homo sapiens
ggttaaataaattgt

SEQ ID NO: 10930 - DNA, 15 bp, Homo sapiens
tggttaaataaattg

SEQ ID NO: 10931 - DNA, 15 bp, Homo sapiens
ctggttaaataaatt

SEQ ID NO: 10932 - DNA, 15 bp, Homo sapiens
actggttaaataaat

SEQ ID NO: 10933 - DNA, 15 bp, Homo sapiens
aactggttaaataaa

SEQ ID NO: 10934 - DNA, 15 bp, Homo sapiens
aaactggttaaataa

SEQ ID NO: 10935 - DNA, 15 bp, Homo sapiens
aaaactggttaaata

SEQ ID NO: 10936 - DNA, 15 bp, Homo sapiens
aaaaactggttaaat

SEQ ID NO: 10937 - DNA, 15 bp, Homo sapiens
taaaaactggttaaa

SEQ ID NO: 10938 - DNA, 15 bp, Homo sapiens
ttaaaaactggttaa

SEQ ID NO: 10939 - DNA, 15 bp, Homo sapiens
tttaaaaactggtta

SEQ ID NO: 10940 - DNA, 15 bp, Homo sapiens
atttaaaaactggtt

SEQ ID NO: 10941 - DNA, 15 bp, Homo sapiens
aatttaaaaactggt

SEQ ID NO: 10942 - DNA, 15 bp, Homo sapiens
aaatttaaaaactgg

SEQ ID NO: 10943 - DNA, 15 bp, Homo sapiens
aaaatttaaaaactg

SEQ ID NO: 10944 - DNA, 15 bp, Homo sapiens
aaaaatttaaaaact

SEQ ID NO: 10945 - DNA, 15 bp, Homo sapiens
aaaaaatttaaaaac

SEQ ID NO: 10946 - DNA, 15 bp, Homo sapiens
taaaaaatttaaaaa

SEQ ID NO: 10947 - DNA, 15 bp, Homo sapiens
gtaaaaaatttaaaa

SEQ ID NO: 10948 - DNA, 15 bp, Homo sapiens
agtaaaaaatttaaa

SEQ ID NO: 10949 - DNA, 15 bp, Homo sapiens
aagtaaaaaatttaa

SEQ ID NO: 10950 - DNA, 15 bp, Homo sapiens
taagtaaaaaattta

SEQ ID NO: 10951 - DNA, 15 bp, Homo sapiens
ataagtaaaaaattt

SEQ ID NO: 10952 - DNA, 15 bp, Homo sapiens
aataagtaaaaaatt

SEQ ID NO: 10953 - DNA, 15 bp, Homo sapiens
aaataagtaaaaaat

SEQ ID NO: 10954 - DNA, 15 bp, Homo sapiens
aaaataagtaaaaaa

SEQ ID NO: 10955 - DNA, 15 bp, Homo sapiens
aaaaataagtaaaaa

SEQ ID NO: 10956 - DNA, 15 bp, Homo sapiens
aaaaaataagtaaaa

SEQ ID NO: 10957 - DNA, 15 bp, Homo sapiens
aaaaaaataagtaaa

SEQ ID NO: 10958 - DNA, 15 bp, Homo sapiens
aaaaaaaataagtaa

SEQ ID NO: 10959 - DNA, 15 bp, Homo sapiens
taaaaaaaataagta

SEQ ID NO: 10960 - DNA, 15 bp, Homo sapiens
ttaaaaaaaataagt

SEQ ID NO: 10961 - DNA, 15 bp, Homo sapiens
attaaaaaaaataag

SEQ ID NO: 10962 - DNA, 15 bp, Homo sapiens
cattaaaaaaaataa

SEQ ID NO: 10963 - DNA, 15 bp, Homo sapiens
acattaaaaaaaata

SEQ ID NO: 10964 - DNA, 15 bp, Homo sapiens
aacattaaaaaaaat

SEQ ID NO: 10965 - DNA, 15 bp, Homo sapiens
aaacattaaaaaaaa

SEQ ID NO: 10966 - DNA, 15 bp, Homo sapiens
aaaacattaaaaaaa

SEQ ID NO: 10967 - DNA, 15 bp, Homo sapiens
aaaaacattaaaaaa

SEQ ID NO: 10968 - DNA, 15 bp, Homo sapiens
aaaaaacattaaaaa

SEQ ID NO: 10969 - DNA, 15 bp, Homo sapiens
aaaaaaacattaaaa

SEQ ID NO: 10970 - DNA, 15 bp, Homo sapiens
taaaaaaacattaaa

SEQ ID NO: 10971 - DNA, 15 bp, Homo sapiens
ctaaaaaaacattaa

SEQ ID NO: 10972 - DNA, 15 bp, Homo sapiens
tctaaaaaaacatta

SEQ ID NO: 10973 - DNA, 15 bp, Homo sapiens
ctctaaaaaaacatt

SEQ ID NO: 10974 - DNA, 15 bp, Homo sapiens
tctctaaaaaaacat

SEQ ID NO: 10975 - DNA, 15 bp, Homo sapiens
cctgtctctaaaaaa

SEQ ID NO: 10976 - DNA, 15 bp, Homo sapiens
tcctgtctctaaaaa

SEQ ID NO: 10977 - DNA, 15 bp, Homo sapiens
atcctgtctctaaaa

SEQ ID NO: 10978 - DNA, 15 bp, Homo sapiens
gatcctgtctctaaa

SEQ ID NO: 10979 - DNA, 15 bp, Homo sapiens
ggatcctgtctctaa

SEQ ID NO: 10980 - DNA, 15 bp, Homo sapiens
gggatcctgtctcta

SEQ ID NO: 10981 - DNA, 15 bp, Homo sapiens
tgggatcctgtctct

SEQ ID NO: 10982 - DNA, 15 bp, Homo sapiens
gtgggatcctgtctc

SEQ ID NO: 10983 - DNA, 15 bp, Homo sapiens
agtgggatcctgtct

SEQ ID NO: 10984 - DNA, 15 bp, Homo sapiens
gagtgggatcctgtc

SEQ ID NO: 10985 - DNA, 15 bp, Homo sapiens
ggagtgggatcctgt

SEQ ID NO: 10986 - DNA, 15 bp, Homo sapiens
tggagtgggatcctg

SEQ ID NO: 10987 - DNA, 15 bp, Homo sapiens
atggagtgggatcct

SEQ ID NO: 10988 - DNA, 15 bp, Homo sapiens
gatggagtgggatcc

SEQ ID NO: 10989 - DNA, 15 bp, Homo sapiens
tgatggagtgggatc

SEQ ID NO: 10990 - DNA, 15 bp, Homo sapiens
gtgatggagtgggat

SEQ ID NO: 10991 - DNA, 15 bp, Homo sapiens
ggtgatggagtggga

SEQ ID NO: 10992 - DNA, 15 bp, Homo sapiens
gggtgatggagtggg

SEQ ID NO: 10993 - DNA, 15 bp, Homo sapiens
tgggtgatggagtgg

SEQ ID NO: 10994 - DNA, 15 bp, Homo sapiens
ctgggtgatggagtg

SEQ ID NO: 10995 - DNA, 15 bp, Homo sapiens
tctgggtgatggagt

SEQ ID NO: 10996 - DNA, 15 bp, Homo sapiens
gtctgggtgatggag

SEQ ID NO: 10997 - DNA, 15 bp, Homo sapiens
agtctgggtgatgga

SEQ ID NO: 10998 - DNA, 15 bp, Homo sapiens
cagtctgggtgatgg

SEQ ID NO: 10999 - DNA, 15 bp, Homo sapiens
ccagtctgggtgatg

SEQ ID NO: 11000 - DNA, 15 bp, Homo sapiens
tccagtctgggtgat

SEQ ID NO: 11001 - DNA, 15 bp, Homo sapiens
ctccagtctgggtga

SEQ ID NO: 11002 - DNA, 15 bp, Homo sapiens
actccagtctgggtg

SEQ ID NO: 11003 - DNA, 15 bp, Homo sapiens
cactccagtctgggt

SEQ ID NO: 11004 - DNA, 15 bp, Homo sapiens
gcactccagtctggg

SEQ ID NO: 11005 - DNA, 15 bp, Homo sapiens
tgcactccagtctgg

SEQ ID NO: 11006 - DNA, 15 bp, Homo sapiens
ttgcactccagtctg

SEQ ID NO: 11007 - DNA, 15 bp, Homo sapiens
gttgcactccagtct

SEQ ID NO: 11008 - DNA, 15 bp, Homo sapiens
tgttgcactccagtc

SEQ ID NO: 11009 - DNA, 15 bp, Homo sapiens
ctgttgcactccagt

SEQ ID NO: 11010 - DNA, 15 bp, Homo sapiens
gctgttgcactccag

SEQ ID NO: 11011 - DNA, 15 bp, Homo sapiens
tgctgttgcactcca

SEQ ID NO: 11012 - DNA, 15 bp, Homo sapiens
atgctgttgcactcc

SEQ ID NO: 11013 - DNA, 15 bp, Homo sapiens
catgctgttgcactc

SEQ ID NO: 11014 - DNA, 15 bp, Homo sapiens
tcatgctgttgcact

SEQ ID NO: 11015 - DNA, 15 bp, Homo sapiens
atcatgctgttgcac

SEQ ID NO: 11016 - DNA, 15 bp, Homo sapiens
gatcatgctgttgca

SEQ ID NO: 11017 - DNA, 15 bp, Homo sapiens
tgatcatgctgttgc

SEQ ID NO: 11018 - DNA, 15 bp, Homo sapiens
atgatcatgctgttg

SEQ ID NO: 11019 - DNA, 15 bp, Homo sapiens
tatgatcatgctgtt

SEQ ID NO: 11020 - DNA, 15 bp, Homo sapiens
ctatgatcatgctgt

SEQ ID NO: 11021 - DNA, 15 bp, Homo sapiens
gctatgatcatgctg

SEQ ID NO: 11022 - DNA, 15 bp, Homo sapiens
agctatgatcatgct

SEQ ID NO: 11023 - DNA, 15 bp, Homo sapiens
aagctatgatcatgc

SEQ ID NO: 11024 - DNA, 15 bp, Homo sapiens
taagctatgatcatg

SEQ ID NO: 11025 - DNA, 15 bp, Homo sapiens
gtaagctatgatcat

SEQ ID NO: 11026 - DNA, 15 bp, Homo sapiens
agtaagctatgatca

SEQ ID NO: 11027 - DNA, 15 bp, Homo sapiens
cagtaagctatgatc

SEQ ID NO: 11028 - DNA, 15 bp, Homo sapiens
gcagtaagctatgat

SEQ ID NO: 11029 - DNA, 15 bp, Homo sapiens
tgcagtaagctatga

SEQ ID NO: 11030 - DNA, 15 bp, Homo sapiens
ctgcagtaagctatg

SEQ ID NO: 11031 - DNA, 15 bp, Homo sapiens
gctgcagtaagctat

SEQ ID NO: 11032 - DNA, 15 bp, Homo sapiens
ggctgcagtaagcta

SEQ ID NO: 11033 - DNA, 15 bp, Homo sapiens
aggctgcagtaagct

SEQ ID NO: 11034 - DNA, 15 bp, Homo sapiens
aaggctgcagtaagc

SEQ ID NO: 11035 - DNA, 15 bp, Homo sapiens
caaggctgcagtaag

SEQ ID NO: 11036 - DNA, 15 bp, Homo sapiens
tcaaggctgcagtaa

SEQ ID NO: 11037 - DNA, 15 bp, Homo sapiens
ttcaaggctgcagta

SEQ ID NO: 11038 - DNA, 15 bp, Homo sapiens
gttcaaggctgcagt

SEQ ID NO: 11039 - DNA, 15 bp, Homo sapiens
agttcaaggctgcag

SEQ ID NO: 11040 - DNA, 15 bp, Homo sapiens
gagttcaaggctgca

SEQ ID NO: 11041 - DNA, 15 bp, Homo sapiens
ggagttcaaggctgc

SEQ ID NO: 11042 - DNA, 15 bp, Homo sapiens
cggagttcaaggctg

SEQ ID NO: 11043 - DNA, 15 bp, Homo sapiens
ccggagttcaaggct

SEQ ID NO: 11044 - DNA, 15 bp, Homo sapiens
cccggagttcaaggc

SEQ ID NO: 11045 - DNA, 15 bp, Homo sapiens
ccccggagttcaagg

SEQ ID NO: 11046 - DNA, 15 bp, Homo sapiens
gccccggagttcaag

SEQ ID NO: 11047 - DNA, 15 bp, Homo sapiens
agccccggagttcaa

SEQ ID NO: 11048 - DNA, 15 bp, Homo sapiens
cagccccggagttca

SEQ ID NO: 11049 - DNA, 15 bp, Homo sapiens
tcagccccggagttc

SEQ ID NO: 11050 - DNA, 15 bp, Homo sapiens
atcagccccggagtt

SEQ ID NO: 11051 - DNA, 15 bp, Homo sapiens
catcagccccggagt

SEQ ID NO: 11052 - DNA, 15 bp, Homo sapiens
acatcagccccggag

SEQ ID NO: 11053 - DNA, 15 bp, Homo sapiens
cacatcagccccgga

SEQ ID NO: 11054 - DNA, 15 bp, Homo sapiens
tcacatcagccccgg

SEQ ID NO: 11055 - DNA, 15 bp, Homo sapiens
atcacatcagccccg

SEQ ID NO: 11056 - DNA, 15 bp, Homo sapiens
gatcacatcagcccc

SEQ ID NO: 11057 - DNA, 15 bp, Homo sapiens
ggatcacatcagccc

SEQ ID NO: 11058 - DNA, 15 bp, Homo sapiens
aggatcacatcagcc

SEQ ID NO: 11059 - DNA, 15 bp, Homo sapiens
gaggatcacatcagc

SEQ ID NO: 11060 - DNA, 15 bp, Homo sapiens
ggaggatcacatcag

SEQ ID NO: 11061 - DNA, 15 bp, Homo sapiens
gggaggatcacatca

SEQ ID NO: 11062 - DNA, 15 bp, Homo sapiens
tgggaggatcacatc

SEQ ID NO: 11063 - DNA, 15 bp, Homo sapiens
gtgggaggatcacat

SEQ ID NO: 11064 - DNA, 15 bp, Homo sapiens
ggtgggaggatcaca

SEQ ID NO: 11065 - DNA, 15 bp, Homo sapiens
tgaggtgggaggatc

SEQ ID NO: 11066 - DNA, 15 bp, Homo sapiens
ctgaggtgggaggat

SEQ ID NO: 11067 - DNA, 15 bp, Homo sapiens
cctgaggtgggagga

SEQ ID NO: 11068 - DNA, 15 bp, Homo sapiens
gcctgaggtgggagg

SEQ ID NO: 11069 - DNA, 15 bp, Homo sapiens
agcctgaggtgggag

SEQ ID NO: 11070 - DNA, 15 bp, Homo sapiens
gagcctgaggtggga

SEQ ID NO: 11071 - DNA, 15 bp, Homo sapiens
agagcctgaggtggg

SEQ ID NO: 11072 - DNA, 15 bp, Homo sapiens
gagagcctgaggtgg

SEQ ID NO: 11073 - DNA, 15 bp, Homo sapiens
agagagcctgaggtg

SEQ ID NO: 11074 - DNA, 15 bp, Homo sapiens
aagagagcctgaggt

SEQ ID NO: 11075 - DNA, 15 bp, Homo sapiens
caagagagcctgagg

SEQ ID NO: 11076 - DNA, 15 bp, Homo sapiens
acaagagagcctgag

SEQ ID NO: 11077 - DNA, 15 bp, Homo sapiens
tacaagagagcctga

SEQ ID NO: 11078 - DNA, 15 bp, Homo sapiens
ctacaagagagcctg

SEQ ID NO: 11079 - DNA, 15 bp, Homo sapiens
gctacaagagagcct

SEQ ID NO: 11080 - DNA, 15 bp, Homo sapiens
agctacaagagagcc

SEQ ID NO: 11081 - DNA, 15 bp, Homo sapiens
cagctacaagagagc

SEQ ID NO: 11082 - DNA, 15 bp, Homo sapiens
ccagctacaagagag

SEQ ID NO: 11083 - DNA, 15 bp, Homo sapiens
cccagctacaagaga

SEQ ID NO: 11084 - DNA, 15 bp, Homo sapiens
tcccagctacaagag

SEQ ID NO: 11085 - DNA, 15 bp, Homo sapiens
gtcccagctacaaga

SEQ ID NO: 11086 - DNA, 15 bp, Homo sapiens
agtcccagctacaag

SEQ ID NO: 11087 - DNA, 15 bp, Homo sapiens
tagtcccagctacaa

SEQ ID NO: 11088 - DNA, 15 bp, Homo sapiens
gtagtcccagctaca

SEQ ID NO: 11089 - DNA, 15 bp, Homo sapiens
ccctgtagtcccagc

SEQ ID NO: 11090 - DNA, 15 bp, Homo sapiens
tccctgtagtcccag

SEQ ID NO: 11091 - DNA, 15 bp, Homo sapiens
atccctgtagtccca

SEQ ID NO: 11092 - DNA, 15 bp, Homo sapiens
catccctgtagtccc

SEQ ID NO: 11093 - DNA, 15 bp, Homo sapiens
acatccctgtagtcc

SEQ ID NO: 11094 - DNA, 15 bp, Homo sapiens
cacatccctgtagtc

SEQ ID NO: 11095 - DNA, 15 bp, Homo sapiens
gcacatccctgtagt

SEQ ID NO: 11096 - DNA, 15 bp, Homo sapiens
ggcacatccctgtag

SEQ ID NO: 11097 - DNA, 15 bp, Homo sapiens
cggcacatccctgta

SEQ ID NO: 11098 - DNA, 15 bp, Homo sapiens
gcggcacatccctgt

SEQ ID NO: 11099 - DNA, 15 bp, Homo sapiens
ggcggcacatccctg

SEQ ID NO: 11100 - DNA, 15 bp, Homo sapiens
tggcggcacatccct

SEQ ID NO: 11101 - DNA, 15 bp, Homo sapiens
atggcggcacatccc

SEQ ID NO: 11102 - DNA, 15 bp, Homo sapiens
catggcggcacatcc

SEQ ID NO: 11103 - DNA, 15 bp, Homo sapiens
gcatggcggcacatc

SEQ ID NO: 11104 - DNA, 15 bp, Homo sapiens
ggcatggcggcacat

SEQ ID NO: 11105 - DNA, 15 bp, Homo sapiens
aggcatggcggcaca

SEQ ID NO: 11106 - DNA, 15 bp, Homo sapiens
caggcatggcggcac

SEQ ID NO: 11107 - DNA, 15 bp, Homo sapiens
ccaggcatggcggca

SEQ ID NO: 11108 - DNA, 15 bp, Homo sapiens
gccaggcatggcggc

SEQ ID NO: 11109 - DNA, 15 bp, Homo sapiens
agccaggcatggcgg

SEQ ID NO: 11110 - DNA, 15 bp, Homo sapiens
tagccaggcatggcg

SEQ ID NO: 11111 - DNA, 15 bp, Homo sapiens
ttagccaggcatggc

SEQ ID NO: 11112 - DNA, 15 bp, Homo sapiens
tttagccaggcatgg

SEQ ID NO: 11113 - DNA, 15 bp, Homo sapiens
atttagccaggcatg

SEQ ID NO: 11114 - DNA, 15 bp, Homo sapiens
aatttagccaggcat

SEQ ID NO: 11115 - DNA, 15 bp, Homo sapiens
aaatttagccaggca

SEQ ID NO: 11116 - DNA, 15 bp, Homo sapiens
aaaatttagccaggc

SEQ ID NO: 11117 - DNA, 15 bp, Homo sapiens
aaaaatttagccagg

SEQ ID NO: 11118 - DNA, 15 bp, Homo sapiens
aaaaaatttagccag

SEQ ID NO: 11119 - DNA, 15 bp, Homo sapiens
taaaaaatttagcca

SEQ ID NO: 11120 - DNA, 15 bp, Homo sapiens
ataaaaaatttagcc

SEQ ID NO: 11121 - DNA, 15 bp, Homo sapiens
aataaaaaatttagc

SEQ ID NO: 11122 - DNA, 15 bp, Homo sapiens
aaataaaaaatttag

SEQ ID NO: 11123 - DNA, 15 bp, Homo sapiens
aaaataaaaaattta

SEQ ID NO: 11124 - DNA, 15 bp, Homo sapiens
aaaaataaaaaattt

SEQ ID NO: 11125 - DNA, 15 bp, Homo sapiens
taaaaataaaaaatt

SEQ ID NO: 11126 - DNA, 15 bp, Homo sapiens
ataaaaataaaaaat

SEQ ID NO: 11127 - DNA, 15 bp, Homo sapiens
aataaaaataaaaaa

SEQ ID NO: 11128 - DNA, 15 bp, Homo sapiens
aaataaaaataaaaa

SEQ ID NO: 11129 - DNA, 15 bp, Homo sapiens
taaaaataaaaataa

SEQ ID NO: 11130 - DNA, 15 bp, Homo sapiens
ataaaaataaaaata

SEQ ID NO: 11131 - DNA, 15 bp, Homo sapiens
aataaaaataaaaat

SEQ ID NO: 11132 - DNA, 15 bp, Homo sapiens
caaaaataaaaataa

SEQ ID NO: 11133 - DNA, 15 bp, Homo sapiens
ccaaaaataaaaata

SEQ ID NO: 11134 - DNA, 15 bp, Homo sapiens
accaaaaataaaaat

SEQ ID NO: 11135 - DNA, 15 bp, Homo sapiens
taccaaaaataaaaa

SEQ ID NO: 11136 - DNA, 15 bp, Homo sapiens
ctaccaaaaataaaa

SEQ ID NO: 11137 - DNA, 15 bp, Homo sapiens
tctaccaaaaataaa

SEQ ID NO: 11138 - DNA, 15 bp, Homo sapiens
gtctaccaaaaataa

SEQ ID NO: 11139 - DNA, 15 bp, Homo sapiens
tgtctaccaaaaata

SEQ ID NO: 11140 - DNA, 15 bp, Homo sapiens
gtgtctaccaaaaat

SEQ ID NO: 11141 - DNA, 15 bp, Homo sapiens
cgtgtctaccaaaaa

SEQ ID NO: 11142 - DNA, 15 bp, Homo sapiens
ccgtgtctaccaaaa

SEQ ID NO: 11143 - DNA, 15 bp, Homo sapiens
cccgtgtctaccaaa

SEQ ID NO: 11144 - DNA, 15 bp, Homo sapiens
ccccgtgtctaccaa

SEQ ID NO: 11145 - DNA, 15 bp, Homo sapiens
accccgtgtctacca

SEQ ID NO: 11146 - DNA, 15 bp, Homo sapiens
aaccccgtgtctacc

SEQ ID NO: 11147 - DNA, 15 bp, Homo sapiens
aaaccccgtgtctac

SEQ ID NO: 11148 - DNA, 15 bp, Homo sapiens
gaaaccccgtgtcta

SEQ ID NO: 11149 - DNA, 15 bp, Homo sapiens
tgaaaccccgtgtct

SEQ ID NO: 11150 - DNA, 15 bp, Homo sapiens
gtgaaaccccgtgtc

SEQ ID NO: 11151 - DNA, 15 bp, Homo sapiens
agtgaaaccccgtgt

SEQ ID NO: 11152 - DNA, 15 bp, Homo sapiens
cagtgaaaccccgtg

SEQ ID NO: 11153 - DNA, 15 bp, Homo sapiens
acagtgaaaccccgt

SEQ ID NO: 11154 - DNA, 15 bp, Homo sapiens
cacagtgaaaccccg

SEQ ID NO: 11155 - DNA, 15 bp, Homo sapiens
acacagtgaaacccc

SEQ ID NO: 11156 - DNA, 15 bp, Homo sapiens
aacacagtgaaaccc

SEQ ID NO: 11157 - DNA, 15 bp, Homo sapiens
caacacagtgaaacc

SEQ ID NO: 11158 - DNA, 15 bp, Homo sapiens
gcaacacagtgaaac

SEQ ID NO: 11159 - DNA, 15 bp, Homo sapiens
ggcaacacagtgaaa

SEQ ID NO: 11160 - DNA, 15 bp, Homo sapiens
gggcaacacagtgaa

SEQ ID NO: 11161 - DNA, 15 bp, Homo sapiens
tgggcaacacagtga

SEQ ID NO: 11162 - DNA, 15 bp, Homo sapiens
ctgggcaacacagtg

SEQ ID NO: 11163 - DNA, 15 bp, Homo sapiens
cctgggcaacacagt

SEQ ID NO: 11164 - DNA, 15 bp, Homo sapiens
gcctgggcaacacag

SEQ ID NO: 11165 - DNA, 15 bp, Homo sapiens
agcctgggcaacaca

SEQ ID NO: 11166 - DNA, 15 bp, Homo sapiens
cagcctgggcaacac

SEQ ID NO: 11167 - DNA, 15 bp, Homo sapiens
ccagcctgggcaaca

SEQ ID NO: 11168 - DNA, 15 bp, Homo sapiens
accagcctgggcaac

SEQ ID NO: 11169 - DNA, 15 bp, Homo sapiens
gaccagcctgggcaa

SEQ ID NO: 11170 - DNA, 15 bp, Homo sapiens
agaccagcctgggca

SEQ ID NO: 11171 - DNA, 15 bp, Homo sapiens
aagaccagcctgggc

SEQ ID NO: 11172 - DNA, 15 bp, Homo sapiens
caagaccagcctggg

SEQ ID NO: 11173 - DNA, 15 bp, Homo sapiens
aaggagttcaagacc

SEQ ID NO: 11174 - DNA, 15 bp, Homo sapiens
caaggagttcaagac

SEQ ID NO: 11175 - DNA, 15 bp, Homo sapiens
ccaaggagttcaaga

SEQ ID NO: 11176 - DNA, 15 bp, Homo sapiens
cccaaggagttcaag

SEQ ID NO: 11177 - DNA, 15 bp, Homo sapiens
gcccaaggagttcaa

SEQ ID NO: 11178 - DNA, 15 bp, Homo sapiens
agcccaaggagttca

SEQ ID NO: 11179 - DNA, 15 bp, Homo sapiens
aagcccaaggagttc

SEQ ID NO: 11180 - DNA, 15 bp, Homo sapiens
caagcccaaggagtt

SEQ ID NO: 11181 - DNA, 15 bp, Homo sapiens
tcaagcccaaggagt

SEQ ID NO: 11182 - DNA, 15 bp, Homo sapiens
ctcaagcccaaggag

SEQ ID NO: 11183 - DNA, 15 bp, Homo sapiens
actcaagcccaagga

SEQ ID NO: 11184 - DNA, 15 bp, Homo sapiens
tactcaagcccaagg

SEQ ID NO: 11185 - DNA, 15 bp, Homo sapiens
ttactcaagcccaag

SEQ ID NO: 11186 - DNA, 15 bp, Homo sapiens
attactcaagcccaa

SEQ ID NO: 11187 - DNA, 15 bp, Homo sapiens
gattactcaagccca

SEQ ID NO: 11188 - DNA, 15 bp, Homo sapiens
ggattactcaagccc

SEQ ID NO: 11189 - DNA, 15 bp, Homo sapiens
aggattactcaagcc

SEQ ID NO: 11190 - DNA, 15 bp, Homo sapiens
gaggattactcaagc

SEQ ID NO: 11191 - DNA, 15 bp, Homo sapiens
ggaggattactcaag

SEQ ID NO: 11192 - DNA, 15 bp, Homo sapiens
aggaggattactcaa

SEQ ID NO: 11193 - DNA, 15 bp, Homo sapiens
caggaggattactca

SEQ ID NO: 11194 - DNA, 15 bp, Homo sapiens
gcaggaggattactc

SEQ ID NO: 11195 - DNA, 15 bp, Homo sapiens
ggcaggaggattact

SEQ ID NO: 11196 - DNA, 15 bp, Homo sapiens
aggcaggaggattac

SEQ ID NO: 11197 - DNA, 15 bp, Homo sapiens
aaggcaggaggatta

SEQ ID NO: 11198 - DNA, 15 bp, Homo sapiens
caaggcaggaggatt

SEQ ID NO: 11199 - DNA, 15 bp, Homo sapiens
ggcactttgggaggc

SEQ ID NO: 11200 - DNA, 15 bp, Homo sapiens
cggcactttgggagg

SEQ ID NO: 11201 - DNA, 15 bp, Homo sapiens
tcggcactttgggag

SEQ ID NO: 11202 - DNA, 15 bp, Homo sapiens
ctcggcactttggga

SEQ ID NO: 11203 - DNA, 15 bp, Homo sapiens
tctcggcactttggg

SEQ ID NO: 11204 - DNA, 15 bp, Homo sapiens
atctcggcactttgg

SEQ ID NO: 11205 - DNA, 15 bp, Homo sapiens
aatctcggcactttg

SEQ ID NO: 11206 - DNA, 15 bp, Homo sapiens
taatctcggcacttt

SEQ ID NO: 11207 - DNA, 15 bp, Homo sapiens
gtaatctcggcactt

SEQ ID NO: 11208 - DNA, 15 bp, Homo sapiens
tgtaatctcggcact

SEQ ID NO: 11209 - DNA, 15 bp, Homo sapiens
ttgtaatctcggcac

SEQ ID NO: 11210 - DNA, 15 bp, Homo sapiens
gttgtaatctcggca

SEQ ID NO: 11211 - DNA, 15 bp, Homo sapiens
ggttgtaatctcggc

SEQ ID NO: 11212 - DNA, 15 bp, Homo sapiens
tggttgtaatctcgg

SEQ ID NO: 11213 - DNA, 15 bp, Homo sapiens
atggttgtaatctcg

SEQ ID NO: 11214 - DNA, 15 bp, Homo sapiens
catggttgtaatctc

SEQ ID NO: 11215 - DNA, 15 bp, Homo sapiens
tcatggttgtaatct

SEQ ID NO: 11216 - DNA, 15 bp, Homo sapiens
ctcatggttgtaatc

SEQ ID NO: 11217 - DNA, 15 bp, Homo sapiens
gctcatggttgtaat

SEQ ID NO: 11218 - DNA, 15 bp, Homo sapiens
ggctcatggttgtaa

SEQ ID NO: 11219 - DNA, 15 bp, Homo sapiens
tggctcatggttgta

SEQ ID NO: 11220 - DNA, 15 bp, Homo sapiens
atggctcatggttgt

SEQ ID NO: 11221 - DNA, 15 bp, Homo sapiens
catggctcatggttg

SEQ ID NO: 11222 - DNA, 15 bp, Homo sapiens
ccatggctcatggtt

SEQ ID NO: 11223 - DNA, 15 bp, Homo sapiens
tccatggctcatggt

SEQ ID NO: 11224 - DNA, 15 bp, Homo sapiens
ctccatggctcatgg

SEQ ID NO: 11225 - DNA, 15 bp, Homo sapiens
gctccatggctcatg

SEQ ID NO: 11226 - DNA, 15 bp, Homo sapiens
ggctccatggctcat

SEQ ID NO: 11227 - DNA, 15 bp, Homo sapiens
gggctccatggctca

SEQ ID NO: 11228 - DNA, 15 bp, Homo sapiens
cgggctccatggctc

SEQ ID NO: 11229 - DNA, 15 bp, Homo sapiens
tcgggctccatggct

SEQ ID NO: 11230 - DNA, 15 bp, Homo sapiens
gtcgggctccatggc

SEQ ID NO: 11231 - DNA, 15 bp, Homo sapiens
tgtcgggctccatgg

SEQ ID NO: 11232 - DNA, 15 bp, Homo sapiens
ttgtcgggctccatg

SEQ ID NO: 11233 - DNA, 15 bp, Homo sapiens
cttgtcgggctccat

SEQ ID NO: 11234 - DNA, 15 bp, Homo sapiens
tcttgtcgggctcca

SEQ ID NO: 11235 - DNA, 15 bp, Homo sapiens
ctcttgtcgggctcc

SEQ ID NO: 11236 - DNA, 15 bp, Homo sapiens
actcttgtcgggctc

SEQ ID NO: 11237 - DNA, 15 bp, Homo sapiens
tactcttgtcgggct

SEQ ID NO: 11238 - DNA, 15 bp, Homo sapiens
ctactcttgtcgggc

SEQ ID NO: 11239 - DNA, 15 bp, Homo sapiens
gctactcttgtcggg

SEQ ID NO: 11240 - DNA, 15 bp, Homo sapiens
ggctactcttgtcgg

SEQ ID NO: 11241 - DNA, 15 bp, Homo sapiens
aggctactcttgtcg

SEQ ID NO: 11242 - DNA, 15 bp, Homo sapiens
aaggctactcttgtc

SEQ ID NO: 11243 - DNA, 15 bp, Homo sapiens
aaaggctactcttgt

SEQ ID NO: 11244 - DNA, 15 bp, Homo sapiens
aaaaggctactcttg

SEQ ID NO: 11245 - DNA, 15 bp, Homo sapiens
taaaaggctactctt

SEQ ID NO: 11246 - DNA, 15 bp, Homo sapiens
ataaaaggctactct

SEQ ID NO: 11247 - DNA, 15 bp, Homo sapiens
aataaaaggctactc

SEQ ID NO: 11248 - DNA, 15 bp, Homo sapiens
aaataaaaggctact

SEQ ID NO: 11249 - DNA, 15 bp, Homo sapiens
caaataaaaggctac

SEQ ID NO: 11250 - DNA, 15 bp, Homo sapiens
gcaaataaaaggcta

SEQ ID NO: 11251 - DNA, 15 bp, Homo sapiens
tgcaaataaaaggct

SEQ ID NO: 11252 - DNA, 15 bp, Homo sapiens
ctgcaaataaaaggc

SEQ ID NO: 11253 - DNA, 15 bp, Homo sapiens
tctgcaaataaaagg

SEQ ID NO: 11254 - DNA, 15 bp, Homo sapiens
gtctgcaaataaaag

SEQ ID NO: 11255 - DNA, 15 bp, Homo sapiens
ggtctgcaaataaaa

SEQ ID NO: 11256 - DNA, 15 bp, Homo sapiens
tggtctgcaaataaa

SEQ ID NO: 11257 - DNA, 15 bp, Homo sapiens
atggtctgcaaataa

SEQ ID NO: 11258 - DNA, 15 bp, Homo sapiens
aatggtctgcaaata

SEQ ID NO: 11259 - DNA, 15 bp, Homo sapiens
taatggtctgcaaat

SEQ ID NO: 11260 - DNA, 15 bp, Homo sapiens
ctaatggtctgcaaa

SEQ ID NO: 11261 - DNA, 15 bp, Homo sapiens
tctaatggtctgcaa

SEQ ID NO: 11262 - DNA, 15 bp, Homo sapiens
ctctaatggtctgca

SEQ ID NO: 11263 - DNA, 15 bp, Homo sapiens
tctctaatggtctgc

SEQ ID NO: 11264 - DNA, 15 bp, Homo sapiens
ttctctaatggtctg

SEQ ID NO: 11265 - DNA, 15 bp, Homo sapiens
tttctctaatggtct

SEQ ID NO: 11266 - DNA, 15 bp, Homo sapiens
ttttctctaatggtc

SEQ ID NO: 11267 - DNA, 15 bp, Homo sapiens
tttttctctaatggt

SEQ ID NO: 11268 - DNA, 15 bp, Homo sapiens
ctttttctctaatgg

SEQ ID NO: 11269 - DNA, 15 bp, Homo sapiens
actttttctctaatg

SEQ ID NO: 11270 - DNA, 15 bp, Homo sapiens
aactttttctctaat

SEQ ID NO: 11271 - DNA, 15 bp, Homo sapiens
caactttttctctaa

SEQ ID NO: 11272 - DNA, 15 bp, Homo sapiens
gcaactttttctcta

SEQ ID NO: 11273 - DNA, 15 bp, Homo sapiens
cgcaactttttctct

SEQ ID NO: 11274 - DNA, 15 bp, Homo sapiens
acgcaactttttctc

SEQ ID NO: 11275 - DNA, 15 bp, Homo sapiens
cacgcaactttttct

SEQ ID NO: 11276 - DNA, 15 bp, Homo sapiens
acacgcaactttttc

SEQ ID NO: 11277 - DNA, 15 bp, Homo sapiens
tacacgcaacttttt

SEQ ID NO: 11278 - DNA, 15 bp, Homo sapiens
ttacacgcaactttt

SEQ ID NO: 11279 - DNA, 15 bp, Homo sapiens
cttacacgcaacttt

SEQ ID NO: 11280 - DNA, 15 bp, Homo sapiens
acttacacgcaactt

SEQ ID NO: 11281 - DNA, 15 bp, Homo sapiens
tacttacacgcaact

SEQ ID NO: 11282 - DNA, 15 bp, Homo sapiens
ctacttacacgcaac

SEQ ID NO: 11283 - DNA, 15 bp, Homo sapiens
tctacttacacgcaa

SEQ ID NO: 11284 - DNA, 15 bp, Homo sapiens
atctacttacacgca

SEQ ID NO: 11285 - DNA, 15 bp, Homo sapiens
tatctacttacacgc

SEQ ID NO: 11286 - DNA, 15 bp, Homo sapiens
ttatctacttacacg

SEQ ID NO: 11287 - DNA, 15 bp, Homo sapiens
cttatctacttacac

SEQ ID NO: 11288 - DNA, 15 bp, Homo sapiens
gcttatctacttaca

SEQ ID NO: 11289 - DNA, 15 bp, Homo sapiens
tgcttatctacttac

SEQ ID NO: 11290 - DNA, 15 bp, Homo sapiens
atgcttatctactta

SEQ ID NO: 11291 - DNA, 15 bp, Homo sapiens
tatgcttatctactt

SEQ ID NO: 11292 - DNA, 15 bp, Homo sapiens
gtatgcttatctact

SEQ ID NO: 11293 - DNA, 15 bp, Homo sapiens
cgtatgcttatctac

SEQ ID NO: 11294 - DNA, 15 bp, Homo sapiens
tcgtatgcttatcta

SEQ ID NO: 11295 - DNA, 15 bp, Homo sapiens
ttcgtatgcttatct

SEQ ID NO: 11296 - DNA, 15 bp, Homo sapiens
attcgtatgcttatc

SEQ ID NO: 11297 - DNA, 15 bp, Homo sapiens
aattcgtatgcttat

SEQ ID NO: 11298 - DNA, 15 bp, Homo sapiens
aaattcgtatgctta

SEQ ID NO: 11299 - DNA, 15 bp, Homo sapiens
taaattcgtatgctt

SEQ ID NO: 11300 - DNA, 15 bp, Homo sapiens
ataaattcgtatgct

SEQ ID NO: 11301 - DNA, 15 bp, Homo sapiens
gataaattcgtatgc

SEQ ID NO: 11302 - DNA, 15 bp, Homo sapiens
tgataaattcgtatg

SEQ ID NO: 11303 - DNA, 15 bp, Homo sapiens
gtgataaattcgtat

SEQ ID NO: 11304 - DNA, 15 bp, Homo sapiens
agtgataaattcgta

SEQ ID NO: 11305 - DNA, 15 bp, Homo sapiens
cagtgataaattcgt

SEQ ID NO: 11306 - DNA, 15 bp, Homo sapiens
gcagtgataaattcg

SEQ ID NO: 11307 - DNA, 15 bp, Homo sapiens
tgcagtgataaattc

SEQ ID NO: 11308 - DNA, 15 bp, Homo sapiens
ttgcagtgataaatt

SEQ ID NO: 11309 - DNA, 15 bp, Homo sapiens
attgcagtgataaat

SEQ ID NO: 11310 - DNA, 15 bp, Homo sapiens
tattgcagtgataaa

SEQ ID NO: 11311 - DNA, 15 bp, Homo sapiens
gtattgcagtgataa

SEQ ID NO: 11312 - DNA, 15 bp, Homo sapiens
agtattgcagtgata

SEQ ID NO: 11313 - DNA, 15 bp, Homo sapiens
cagtattgcagtgat

SEQ ID NO: 11314 - DNA, 15 bp, Homo sapiens
acagtattgcagtga

SEQ ID NO: 11315 - DNA, 15 bp, Homo sapiens
aacagtattgcagtg

SEQ ID NO: 11316 - DNA, 15 bp, Homo sapiens
aaacagtattgcagt

SEQ ID NO: 11317 - DNA, 15 bp, Homo sapiens
caaacagtattgcag

SEQ ID NO: 11318 - DNA, 15 bp, Homo sapiens
acaaacagtattgca

SEQ ID NO: 11319 - DNA, 15 bp, Homo sapiens
tacaaacagtattgc

SEQ ID NO: 11320 - DNA, 15 bp, Homo sapiens
ctacaaacagtattg

SEQ ID NO: 11321 - DNA, 15 bp, Homo sapiens
tctacaaacagtatt

SEQ ID NO: 11322 - DNA, 15 bp, Homo sapiens
ctctacaaacagtat

SEQ ID NO: 11323 - DNA, 15 bp, Homo sapiens
tctctacaaacagta

SEQ ID NO: 11324 - DNA, 15 bp, Homo sapiens
atctctacaaacagt

SEQ ID NO: 11325 - DNA, 15 bp, Homo sapiens
gatctctacaaacag

SEQ ID NO: 11326 - DNA, 15 bp, Homo sapiens
tgatctctacaaaca

SEQ ID NO: 11327 - DNA, 15 bp, Homo sapiens
gtgatctctacaaac

SEQ ID NO: 11328 - DNA, 15 bp, Homo sapiens
tgtgatctctacaaa

SEQ ID NO: 11329 - DNA, 15 bp, Homo sapiens
ctgtgatctctacaa

SEQ ID NO: 11330 - DNA, 15 bp, Homo sapiens
tctgtgatctctaca

SEQ ID NO: 11331 - DNA, 15 bp, Homo sapiens
ctctgtgatctctac

SEQ ID NO: 11332 - DNA, 15 bp, Homo sapiens
gctctgtgatctcta

SEQ ID NO: 11333 - DNA, 15 bp, Homo sapiens
agctctgtgatctct

SEQ ID NO: 11334 - DNA, 15 bp, Homo sapiens
cagctctgtgatctc

SEQ ID NO: 11335 - DNA, 15 bp, Homo sapiens
acagctctgtgatct

SEQ ID NO: 11336 - DNA, 15 bp, Homo sapiens
aacagctctgtgatc

SEQ ID NO: 11337 - DNA, 15 bp, Homo sapiens
taacagctctgtgat

SEQ ID NO: 11338 - DNA, 15 bp, Homo sapiens
ctaacagctctgtga

SEQ ID NO: 11339 - DNA, 15 bp, Homo sapiens
cctaacagctctgtg

SEQ ID NO: 11340 - DNA, 15 bp, Homo sapiens
gcctaacagctctgt

SEQ ID NO: 11341 - DNA, 15 bp, Homo sapiens
agcctaacagctctg

SEQ ID NO: 11342 - DNA, 15 bp, Homo sapiens
tagcctaacagctct

SEQ ID NO: 11343 - DNA, 15 bp, Homo sapiens
ctagcctaacagctc

SEQ ID NO: 11344 - DNA, 15 bp, Homo sapiens
cctagcctaacagct

SEQ ID NO: 11345 - DNA, 15 bp, Homo sapiens
tcctagcctaacagc

SEQ ID NO: 11346 - DNA, 15 bp, Homo sapiens
ttcctagcctaacag

SEQ ID NO: 11347 - DNA, 15 bp, Homo sapiens
cttcctagcctaaca

SEQ ID NO: 11348 - DNA, 15 bp, Homo sapiens
tcttcctagcctaac

SEQ ID NO: 11349 - DNA, 15 bp, Homo sapiens
ttcttcctagcctaa

SEQ ID NO: 11350 - DNA, 15 bp, Homo sapiens
cttcttcctagccta

SEQ ID NO: 11351 - DNA, 15 bp, Homo sapiens
acttcttcctagcct

SEQ ID NO: 11352 - DNA, 15 bp, Homo sapiens
aacttcttcctagcc

SEQ ID NO: 11353 - DNA, 15 bp, Homo sapiens
aaacttcttcctagc

SEQ ID NO: 11354 - DNA, 15 bp, Homo sapiens
aaaacttcttcctag

SEQ ID NO: 11355 - DNA, 15 bp, Homo sapiens
aaaaacttcttccta

SEQ ID NO: 11356 - DNA, 15 bp, Homo sapiens
taaaaacttcttcct

SEQ ID NO: 11357 - DNA, 15 bp, Homo sapiens
ctaaaaacttcttcc

SEQ ID NO: 11358 - DNA, 15 bp, Homo sapiens
gctaaaaacttcttc

SEQ ID NO: 11359 - DNA, 15 bp, Homo sapiens
tgctaaaaacttctt

SEQ ID NO: 11360 - DNA, 15 bp, Homo sapiens
ctgctaaaaacttct

SEQ ID NO: 11361 - DNA, 15 bp, Homo sapiens
actgctaaaaacttc

SEQ ID NO: 11362 - DNA, 15 bp, Homo sapiens
aactgctaaaaactt

SEQ ID NO: 11363 - DNA, 15 bp, Homo sapiens
taactgctaaaaact

SEQ ID NO: 11364 - DNA, 15 bp, Homo sapiens
ctaactgctaaaaac

SEQ ID NO: 11365 - DNA, 15 bp, Homo sapiens
gctaactgctaaaaa

SEQ ID NO: 11366 - DNA, 15 bp, Homo sapiens
tgctaactgctaaaa

SEQ ID NO: 11367 - DNA, 15 bp, Homo sapiens
gtgctaactgctaaa

SEQ ID NO: 11368 - DNA, 15 bp, Homo sapiens
agtgctaactgctaa

SEQ ID NO: 11369 - DNA, 15 bp, Homo sapiens
tagtgctaactgcta

SEQ ID NO: 11370 - DNA, 15 bp, Homo sapiens
ctagtgctaactgct

SEQ ID NO: 11371 - DNA, 15 bp, Homo sapiens
tctagtgctaactgc

SEQ ID NO: 11372 - DNA, 15 bp, Homo sapiens
ttctagtgctaactg

SEQ ID NO: 11373 - DNA, 15 bp, Homo sapiens
tttctagtgctaact

SEQ ID NO: 11374 - DNA, 15 bp, Homo sapiens
ctttctagtgctaac

SEQ ID NO: 11375 - DNA, 15 bp, Homo sapiens
gctttctagtgctaa

SEQ ID NO: 11376 - DNA, 15 bp, Homo sapiens
tgctttctagtgcta

SEQ ID NO: 11377 - DNA, 15 bp, Homo sapiens
ttgctttctagtgct

SEQ ID NO: 11378 - DNA, 15 bp, Homo sapiens
tttgctttctagtgc

SEQ ID NO: 11379 - DNA, 15 bp, Homo sapiens
ttttgctttctagtg

SEQ ID NO: 11380 - DNA, 15 bp, Homo sapiens
gttttgctttctagt

SEQ ID NO: 11381 - DNA, 15 bp, Homo sapiens
agttttgctttctag

SEQ ID NO: 11382 - DNA, 15 bp, Homo sapiens
aagttttgctttcta

SEQ ID NO: 11383 - DNA, 15 bp, Homo sapiens
aaagttttgctttct

SEQ ID NO: 11384 - DNA, 15 bp, Homo sapiens
caaagttttgctttc

SEQ ID NO: 11385 - DNA, 15 bp, Homo sapiens
ccaaagttttgcttt

SEQ ID NO: 11386 - DNA, 15 bp, Homo sapiens
tccaaagttttgctt

SEQ ID NO: 11387 - DNA, 15 bp, Homo sapiens
ttccaaagttttgct

SEQ ID NO: 11388 - DNA, 15 bp, Homo sapiens
tttccaaagttttgc

SEQ ID NO: 11389 - DNA, 15 bp, Homo sapiens
gtttccaaagttttg

SEQ ID NO: 11390 - DNA, 15 bp, Homo sapiens
agtttccaaagtttt

SEQ ID NO: 11391 - DNA, 15 bp, Homo sapiens
aagtttccaaagttt

SEQ ID NO: 11392 - DNA, 15 bp, Homo sapiens
gaagtttccaaagtt

SEQ ID NO: 11393 - DNA, 15 bp, Homo sapiens
ggaagtttccaaagt

SEQ ID NO: 11394 - DNA, 15 bp, Homo sapiens
tggaagtttccaaag

SEQ ID NO: 11395 - DNA, 15 bp, Homo sapiens
atggaagtttccaaa

SEQ ID NO: 11396 - DNA, 15 bp, Homo sapiens
aatggaagtttccaa

SEQ ID NO: 11397 - DNA, 15 bp, Homo sapiens
aaatggaagtttcca

SEQ ID NO: 11398 - DNA, 15 bp, Homo sapiens
gaaatggaagtttcc

SEQ ID NO: 11399 - DNA, 15 bp, Homo sapiens
tgaaatggaagtttc

SEQ ID NO: 11400 - DNA, 15 bp, Homo sapiens
atgaaatggaagttt

SEQ ID NO: 11401 - DNA, 15 bp, Homo sapiens
gatgaaatggaagtt

SEQ ID NO: 11402 - DNA, 15 bp, Homo sapiens
tgatgaaatggaagt

SEQ ID NO: 11403 - DNA, 15 bp, Homo sapiens
ttgatgaaatggaag

SEQ ID NO: 11404 - DNA, 15 bp, Homo sapiens
tttgatgaaatggaa

SEQ ID NO: 11405 - DNA, 15 bp, Homo sapiens
ttttgatgaaatgga

SEQ ID NO: 11406 - DNA, 15 bp, Homo sapiens
cttttgatgaaatgg

SEQ ID NO: 11407 - DNA, 15 bp, Homo sapiens
acttttgatgaaatg

SEQ ID NO: 11408 - DNA, 15 bp, Homo sapiens
cacttttgatgaaat

SEQ ID NO: 11409 - DNA, 15 bp, Homo sapiens
tcacttttgatgaaa

SEQ ID NO: 11410 - DNA, 15 bp, Homo sapiens
gtcacttttgatgaa

SEQ ID NO: 11411 - DNA, 15 bp, Homo sapiens
ggtcacttttgatga

SEQ ID NO: 11412 - DNA, 15 bp, Homo sapiens
aggtcacttttgatg

SEQ ID NO: 11413 - DNA, 15 bp, Homo sapiens
gaggtcacttttgat

SEQ ID NO: 11414 - DNA, 15 bp, Homo sapiens
tgaggtcacttttga

SEQ ID NO: 11415 - DNA, 15 bp, Homo sapiens
atgaggtcacttttg

SEQ ID NO: 11416 - DNA, 15 bp, Homo sapiens
gatgaggtcactttt

SEQ ID NO: 11417 - DNA, 15 bp, Homo sapiens
agatgaggtcacttt

SEQ ID NO: 11418 - DNA, 15 bp, Homo sapiens
cagatgaggtcactt

SEQ ID NO: 11419 - DNA, 15 bp, Homo sapiens
tcagatgaggtcact

SEQ ID NO: 11420 - DNA, 15 bp, Homo sapiens
ctcagatgaggtcac

SEQ ID NO: 11421 - DNA, 15 bp, Homo sapiens
actcagatgaggtca

SEQ ID NO: 11422 - DNA, 15 bp, Homo sapiens
tactcagatgaggtc

SEQ ID NO: 11423 - DNA, 15 bp, Homo sapiens
ctactcagatgaggt

SEQ ID NO: 11424 - DNA, 15 bp, Homo sapiens
cctactcagatgagg

SEQ ID NO: 11425 - DNA, 15 bp, Homo sapiens
ccctactcagatgag

SEQ ID NO: 11426 - DNA, 15 bp, Homo sapiens
gccctactcagatga

SEQ ID NO: 11427 - DNA, 15 bp, Homo sapiens
tgccctactcagatg

SEQ ID NO: 11428 - DNA, 15 bp, Homo sapiens
atgccctactcagat

SEQ ID NO: 11429 - DNA, 15 bp, Homo sapiens
catgccctactcaga

SEQ ID NO: 11430 - DNA, 15 bp, Homo sapiens
acatgccctactcag

SEQ ID NO: 11431 - DNA, 15 bp, Homo sapiens
cacatgccctactca

SEQ ID NO: 11432 - DNA, 15 bp, Homo sapiens
tcacatgccctactc

SEQ ID NO: 11433 - DNA, 15 bp, Homo sapiens
ctcacatgccctact

SEQ ID NO: 11434 - DNA, 15 bp, Homo sapiens
cctcacatgccctac

SEQ ID NO: 11435 - DNA, 15 bp, Homo sapiens
ccctcacatgcccta

SEQ ID NO: 11436 - DNA, 15 bp, Homo sapiens
tccctcacatgccct

SEQ ID NO: 11437 - DNA, 15 bp, Homo sapiens
ttccctcacatgccc

SEQ ID NO: 11438 - DNA, 15 bp, Homo sapiens
cttccctcacatgcc

SEQ ID NO: 11439 - DNA, 15 bp, Homo sapiens
ccttccctcacatgc

SEQ ID NO: 11440 - DNA, 15 bp, Homo sapiens
tccttccctcacatg

SEQ ID NO: 11441 - DNA, 15 bp, Homo sapiens
gtccttccctcacat

SEQ ID NO: 11442 - DNA, 15 bp, Homo sapiens
ggtccttccctcaca

SEQ ID NO: 11443 - DNA, 15 bp, Homo sapiens
aggtccttccctcac

SEQ ID NO: 11444 - DNA, 15 bp, Homo sapiens
aaggtccttccctca

SEQ ID NO: 11445 - DNA, 15 bp, Homo sapiens
aaaggtccttccctc

SEQ ID NO: 11446 - DNA, 15 bp, Homo sapiens
aaaaggtccttccct

SEQ ID NO: 11447 - DNA, 15 bp, Homo sapiens
aaaaaggtccttccc

SEQ ID NO: 11448 - DNA, 15 bp, Homo sapiens
taaaaaggtccttcc

SEQ ID NO: 11449 - DNA, 15 bp, Homo sapiens
gtaaaaaggtccttc

SEQ ID NO: 11450 - DNA, 15 bp, Homo sapiens
agtaaaaaggtcctt

SEQ ID NO: 11451 - DNA, 15 bp, Homo sapiens
gagtaaaaaggtcct

SEQ ID NO: 11452 - DNA, 15 bp, Homo sapiens
cgagtaaaaaggtcc

SEQ ID NO: 11453 - DNA, 15 bp, Homo sapiens
tcgagtaaaaaggtc

SEQ ID NO: 11454 - DNA, 15 bp, Homo sapiens
gtcgagtaaaaaggt

SEQ ID NO: 11455 - DNA, 15 bp, Homo sapiens
tgtcgagtaaaaagg

SEQ ID NO: 11456 - DNA, 15 bp, Homo sapiens
ttgtcgagtaaaaag

SEQ ID NO: 11457 - DNA, 15 bp, Homo sapiens
cttgtcgagtaaaaa

SEQ ID NO: 11458 - DNA, 15 bp, Homo sapiens
ccttgtcgagtaaaa

SEQ ID NO: 11459 - DNA, 15 bp, Homo sapiens
cccttgtcgagtaaa

SEQ ID NO: 11460 - DNA, 15 bp, Homo sapiens
ccccttgtcgagtaa

SEQ ID NO: 11461 - DNA, 15 bp, Homo sapiens
tccccttgtcgagta

SEQ ID NO: 11462 - DNA, 15 bp, Homo sapiens
ttccccttgtcgagt

SEQ ID NO: 11463 - DNA, 15 bp, Homo sapiens
gttccccttgtcgag

SEQ ID NO: 11464 - DNA, 15 bp, Homo sapiens
agttccccttgtcga

SEQ ID NO: 11465 - DNA, 15 bp, Homo sapiens
aagttccccttgtcg

SEQ ID NO: 11466 - DNA, 15 bp, Homo sapiens
caagttccccttgtc

SEQ ID NO: 11467 - DNA, 15 bp, Homo sapiens
gcaagttccccttgt

SEQ ID NO: 11468 - DNA, 15 bp, Homo sapiens
ggcaagttccccttg

SEQ ID NO: 11469 - DNA, 15 bp, Homo sapiens
tggcaagttcccctt

SEQ ID NO: 11470 - DNA, 15 bp, Homo sapiens
ctggcaagttcccct

SEQ ID NO: 11471 - DNA, 15 bp, Homo sapiens
actggcaagttcccc

SEQ ID NO: 11472 - DNA, 15 bp, Homo sapiens
aactggcaagttccc

SEQ ID NO: 11473 - DNA, 15 bp, Homo sapiens
gaactggcaagttcc

SEQ ID NO: 11474 - DNA, 15 bp, Homo sapiens
agaactggcaagttc

SEQ ID NO: 11475 - DNA, 15 bp, Homo sapiens
aagaactggcaagtt

SEQ ID NO: 11476 - DNA, 15 bp, Homo sapiens
caagaactggcaagt

SEQ ID NO: 11477 - DNA, 15 bp, Homo sapiens
acaagaactggcaag

SEQ ID NO: 11478 - DNA, 15 bp, Homo sapiens
aacaagaactggcaa

SEQ ID NO: 11479 - DNA, 15 bp, Homo sapiens
aaacaagaactggca

SEQ ID NO: 11480 - DNA, 15 bp, Homo sapiens
caaacaagaactggc

SEQ ID NO: 11481 - DNA, 15 bp, Homo sapiens
acaaacaagaactgg

SEQ ID NO: 11482 - DNA, 15 bp, Homo sapiens
cacaaacaagaactg

SEQ ID NO: 11483 - DNA, 15 bp, Homo sapiens
tcacaaacaagaact

SEQ ID NO: 11484 - DNA, 15 bp, Homo sapiens
ttcacaaacaagaac

SEQ ID NO: 11485 - DNA, 15 bp, Homo sapiens
gttcacaaacaagaa

SEQ ID NO: 11486 - DNA, 15 bp, Homo sapiens
ggttcacaaacaaga

SEQ ID NO: 11487 - DNA, 15 bp, Homo sapiens
aggttcacaaacaag

SEQ ID NO: 11488 - DNA, 15 bp, Homo sapiens
aaggttcacaaacaa

SEQ ID NO: 11489 - DNA, 15 bp, Homo sapiens
caaggttcacaaaca

SEQ ID NO: 11490 - DNA, 15 bp, Homo sapiens
tcaaggttcacaaac

SEQ ID NO: 11491 - DNA, 15 bp, Homo sapiens
ttcaaggttcacaaa

SEQ ID NO: 11492 - DNA, 15 bp, Homo sapiens
cttcaaggttcacaa

SEQ ID NO: 11493 - DNA, 15 bp, Homo sapiens
tcttcaaggttcaca

SEQ ID NO: 11494 - DNA, 15 bp, Homo sapiens
ttcttcaaggttcac

SEQ ID NO: 11495 - DNA, 15 bp, Homo sapiens
tttcttcaaggttca

SEQ ID NO: 11496 - DNA, 15 bp, Homo sapiens
ctttcttcaaggttc

SEQ ID NO: 11497 - DNA, 15 bp, Homo sapiens
actttcttcaaggtt

SEQ ID NO: 11498 - DNA, 15 bp, Homo sapiens
cactttcttcaaggt

SEQ ID NO: 11499 - DNA, 15 bp, Homo sapiens
ccactttcttcaagg

SEQ ID NO: 11500 - DNA, 15 bp, Homo sapiens
tccactttcttcaag

SEQ ID NO: 11501 - DNA, 15 bp, Homo sapiens
ctccactttcttcaa

SEQ ID NO: 11502 - DNA, 15 bp, Homo sapiens
gctccactttcttca

SEQ ID NO: 11503 - DNA, 15 bp, Homo sapiens
tgctccactttcttc

SEQ ID NO: 11504 - DNA, 15 bp, Homo sapiens
atgctccactttctt

SEQ ID NO: 11505 - DNA, 15 bp, Homo sapiens
aatgctccactttct

SEQ ID NO: 11506 - DNA, 15 bp, Homo sapiens
aaatgctccactttc

SEQ ID NO: 11507 - DNA, 15 bp, Homo sapiens
aaaatgctccacttt

SEQ ID NO: 11508 - DNA, 15 bp, Homo sapiens
aaaaatgctccactt

SEQ ID NO: 11509 - DNA, 15 bp, Homo sapiens
taaaaatgctccact

SEQ ID NO: 11510 - DNA, 15 bp, Homo sapiens
ataaaaatgctccac

SEQ ID NO: 11511 - DNA, 15 bp, Homo sapiens
aataaaaatgctcca

SEQ ID NO: 11512 - DNA, 15 bp, Homo sapiens
aaataaaaatgctcc

SEQ ID NO: 11513 - DNA, 15 bp, Homo sapiens
aaaataaaaatgctc

SEQ ID NO: 11514 - DNA, 15 bp, Homo sapiens
caaaataaaaatgct

SEQ ID NO: 11515 - DNA, 15 bp, Homo sapiens
ccaaaataaaaatgc

SEQ ID NO: 11516 - DNA, 15 bp, Homo sapiens
cccaaaataaaaatg

SEQ ID NO: 11517 - DNA, 15 bp, Homo sapiens
tcccaaaataaaaat

SEQ ID NO: 11518 - DNA, 15 bp, Homo sapiens
gtcccaaaataaaaa

SEQ ID NO: 11519 - DNA, 15 bp, Homo sapiens
ggtcccaaaataaaa

SEQ ID NO: 11520 - DNA, 15 bp, Homo sapiens
tggtcccaaaataaa

SEQ ID NO: 11521 - DNA, 15 bp, Homo sapiens
atggtcccaaaataa

SEQ ID NO: 11522 - DNA, 15 bp, Homo sapiens
aatggtcccaaaata

SEQ ID NO: 11523 - DNA, 15 bp, Homo sapiens
gaatggtcccaaaat

SEQ ID NO: 11524 - DNA, 15 bp, Homo sapiens
agaatggtcccaaaa

SEQ ID NO: 11525 - DNA, 15 bp, Homo sapiens
tagaatggtcccaaa

SEQ ID NO: 11526 - DNA, 15 bp, Homo sapiens
ctagaatggtcccaa

SEQ ID NO: 11527 - DNA, 15 bp, Homo sapiens
cctagaatggtccca

SEQ ID NO: 11528 - DNA, 15 bp, Homo sapiens
acctagaatggtccc

SEQ ID NO: 11529 - DNA, 15 bp, Homo sapiens
aacctagaatggtcc

SEQ ID NO: 11530 - DNA, 15 bp, Homo sapiens
caacctagaatggtc

SEQ ID NO: 11531 - DNA, 15 bp, Homo sapiens
acaacctagaatggt

SEQ ID NO: 11532 - DNA, 15 bp, Homo sapiens
cacaacctagaatgg

SEQ ID NO: 11533 - DNA, 15 bp, Homo sapiens
ccacaacctagaatg

SEQ ID NO: 11534 - DNA, 15 bp, Homo sapiens
accacaacctagaat

SEQ ID NO: 11535 - DNA, 15 bp, Homo sapiens
taccacaacctagaa

SEQ ID NO: 11536 - DNA, 15 bp, Homo sapiens
ctaccacaacctaga

SEQ ID NO: 11537 - DNA, 15 bp, Homo sapiens
actaccacaacctag

SEQ ID NO: 11538 - DNA, 15 bp, Homo sapiens
aactaccacaaccta

SEQ ID NO: 11539 - DNA, 15 bp, Homo sapiens
gaactaccacaacct

SEQ ID NO: 11540 - DNA, 15 bp, Homo sapiens
ggaactaccacaacc

SEQ ID NO: 11541 - DNA, 15 bp, Homo sapiens
aggaactaccacaac

SEQ ID NO: 11542 - DNA, 15 bp, Homo sapiens
aaggaactaccacaa

SEQ ID NO: 11543 - DNA, 15 bp, Homo sapiens
caaggaactaccaca

SEQ ID NO: 11544 - DNA, 15 bp, Homo sapiens
ccaaggaactaccac

SEQ ID NO: 11545 - DNA, 15 bp, Homo sapiens
accaaggaactacca

SEQ ID NO: 11546 - DNA, 15 bp, Homo sapiens
taccaaggaactacc

SEQ ID NO: 11547 - DNA, 15 bp, Homo sapiens
gtaccaaggaactac

SEQ ID NO: 11548 - DNA, 15 bp, Homo sapiens
agtaccaaggaacta

SEQ ID NO: 11549 - DNA, 15 bp, Homo sapiens
gagtaccaaggaact

SEQ ID NO: 11550 - DNA, 15 bp, Homo sapiens
cgagtaccaaggaac

SEQ ID NO: 11551 - DNA, 15 bp, Homo sapiens
ccgagtaccaaggaa

SEQ ID NO: 11552 - DNA, 15 bp, Homo sapiens
cccgagtaccaagga

SEQ ID NO: 11553 - DNA, 15 bp, Homo sapiens
ccccgagtaccaagg

SEQ ID NO: 11554 - DNA, 15 bp, Homo sapiens
accccgagtaccaag

SEQ ID NO: 11555 - DNA, 15 bp, Homo sapiens
aaccccgagtaccaa

SEQ ID NO: 11556 - DNA, 15 bp, Homo sapiens
caaccccgagtacca

SEQ ID NO: 11557 - DNA, 15 bp, Homo sapiens
ccaaccccgagtacc

SEQ ID NO: 11558 - DNA, 15 bp, Homo sapiens
tccaaccccgagtac

SEQ ID NO: 11559 - DNA, 15 bp, Homo sapiens
ctccaaccccgagta

SEQ ID NO: 11560 - DNA, 15 bp, Homo sapiens
tctccaaccccgagt

SEQ ID NO: 11561 - DNA, 15 bp, Homo sapiens
ttctccaaccccgag

SEQ ID NO: 11562 - DNA, 15 bp, Homo sapiens
attctccaaccccga

SEQ ID NO: 11563 - DNA, 15 bp, Homo sapiens
gattctccaaccccg

SEQ ID NO: 11564 - DNA, 15 bp, Homo sapiens
agattctccaacccc

SEQ ID NO: 11565 - DNA, 15 bp, Homo sapiens
gagattctccaaccc

SEQ ID NO: 11566 - DNA, 15 bp, Homo sapiens
ggagattctccaacc

SEQ ID NO: 11567 - DNA, 15 bp, Homo sapiens
gggagattctccaac

SEQ ID NO: 11568 - DNA, 15 bp, Homo sapiens
agggagattctccaa

SEQ ID NO: 11569 - DNA, 15 bp, Homo sapiens
gagggagattctcca

SEQ ID NO: 11570 - DNA, 15 bp, Homo sapiens
agagggagattctcc

SEQ ID NO: 11571 - DNA, 15 bp, Homo sapiens
cagagggagattctc

SEQ ID NO: 11572 - DNA, 15 bp, Homo sapiens
gcagagggagattct

SEQ ID NO: 11573 - DNA, 15 bp, Homo sapiens
agcagagggagattc

SEQ ID NO: 11574 - DNA, 15 bp, Homo sapiens
cagcagagggagatt

SEQ ID NO: 11575 - DNA, 15 bp, Homo sapiens
gcagcagagggagat

SEQ ID NO: 11576 - DNA, 15 bp, Homo sapiens
agcagcagagggaga

SEQ ID NO: 11577 - DNA, 15 bp, Homo sapiens
cagcagcagagggag

SEQ ID NO: 11578 - DNA, 15 bp, Homo sapiens
ccagcagcagaggga

SEQ ID NO: 11579 - DNA, 15 bp, Homo sapiens
tccagcagcagaggg

SEQ ID NO: 11580 - DNA, 15 bp, Homo sapiens
gtccagcagcagagg

SEQ ID NO: 11581 - DNA, 15 bp, Homo sapiens
ggtccagcagcagag

SEQ ID NO: 11582 - DNA, 15 bp, Homo sapiens
aggtccagcagcaga

SEQ ID NO: 11583 - DNA, 15 bp, Homo sapiens
aaggtccagcagcag

SEQ ID NO: 11584 - DNA, 15 bp, Homo sapiens
gaaggtccagcagca

SEQ ID NO: 11585 - DNA, 15 bp, Homo sapiens
agaaggtccagcagc

SEQ ID NO: 11586 - DNA, 15 bp, Homo sapiens
cagaaggtccagcag

SEQ ID NO: 11587 - DNA, 15 bp, Homo sapiens
gcagaaggtccagca

SEQ ID NO: 11588 - DNA, 15 bp, Homo sapiens
ggcagaaggtccagc

SEQ ID NO: 11589 - DNA, 15 bp, Homo sapiens
aggcagaaggtccag

SEQ ID NO: 11590 - DNA, 15 bp, Homo sapiens
gaggcagaaggtcca

SEQ ID NO: 11591 - DNA, 15 bp, Homo sapiens
ggaggcagaaggtcc

SEQ ID NO: 11592 - DNA, 15 bp, Homo sapiens
aggaggcagaaggtc

SEQ ID NO: 11593 - DNA, 15 bp, Homo sapiens
gaggaggcagaaggt

SEQ ID NO: 11594 - DNA, 15 bp, Homo sapiens
tgaggaggcagaagg

SEQ ID NO: 11595 - DNA, 15 bp, Homo sapiens
atgaggaggcagaag

SEQ ID NO: 11596 - DNA, 15 bp, Homo sapiens
catgaggaggcagaa

SEQ ID NO: 11597 - DNA, 15 bp, Homo sapiens
gcatgaggaggcaga

SEQ ID NO: 11598 - DNA, 15 bp, Homo sapiens
agcatgaggaggcag

SEQ ID NO: 11599 - DNA, 15 bp, Homo sapiens
cagcatgaggaggca

SEQ ID NO: 11600 - DNA, 15 bp, Homo sapiens
acagcatgaggaggc

SEQ ID NO: 11601 - DNA, 15 bp, Homo sapiens
tacagcatgaggagg

SEQ ID NO: 11602 - DNA, 15 bp, Homo sapiens
ttacagcatgaggag

SEQ ID NO: 11603 - DNA, 15 bp, Homo sapiens
attacagcatgagga

SEQ ID NO: 11604 - DNA, 15 bp, Homo sapiens
tattacagcatgagg

SEQ ID NO: 11605 - DNA, 15 bp, Homo sapiens
atattacagcatgag

SEQ ID NO: 11606 - DNA, 15 bp, Homo sapiens
catattacagcatga

SEQ ID NO: 11607 - DNA, 15 bp, Homo sapiens
gcatattacagcatg

SEQ ID NO: 11608 - DNA, 15 bp, Homo sapiens
tgcatattacagcat

SEQ ID NO: 11609 - DNA, 15 bp, Homo sapiens
atgcatattacagca

SEQ ID NO: 11610 - DNA, 15 bp, Homo sapiens
tatgcatattacagc

SEQ ID NO: 11611 - DNA, 15 bp, Homo sapiens
ttatgcatattacag

SEQ ID NO: 11612 - DNA, 15 bp, Homo sapiens
cttatgcatattaca

SEQ ID NO: 11613 - DNA, 15 bp, Homo sapiens
tcttatgcatattac

SEQ ID NO: 11614 - DNA, 15 bp, Homo sapiens
ctcttatgcatatta

SEQ ID NO: 11615 - DNA, 15 bp, Homo sapiens
cctcttatgcatatt

SEQ ID NO: 11616 - DNA, 15 bp, Homo sapiens
acctcttatgcatat

SEQ ID NO: 11617 - DNA, 15 bp, Homo sapiens
cacctcttatgcata

SEQ ID NO: 11618 - DNA, 15 bp, Homo sapiens
acacctcttatgcat

SEQ ID NO: 11619 - DNA, 15 bp, Homo sapiens
gacacctcttatgca

SEQ ID NO: 11620 - DNA, 15 bp, Homo sapiens
ggacacctcttatgc

SEQ ID NO: 11621 - DNA, 15 bp, Homo sapiens
aggacacctcttatg

SEQ ID NO: 11622 - DNA, 15 bp, Homo sapiens
taggacacctcttat

SEQ ID NO: 11623 - DNA, 15 bp, Homo sapiens
ctaggacacctctta

SEQ ID NO: 11624 - DNA, 15 bp, Homo sapiens
tctaggacacctctt

SEQ ID NO: 11625 - DNA, 15 bp, Homo sapiens
ttctaggacacctct

SEQ ID NO: 11626 - DNA, 15 bp, Homo sapiens
cttctaggacacctc

SEQ ID NO: 11627 - DNA, 15 bp, Homo sapiens
acttctaggacacct

SEQ ID NO: 11628 - DNA, 15 bp, Homo sapiens
tacttctaggacacc

SEQ ID NO: 11629 - DNA, 15 bp, Homo sapiens
atacttctaggacac

SEQ ID NO: 11630 - DNA, 15 bp, Homo sapiens
aatacttctaggaca

SEQ ID NO: 11631 - DNA, 15 bp, Homo sapiens
gaatacttctaggac

SEQ ID NO: 11632 - DNA, 15 bp, Homo sapiens
tgaatacttctagga

SEQ ID NO: 11633 - DNA, 15 bp, Homo sapiens
ctgaatacttctagg

SEQ ID NO: 11634 - DNA, 15 bp, Homo sapiens
cctgaatacttctag

SEQ ID NO: 11635 - DNA, 15 bp, Homo sapiens
tcctgaatacttcta

SEQ ID NO: 11636 - DNA, 15 bp, Homo sapiens
ttcctgaatacttct

SEQ ID NO: 11637 - DNA, 15 bp, Homo sapiens
gttcctgaatacttc

SEQ ID NO: 11638 - DNA, 15 bp, Homo sapiens
tgttcctgaatactt

SEQ ID NO: 11639 - DNA, 15 bp, Homo sapiens
ctgttcctgaatact

SEQ ID NO: 11640 - DNA, 15 bp, Homo sapiens
cctgttcctgaatac

SEQ ID NO: 11641 - DNA, 15 bp, Homo sapiens
gcctgttcctgaata

SEQ ID NO: 11642 - DNA, 15 bp, Homo sapiens
agcctgttcctgaat

SEQ ID NO: 11643 - DNA, 15 bp, Homo sapiens
cagcctgttcctgaa

SEQ ID NO: 11644 - DNA, 15 bp, Homo sapiens
acagcctgttcctga

SEQ ID NO: 11645 - DNA, 15 bp, Homo sapiens
cacagcctgttcctg

SEQ ID NO: 11646 - DNA, 15 bp, Homo sapiens
ccacagcctgttcct

SEQ ID NO: 11647 - DNA, 15 bp, Homo sapiens
accacagcctgttcc

SEQ ID NO: 11648 - DNA, 15 bp, Homo sapiens
aaccacagcctgttc

SEQ ID NO: 11649 - DNA, 15 bp, Homo sapiens
caaccacagcctgtt

SEQ ID NO: 11650 - DNA, 15 bp, Homo sapiens
gcaaccacagcctgt

SEQ ID NO: 11651 - DNA, 15 bp, Homo sapiens
agcaaccacagcctg

SEQ ID NO: 11652 - DNA, 15 bp, Homo sapiens
aagcaaccacagcct

SEQ ID NO: 11653 - DNA, 15 bp, Homo sapiens
aaagcaaccacagcc

SEQ ID NO: 11654 - DNA, 15 bp, Homo sapiens
caaagcaaccacagc

SEQ ID NO: 11655 - DNA, 15 bp, Homo sapiens
acaaagcaaccacag

SEQ ID NO: 11656 - DNA, 15 bp, Homo sapiens
aacaaagcaaccaca

SEQ ID NO: 11657 - DNA, 15 bp, Homo sapiens
caacaaagcaaccac

SEQ ID NO: 11658 - DNA, 15 bp, Homo sapiens
acaacaaagcaacca

SEQ ID NO: 11659 - DNA, 15 bp, Homo sapiens
aacaacaaagcaacc

SEQ ID NO: 11660 - DNA, 15 bp, Homo sapiens
gaacaacaaagcaac

SEQ ID NO: 11661 - DNA, 15 bp, Homo sapiens
agaacaacaaagcaa

SEQ ID NO: 11662 - DNA, 15 bp, Homo sapiens
cagaacaacaaagca

SEQ ID NO: 11663 - DNA, 15 bp, Homo sapiens
acagaacaacaaagc

SEQ ID NO: 11664 - DNA, 15 bp, Homo sapiens
cacagaacaacaaag

SEQ ID NO: 11665 - DNA, 15 bp, Homo sapiens
tcacagaacaacaaa

SEQ ID NO: 11666 - DNA, 15 bp, Homo sapiens
gtcacagaacaacaa

SEQ ID NO: 11667 - DNA, 15 bp, Homo sapiens
agtcacagaacaaca

SEQ ID NO: 11668 - DNA, 15 bp, Homo sapiens
cagtcacagaacaac

SEQ ID NO: 11669 - DNA, 15 bp, Homo sapiens
acagtcacagaacaa

SEQ ID NO: 11670 - DNA, 15 bp, Homo sapiens
aacagtcacagaaca

SEQ ID NO: 11671 - DNA, 15 bp, Homo sapiens
caacagtcacagaac

SEQ ID NO: 11672 - DNA, 15 bp, Homo sapiens
tcaacagtcacagaa

SEQ ID NO: 11673 - DNA, 15 bp, Homo sapiens
ttcaacagtcacaga

SEQ ID NO: 11674 - DNA, 15 bp, Homo sapiens
gttcaacagtcacag

SEQ ID NO: 11675 - DNA, 15 bp, Homo sapiens
agttcaacagtcaca

SEQ ID NO: 11676 - DNA, 15 bp, Homo sapiens
gagttcaacagtcac

SEQ ID NO: 11677 - DNA, 15 bp, Homo sapiens
agagttcaacagtca

SEQ ID NO: 11678 - DNA, 15 bp, Homo sapiens
aagagttcaacagtc

SEQ ID NO: 11679 - DNA, 15 bp, Homo sapiens
aaagagttcaacagt

SEQ ID NO: 11680 - DNA, 15 bp, Homo sapiens
taaagagttcaacag

SEQ ID NO: 11681 - DNA, 15 bp, Homo sapiens
ataaagagttcaaca

SEQ ID NO: 11682 - DNA, 15 bp, Homo sapiens
tataaagagttcaac

SEQ ID NO: 11683 - DNA, 15 bp, Homo sapiens
atataaagagttcaa

SEQ ID NO: 11684 - DNA, 15 bp, Homo sapiens
tatataaagagttca

SEQ ID NO: 11685 - DNA, 15 bp, Homo sapiens
ctatataaagagttc

SEQ ID NO: 11686 - DNA, 15 bp, Homo sapiens
gctatataaagagtt

SEQ ID NO: 11687 - DNA, 15 bp, Homo sapiens
tgctatataaagagt

SEQ ID NO: 11688 - DNA, 15 bp, Homo sapiens
ctgctatataaagag

SEQ ID NO: 11689 - DNA, 15 bp, Homo sapiens
actgctatataaaga

SEQ ID NO: 11690 - DNA, 15 bp, Homo sapiens
tactgctatataaag

SEQ ID NO: 11691 - DNA, 15 bp, Homo sapiens
gtactgctatataaa

SEQ ID NO: 11692 - DNA, 15 bp, Homo sapiens
agtactgctatataa

SEQ ID NO: 11693 - DNA, 15 bp, Homo sapiens
aagtactgctatata

SEQ ID NO: 11694 - DNA, 15 bp, Homo sapiens
aaagtactgctatat

SEQ ID NO: 11695 - DNA, 15 bp, Homo sapiens
aaaagtactgctata

SEQ ID NO: 11696 - DNA, 15 bp, Homo sapiens
aaaaagtactgctat

SEQ ID NO: 11697 - DNA, 15 bp, Homo sapiens
aaaaaagtactgcta

SEQ ID NO: 11698 - DNA, 15 bp, Homo sapiens
taaaaaagtactgct

SEQ ID NO: 11699 - DNA, 15 bp, Homo sapiens
ttaaaaaagtactgc

SEQ ID NO: 11700 - DNA, 15 bp, Homo sapiens
cttaaaaaagtactg

SEQ ID NO: 11701 - DNA, 15 bp, Homo sapiens
gcttaaaaaagtact

SEQ ID NO: 11702 - DNA, 15 bp, Homo sapiens
agcttaaaaaagtac

SEQ ID NO: 11703 - DNA, 15 bp, Homo sapiens
cagcttaaaaaagta

SEQ ID NO: 11704 - DNA, 15 bp, Homo sapiens
acagcttaaaaaagt

SEQ ID NO: 11705 - DNA, 15 bp, Homo sapiens
tacagcttaaaaaag

SEQ ID NO: 11706 - DNA, 15 bp, Homo sapiens
gtacagcttaaaaaa

SEQ ID NO: 11707 - DNA, 15 bp, Homo sapiens
agtacagcttaaaaa

SEQ ID NO: 11708 - DNA, 15 bp, Homo sapiens
tagtacagcttaaaa

SEQ ID NO: 11709 - DNA, 15 bp, Homo sapiens
ttagtacagcttaaa

SEQ ID NO: 11710 - DNA, 15 bp, Homo sapiens
attagtacagcttaa

SEQ ID NO: 11711 - DNA, 15 bp, Homo sapiens
aattagtacagctta

SEQ ID NO: 11712 - DNA, 15 bp, Homo sapiens
caattagtacagctt

SEQ ID NO: 11713 - DNA, 15 bp, Homo sapiens
tcaattagtacagct

SEQ ID NO: 11714 - DNA, 15 bp, Homo sapiens
ctcaattagtacagc

SEQ ID NO: 11715 - DNA, 15 bp, Homo sapiens
gctcaattagtacag

SEQ ID NO: 11716 - DNA, 15 bp, Homo sapiens
tgctcaattagtaca

SEQ ID NO: 11717 - DNA, 15 bp, Homo sapiens
atgctcaattagtac

SEQ ID NO: 11718 - DNA, 15 bp, Homo sapiens
aatgctcaattagta

SEQ ID NO: 11719 - DNA, 15 bp, Homo sapiens
aaatgctcaattagt

SEQ ID NO: 11720 - DNA, 15 bp, Homo sapiens
taaatgctcaattag

SEQ ID NO: 11721 - DNA, 15 bp, Homo sapiens
ataaatgctcaatta

SEQ ID NO: 11722 - DNA, 15 bp, Homo sapiens
aataaatgctcaatt

SEQ ID NO: 11723 - DNA, 15 bp, Homo sapiens
taataaatgctcaat

SEQ ID NO: 11724 - DNA, 15 bp, Homo sapiens
ataataaatgctcaa

SEQ ID NO: 11725 - DNA, 15 bp, Homo sapiens
cataataaatgctca

SEQ ID NO: 11726 - DNA, 15 bp, Homo sapiens
acataataaatgctc

SEQ ID NO: 11727 - DNA, 15 bp, Homo sapiens
cacataataaatgct

SEQ ID NO: 11728 - DNA, 15 bp, Homo sapiens
acacataataaatgc

SEQ ID NO: 11729 - DNA, 15 bp, Homo sapiens
gacacataataaatg

SEQ ID NO: 11730 - DNA, 15 bp, Homo sapiens
tgacacataataaat

SEQ ID NO: 11731 - DNA, 15 bp, Homo sapiens
ctgacacataataaa

SEQ ID NO: 11732 - DNA, 15 bp, Homo sapiens
actgacacataataa

SEQ ID NO: 11733 - DNA, 15 bp, Homo sapiens
aactgacacataata

SEQ ID NO: 11734 - DNA, 15 bp, Homo sapiens
taactgacacataat

SEQ ID NO: 11735 - DNA, 15 bp, Homo sapiens
gtaactgacacataa

SEQ ID NO: 11736 - DNA, 15 bp, Homo sapiens
agtaactgacacata

SEQ ID NO: 11737 - DNA, 15 bp, Homo sapiens
cagtaactgacacat

SEQ ID NO: 11738 - DNA, 15 bp, Homo sapiens
acagtaactgacaca

SEQ ID NO: 11739 - DNA, 15 bp, Homo sapiens
cacagtaactgacac

SEQ ID NO: 11740 - DNA, 15 bp, Homo sapiens
gcacagtaactgaca

SEQ ID NO: 11741 - DNA, 15 bp, Homo sapiens
agcacagtaactgac

SEQ ID NO: 11742 - DNA, 15 bp, Homo sapiens
tagcacagtaactga

SEQ ID NO: 11743 - DNA, 15 bp, Homo sapiens
ctagcacagtaactg

SEQ ID NO: 11744 - DNA, 15 bp, Homo sapiens
gctagcacagtaact

SEQ ID NO: 11745 - DNA, 15 bp, Homo sapiens
agctagcacagtaac

SEQ ID NO: 11746 - DNA, 15 bp, Homo sapiens
cagctagcacagtaa

SEQ ID NO: 11747 - DNA, 15 bp, Homo sapiens
gcagctagcacagta

SEQ ID NO: 11748 - DNA, 15 bp, Homo sapiens
agcagctagcacagt

SEQ ID NO: 11749 - DNA, 15 bp, Homo sapiens
cagcagctagcacag

SEQ ID NO: 11750 - DNA, 15 bp, Homo sapiens
ccagcagctagcaca

SEQ ID NO: 11751 - DNA, 15 bp, Homo sapiens
tccagcagctagcac

SEQ ID NO: 11752 - DNA, 15 bp, Homo sapiens
ttccagcagctagca

SEQ ID NO: 11753 - DNA, 15 bp, Homo sapiens
tttccagcagctagc

SEQ ID NO: 11754 - DNA, 15 bp, Homo sapiens
gtttccagcagctag

SEQ ID NO: 11755 - DNA, 15 bp, Homo sapiens
agtttccagcagcta

SEQ ID NO: 11756 - DNA, 15 bp, Homo sapiens
tagtttccagcagct

SEQ ID NO: 11757 - DNA, 15 bp, Homo sapiens
atagtttccagcagc

SEQ ID NO: 11758 - DNA, 15 bp, Homo sapiens
gatagtttccagcag

SEQ ID NO: 11759 - DNA, 15 bp, Homo sapiens
ggatagtttccagca

SEQ ID NO: 11760 - DNA, 15 bp, Homo sapiens
aggatagtttccagc

SEQ ID NO: 11761 - DNA, 15 bp, Homo sapiens
taggatagtttccag

SEQ ID NO: 11762 - DNA, 15 bp, Homo sapiens
gtaggatagtttcca

SEQ ID NO: 11763 - DNA, 15 bp, Homo sapiens
ggtaggatagtttcc

SEQ ID NO: 11764 - DNA, 15 bp, Homo sapiens
gggtaggatagtttc

SEQ ID NO: 11765 - DNA, 15 bp, Homo sapiens
agggtaggatagttt

SEQ ID NO: 11766 - DNA, 15 bp, Homo sapiens
gagggtaggatagtt

SEQ ID NO: 11767 - DNA, 15 bp, Homo sapiens
tgagggtaggatagt

SEQ ID NO: 11768 - DNA, 15 bp, Homo sapiens
ctgagggtaggatag

SEQ ID NO: 11769 - DNA, 15 bp, Homo sapiens
gctgagggtaggata

SEQ ID NO: 11770 - DNA, 15 bp, Homo sapiens
tgctgagggtaggat

SEQ ID NO: 11771 - DNA, 15 bp, Homo sapiens
ctgctgagggtagga

SEQ ID NO: 11772 - DNA, 15 bp, Homo sapiens
actgctgagggtagg

SEQ ID NO: 11773 - DNA, 15 bp, Homo sapiens
gactgctgagggtag

SEQ ID NO: 11774 - DNA, 15 bp, Homo sapiens
agactgctgagggta

SEQ ID NO: 11775 - DNA, 15 bp, Homo sapiens
aagactgctgagggt

SEQ ID NO: 11776 - DNA, 15 bp, Homo sapiens
gaagactgctgaggg

SEQ ID NO: 11777 - DNA, 15 bp, Homo sapiens
agaagactgctgagg

SEQ ID NO: 11778 - DNA, 15 bp, Homo sapiens
cagaagactgctgag

SEQ ID NO: 11779 - DNA, 15 bp, Homo sapiens
ccagaagactgctga

SEQ ID NO: 11780 - DNA, 15 bp, Homo sapiens
accagaagactgctg

SEQ ID NO: 11781 - DNA, 15 bp, Homo sapiens
gaccagaagactgct

SEQ ID NO: 11782 - DNA, 15 bp, Homo sapiens
agaccagaagactgc

SEQ ID NO: 11783 - DNA, 15 bp, Homo sapiens
tagaccagaagactg

SEQ ID NO: 11784 - DNA, 15 bp, Homo sapiens
ttagaccagaagact

SEQ ID NO: 11785 - DNA, 15 bp, Homo sapiens
attagaccagaagac

SEQ ID NO: 11786 - DNA, 15 bp, Homo sapiens
cattagaccagaaga

SEQ ID NO: 11787 - DNA, 15 bp, Homo sapiens
ccattagaccagaag

SEQ ID NO: 11788 - DNA, 15 bp, Homo sapiens
cccattagaccagaa

SEQ ID NO: 11789 - DNA, 15 bp, Homo sapiens
tcccattagaccaga

SEQ ID NO: 11790 - DNA, 15 bp, Homo sapiens
ctcccattagaccag

SEQ ID NO: 11791 - DNA, 15 bp, Homo sapiens
cctcccattagacca

SEQ ID NO: 11792 - DNA, 15 bp, Homo sapiens
acctcccattagacc

SEQ ID NO: 11793 - DNA, 15 bp, Homo sapiens
tacctcccattagac

SEQ ID NO: 11794 - DNA, 15 bp, Homo sapiens
gtacctcccattaga

SEQ ID NO: 11795 - DNA, 15 bp, Homo sapiens
tgtacctcccattag

SEQ ID NO: 11796 - DNA, 15 bp, Homo sapiens
ctgtacctcccatta

SEQ ID NO: 11797 - DNA, 15 bp, Homo sapiens
tctgtacctcccatt

SEQ ID NO: 11798 - DNA, 15 bp, Homo sapiens
gtctgtacctcccat

SEQ ID NO: 11799 - DNA, 15 bp, Homo sapiens
tgtctgtacctccca

SEQ ID NO: 11800 - DNA, 15 bp, Homo sapiens
ctgtctgtacctccc

SEQ ID NO: 11801 - DNA, 15 bp, Homo sapiens
cctgtctgtacctcc

SEQ ID NO: 11802 - DNA, 15 bp, Homo sapiens
gcctgtctgtacctc

SEQ ID NO: 11803 - DNA, 15 bp, Homo sapiens
tgcctgtctgtacct

SEQ ID NO: 11804 - DNA, 15 bp, Homo sapiens
ttgcctgtctgtacc

SEQ ID NO: 11805 - DNA, 15 bp, Homo sapiens
tttgcctgtctgtac

SEQ ID NO: 11806 - DNA, 15 bp, Homo sapiens
atttgcctgtctgta

SEQ ID NO: 11807 - DNA, 15 bp, Homo sapiens
catttgcctgtctgt

SEQ ID NO: 11808 - DNA, 15 bp, Homo sapiens
ccatttgcctgtctg

SEQ ID NO: 11809 - DNA, 15 bp, Homo sapiens
cccatttgcctgtct

SEQ ID NO: 11810 - DNA, 15 bp, Homo sapiens
gcccatttgcctgtc

SEQ ID NO: 11811 - DNA, 15 bp, Homo sapiens
agcccatttgcctgt

SEQ ID NO: 11812 - DNA, 15 bp, Homo sapiens
tagcccatttgcctg

SEQ ID NO: 11813 - DNA, 15 bp, Homo sapiens
atagcccatttgcct

SEQ ID NO: 11814 - DNA, 15 bp, Homo sapiens
catagcccatttgcc

SEQ ID NO: 11815 - DNA, 15 bp, Homo sapiens
tcatagcccatttgc

SEQ ID NO: 11816 - DNA, 15 bp, Homo sapiens
gtcatagcccatttg

SEQ ID NO: 11817 - DNA, 15 bp, Homo sapiens
agtcatagcccattt

SEQ ID NO: 11818 - DNA, 15 bp, Homo sapiens
aagtcatagcccatt

SEQ ID NO: 11819 - DNA, 15 bp, Homo sapiens
aaagtcatagcccat

SEQ ID NO: 11820 - DNA, 15 bp, Homo sapiens
taaagtcatagccca

SEQ ID NO: 11821 - DNA, 15 bp, Homo sapiens
gtaaagtcatagccc

SEQ ID NO: 11822 - DNA, 15 bp, Homo sapiens
tgtaaagtcatagcc

SEQ ID NO: 11823 - DNA, 15 bp, Homo sapiens
ttgtaaagtcatagc

SEQ ID NO: 11824 - DNA, 15 bp, Homo sapiens
cttgtaaagtcatag

SEQ ID NO: 11825 - DNA, 15 bp, Homo sapiens
tcttgtaaagtcata

SEQ ID NO: 11826 - DNA, 15 bp, Homo sapiens
ctcttgtaaagtcat

SEQ ID NO: 11827 - DNA, 15 bp, Homo sapiens
cctcttgtaaagtca

SEQ ID NO: 11828 - DNA, 15 bp, Homo sapiens
gcctcttgtaaagtc

SEQ ID NO: 11829 - DNA, 15 bp, Homo sapiens
agcctcttgtaaagt

SEQ ID NO: 11830 - DNA, 15 bp, Homo sapiens
tagcctcttgtaaag

SEQ ID NO: 11831 - DNA, 15 bp, Homo sapiens
ttagcctcttgtaaa

SEQ ID NO: 11832 - DNA, 15 bp, Homo sapiens
gttagcctcttgtaa

SEQ ID NO: 11833 - DNA, 15 bp, Homo sapiens
agttagcctcttgta

SEQ ID NO: 11834 - DNA, 15 bp, Homo sapiens
aagttagcctcttgt

SEQ ID NO: 11835 - DNA, 15 bp, Homo sapiens
gaagttagcctcttg

SEQ ID NO: 11836 - DNA, 15 bp, Homo sapiens
agaagttagcctctt

SEQ ID NO: 11837 - DNA, 15 bp, Homo sapiens
cagaagttagcctct

SEQ ID NO: 11838 - DNA, 15 bp, Homo sapiens
acagaagttagcctc

SEQ ID NO: 11839 - DNA, 15 bp, Homo sapiens
cacagaagttagcct

SEQ ID NO: 11840 - DNA, 15 bp, Homo sapiens
tcacagaagttagcc

SEQ ID NO: 11841 - DNA, 15 bp, Homo sapiens
atcacagaagttagc

SEQ ID NO: 11842 - DNA, 15 bp, Homo sapiens
catcacagaagttag

SEQ ID NO: 11843 - DNA, 15 bp, Homo sapiens
ccatcacagaagtta

SEQ ID NO: 11844 - DNA, 15 bp, Homo sapiens
tccatcacagaagtt

SEQ ID NO: 11845 - DNA, 15 bp, Homo sapiens
ctccatcacagaagt

SEQ ID NO: 11846 - DNA, 15 bp, Homo sapiens
tctccatcacagaag

SEQ ID NO: 11847 - DNA, 15 bp, Homo sapiens
ctctccatcacagaa

SEQ ID NO: 11848 - DNA, 15 bp, Homo sapiens
tctctccatcacaga

SEQ ID NO: 11849 - DNA, 15 bp, Homo sapiens
ttctctccatcacag

SEQ ID NO: 11850 - DNA, 15 bp, Homo sapiens
cttctctccatcaca

SEQ ID NO: 11851 - DNA, 15 bp, Homo sapiens
acttctctccatcac

SEQ ID NO: 11852 - DNA, 15 bp, Homo sapiens
aacttctctccatca

SEQ ID NO: 11853 - DNA, 15 bp, Homo sapiens
gaacttctctccatc

SEQ ID NO: 11854 - DNA, 15 bp, Homo sapiens
ggaacttctctccat

SEQ ID NO: 11855 - DNA, 15 bp, Homo sapiens
tggaacttctctcca

SEQ ID NO: 11856 - DNA, 15 bp, Homo sapiens
ctggaacttctctcc

SEQ ID NO: 11857 - DNA, 15 bp, Homo sapiens
gctggaacttctctc

SEQ ID NO: 11858 - DNA, 15 bp, Homo sapiens
ggctggaacttctct

SEQ ID NO: 11859 - DNA, 15 bp, Homo sapiens
tggctggaacttctc

SEQ ID NO: 11860 - DNA, 15 bp, Homo sapiens
gtggctggaacttct

SEQ ID NO: 11861 - DNA, 15 bp, Homo sapiens
agtggctggaacttc

SEQ ID NO: 11862 - DNA, 15 bp, Homo sapiens
tagtggctggaactt

SEQ ID NO: 11863 - DNA, 15 bp, Homo sapiens
ttagtggctggaact

SEQ ID NO: 11864 - DNA, 15 bp, Homo sapiens
cttagtggctggaac

SEQ ID NO: 11865 - DNA, 15 bp, Homo sapiens
ccttagtggctggaa

SEQ ID NO: 11866 - DNA, 15 bp, Homo sapiens
cccttagtggctgga

SEQ ID NO: 11867 - DNA, 15 bp, Homo sapiens
tcccttagtggctgg

SEQ ID NO: 11868 - DNA, 15 bp, Homo sapiens
ctcccttagtggctg

SEQ ID NO: 11869 - DNA, 15 bp, Homo sapiens
gctcccttagtggct

SEQ ID NO: 11870 - DNA, 15 bp, Homo sapiens
tgctcccttagtggc

SEQ ID NO: 11871 - DNA, 15 bp, Homo sapiens
gtgctcccttagtgg

SEQ ID NO: 11872 - DNA, 15 bp, Homo sapiens
tgtgctcccttagtg

SEQ ID NO: 11873 - DNA, 15 bp, Homo sapiens
atgtgctcccttagt

SEQ ID NO: 11874 - DNA, 15 bp, Homo sapiens
tatgtgctcccttag

SEQ ID NO: 11875 - DNA, 15 bp, Homo sapiens
ttatgtgctccctta

SEQ ID NO: 11876 - DNA, 15 bp, Homo sapiens
tttatgtgctccctt

SEQ ID NO: 11877 - DNA, 15 bp, Homo sapiens
ttttatgtgctccct

SEQ ID NO: 11878 - DNA, 15 bp, Homo sapiens
tttttatgtgctccc

SEQ ID NO: 11879 - DNA, 15 bp, Homo sapiens
atttttatgtgctcc

SEQ ID NO: 11880 - DNA, 15 bp, Homo sapiens
gatttttatgtgctc

SEQ ID NO: 11881 - DNA, 15 bp, Homo sapiens
tgatttttatgtgct

SEQ ID NO: 11882 - DNA, 15 bp, Homo sapiens
ctgatttttatgtgc

SEQ ID NO: 11883 - DNA, 15 bp, Homo sapiens
tctgatttttatgtg

SEQ ID NO: 11884 - DNA, 15 bp, Homo sapiens
ctctgatttttatgt

SEQ ID NO: 11885 - DNA, 15 bp, Homo sapiens
cctctgatttttatg

SEQ ID NO: 11886 - DNA, 15 bp, Homo sapiens
tcctctgatttttat

SEQ ID NO: 11887 - DNA, 15 bp, Homo sapiens
ctcctctgattttta

SEQ ID NO: 11888 - DNA, 15 bp, Homo sapiens
tctcctctgattttt

SEQ ID NO: 11889 - DNA, 15 bp, Homo sapiens
atctcctctgatttt

SEQ ID NO: 11890 - DNA, 15 bp, Homo sapiens
gatctcctctgattt

SEQ ID NO: 11891 - DNA, 15 bp, Homo sapiens
ggatctcctctgatt

SEQ ID NO: 11892 - DNA, 15 bp, Homo sapiens
aggatctcctctgat

SEQ ID NO: 11893 - DNA, 15 bp, Homo sapiens
taggatctcctctga

SEQ ID NO: 11894 - DNA, 15 bp, Homo sapiens
gtaggatctcctctg

SEQ ID NO: 11895 - DNA, 15 bp, Homo sapiens
ggtaggatctcctct

SEQ ID NO: 11896 - DNA, 15 bp, Homo sapiens
tggtaggatctcctc

SEQ ID NO: 11897 - DNA, 15 bp, Homo sapiens
ttggtaggatctcct

SEQ ID NO: 11898 - DNA, 15 bp, Homo sapiens
cttggtaggatctcc

SEQ ID NO: 11899 - DNA, 15 bp, Homo sapiens
tcttggtaggatctc

SEQ ID NO: 11900 - DNA, 15 bp, Homo sapiens
ttcttggtaggatct

SEQ ID NO: 11901 - DNA, 15 bp, Homo sapiens
attcttggtaggatc

SEQ ID NO: 11902 - DNA, 15 bp, Homo sapiens
aattcttggtaggat

SEQ ID NO: 11903 - DNA, 15 bp, Homo sapiens
caattcttggtagga

SEQ ID NO: 11904 - DNA, 15 bp, Homo sapiens
ccaattcttggtagg

SEQ ID NO: 11905 - DNA, 15 bp, Homo sapiens
cccaattcttggtag

SEQ ID NO: 11906 - DNA, 15 bp, Homo sapiens
tcccaattcttggta

SEQ ID NO: 11907 - DNA, 15 bp, Homo sapiens
ctcccaattcttggt

SEQ ID NO: 11908 - DNA, 15 bp, Homo sapiens
cctcccaattcttgg

SEQ ID NO: 11909 - DNA, 15 bp, Homo sapiens
acctcccaattcttg

SEQ ID NO: 11910 - DNA, 15 bp, Homo sapiens
tacctcccaattctt

SEQ ID NO: 11911 - DNA, 15 bp, Homo sapiens
ctacctcccaattct

SEQ ID NO: 11912 - DNA, 15 bp, Homo sapiens
cctacctcccaattc

SEQ ID NO: 11913 - DNA, 15 bp, Homo sapiens
acctacctcccaatt

SEQ ID NO: 11914 - DNA, 15 bp, Homo sapiens
gacctacctcccaat

SEQ ID NO: 11915 - DNA, 15 bp, Homo sapiens
tgacctacctcccaa

SEQ ID NO: 11916 - DNA, 15 bp, Homo sapiens
ctgacctacctccca

SEQ ID NO: 11917 - DNA, 15 bp, Homo sapiens
cctgacctacctccc

SEQ ID NO: 11918 - DNA, 15 bp, Homo sapiens
ccctgacctacctcc

SEQ ID NO: 11919 - DNA, 15 bp, Homo sapiens
tccctgacctacctc

SEQ ID NO: 11920 - DNA, 15 bp, Homo sapiens
ctccctgacctacct

SEQ ID NO: 11921 - DNA, 15 bp, Homo sapiens
cctccctgacctacc

SEQ ID NO: 11922 - DNA, 15 bp, Homo sapiens
tcctccctgacctac

SEQ ID NO: 11923 - DNA, 15 bp, Homo sapiens
ctcctccctgaccta

SEQ ID NO: 11924 - DNA, 15 bp, Homo sapiens
tctcctccctgacct

SEQ ID NO: 11925 - DNA, 15 bp, Homo sapiens
gtctcctccctgacc

SEQ ID NO: 11926 - DNA, 15 bp, Homo sapiens
agtctcctccctgac

SEQ ID NO: 11927 - DNA, 15 bp, Homo sapiens
aagtctcctccctga

SEQ ID NO: 11928 - DNA, 15 bp, Homo sapiens
gaagtctcctccctg

SEQ ID NO: 11929 - DNA, 15 bp, Homo sapiens
agaagtctcctccct

SEQ ID NO: 11930 - DNA, 15 bp, Homo sapiens
aagaagtctcctccc

SEQ ID NO: 11931 - DNA, 15 bp, Homo sapiens
aaagaagtctcctcc

SEQ ID NO: 11932 - DNA, 15 bp, Homo sapiens
caaagaagtctcctc

SEQ ID NO: 11933 - DNA, 15 bp, Homo sapiens
tcaaagaagtctcct

SEQ ID NO: 11934 - DNA, 15 bp, Homo sapiens
ttcaaagaagtctcc

SEQ ID NO: 11935 - DNA, 15 bp, Homo sapiens
tttcaaagaagtctc

SEQ ID NO: 11936 - DNA, 15 bp, Homo sapiens
ttttcaaagaagtct

SEQ ID NO: 11937 - DNA, 15 bp, Homo sapiens
tttttcaaagaagtc

SEQ ID NO: 11938 - DNA, 15 bp, Homo sapiens
atttttcaaagaagt

SEQ ID NO: 11939 - DNA, 15 bp, Homo sapiens
catttttcaaagaag

SEQ ID NO: 11940 - DNA, 15 bp, Homo sapiens
ccatttttcaaagaa

SEQ ID NO: 11941 - DNA, 15 bp, Homo sapiens
gccatttttcaaaga

SEQ ID NO: 11942 - DNA, 15 bp, Homo sapiens
tgccatttttcaaag

SEQ ID NO: 11943 - DNA, 15 bp, Homo sapiens
atgccatttttcaaa

SEQ ID NO: 11944 - DNA, 15 bp, Homo sapiens
gatgccatttttcaa

SEQ ID NO: 11945 - DNA, 15 bp, Homo sapiens
agatgccatttttca

SEQ ID NO: 11946 - DNA, 15 bp, Homo sapiens
tagatgccatttttc

SEQ ID NO: 11947 - DNA, 15 bp, Homo sapiens
ttagatgccattttt

SEQ ID NO: 11948 - DNA, 15 bp, Homo sapiens
cttagatgccatttt

SEQ ID NO: 11949 - DNA, 15 bp, Homo sapiens
tcttagatgccattt

SEQ ID NO: 11950 - DNA, 15 bp, Homo sapiens
gtcttagatgccatt

SEQ ID NO: 11951 - DNA, 15 bp, Homo sapiens
ggtcttagatgccat

SEQ ID NO: 11952 - DNA, 15 bp, Homo sapiens
aggtcttagatgcca

SEQ ID NO: 11953 - DNA, 15 bp, Homo sapiens
caggtcttagatgcc

SEQ ID NO: 11954 - DNA, 15 bp, Homo sapiens
tcaggtcttagatgc

SEQ ID NO: 11955 - DNA, 15 bp, Homo sapiens
ttcaggtcttagatg

SEQ ID NO: 11956 - DNA, 15 bp, Homo sapiens
gttcaggtcttagat

SEQ ID NO: 11957 - DNA, 15 bp, Homo sapiens
tgttcaggtcttaga

SEQ ID NO: 11958 - DNA, 15 bp, Homo sapiens
ctgttcaggtcttag

SEQ ID NO: 11959 - DNA, 15 bp, Homo sapiens
gctgttcaggtctta

SEQ ID NO: 11960 - DNA, 15 bp, Homo sapiens
tgctgttcaggtctt

SEQ ID NO: 11961 - DNA, 15 bp, Homo sapiens
ttgctgttcaggtct

SEQ ID NO: 11962 - DNA, 15 bp, Homo sapiens
cttgctgttcaggtc

SEQ ID NO: 11963 - DNA, 15 bp, Homo sapiens
ccttgctgttcaggt

SEQ ID NO: 11964 - DNA, 15 bp, Homo sapiens
tccttgctgttcagg

SEQ ID NO: 11965 - DNA, 15 bp, Homo sapiens
ttccttgctgttcag

SEQ ID NO: 11966 - DNA, 15 bp, Homo sapiens
tttccttgctgttca

SEQ ID NO: 11967 - DNA, 15 bp, Homo sapiens
gtttccttgctgttc

SEQ ID NO: 11968 - DNA, 15 bp, Homo sapiens
tgtttccttgctgtt

SEQ ID NO: 11969 - DNA, 15 bp, Homo sapiens
atgtttccttgctgt

SEQ ID NO: 11970 - DNA, 15 bp, Homo sapiens
aatgtttccttgctg

SEQ ID NO: 11971 - DNA, 15 bp, Homo sapiens
taatgtttccttgct

SEQ ID NO: 11972 - DNA, 15 bp, Homo sapiens
ctaatgtttccttgc

SEQ ID NO: 11973 - DNA, 15 bp, Homo sapiens
gctaatgtttccttg

SEQ ID NO: 11974 - DNA, 15 bp, Homo sapiens
agctaatgtttcctt

SEQ ID NO: 11975 - DNA, 15 bp, Homo sapiens
tagctaatgtttcct

SEQ ID NO: 11976 - DNA, 15 bp, Homo sapiens
ctagctaatgtttcc

SEQ ID NO: 11977 - DNA, 15 bp, Homo sapiens
cctagctaatgtttc

SEQ ID NO: 11978 - DNA, 15 bp, Homo sapiens
acctagctaatgttt

SEQ ID NO: 11979 - DNA, 15 bp, Homo sapiens
gacctagctaatgtt

SEQ ID NO: 11980 - DNA, 15 bp, Homo sapiens
tgacctagctaatgt

SEQ ID NO: 11981 - DNA, 15 bp, Homo sapiens
ttgacctagctaatg

SEQ ID NO: 11982 - DNA, 15 bp, Homo sapiens
cttgacctagctaat

SEQ ID NO: 11983 - DNA, 15 bp, Homo sapiens
ccttgacctagctaa

SEQ ID NO: 11984 - DNA, 15 bp, Homo sapiens
tccttgacctagcta

SEQ ID NO: 11985 - DNA, 15 bp, Homo sapiens
gtccttgacctagct

SEQ ID NO: 11986 - DNA, 15 bp, Homo sapiens
tgtccttgacctagc

SEQ ID NO: 11987 - DNA, 15 bp, Homo sapiens
ttgtccttgacctag

SEQ ID NO: 11988 - DNA, 15 bp, Homo sapiens
tttgtccttgaccta

SEQ ID NO: 11989 - DNA, 15 bp, Homo sapiens
ctttgtccttgacct

SEQ ID NO: 11990 - DNA, 15 bp, Homo sapiens
gctttgtccttgacc

SEQ ID NO: 11991 - DNA, 15 bp, Homo sapiens
tgctttgtccttgac

SEQ ID NO: 11992 - DNA, 15 bp, Homo sapiens
atgctttgtccttga

SEQ ID NO: 11993 - DNA, 15 bp, Homo sapiens
gatgctttgtccttg

SEQ ID NO: 11994 - DNA, 15 bp, Homo sapiens
tgatgctttgtcctt

SEQ ID NO: 11995 - DNA, 15 bp, Homo sapiens
ctgatgctttgtcct

SEQ ID NO: 11996 - DNA, 15 bp, Homo sapiens
actgatgctttgtcc

SEQ ID NO: 11997 - DNA, 15 bp, Homo sapiens
cactgatgctttgtc

SEQ ID NO: 11998 - DNA, 15 bp, Homo sapiens
ccactgatgctttgt

SEQ ID NO: 11999 - DNA, 15 bp, Homo sapiens
cccactgatgctttg

SEQ ID NO: 12000 - DNA, 15 bp, Homo sapiens
ccccactgatgcttt

SEQ ID NO: 12001 - DNA, 15 bp, Homo sapiens
tccccactgatgctt

SEQ ID NO: 12002 - DNA, 15 bp, Homo sapiens
ctccccactgatgct

SEQ ID NO: 12003 - DNA, 15 bp, Homo sapiens
tctccccactgatgc

SEQ ID NO: 12004 - DNA, 15 bp, Homo sapiens
ctctccccactgatg

SEQ ID NO: 12005 - DNA, 15 bp, Homo sapiens
tctctccccactgat

SEQ ID NO: 12006 - DNA, 15 bp, Homo sapiens
atctctccccactga

SEQ ID NO: 12007 - DNA, 15 bp, Homo sapiens
catctctccccactg

SEQ ID NO: 12008 - DNA, 15 bp, Homo sapiens
gcatctctccccact

SEQ ID NO: 12009 - DNA, 15 bp, Homo sapiens
tgcatctctccccac

SEQ ID NO: 12010 - DNA, 15 bp, Homo sapiens
atgcatctctcccca

SEQ ID NO: 12011 - DNA, 15 bp, Homo sapiens
catgcatctctcccc

SEQ ID NO: 12012 - DNA, 15 bp, Homo sapiens
tcatgcatctctccc

SEQ ID NO: 12013 - DNA, 15 bp, Homo sapiens
ctcatgcatctctcc

SEQ ID NO: 12014 - DNA, 15 bp, Homo sapiens
actcatgcatctctc

SEQ ID NO: 12015 - DNA, 15 bp, Homo sapiens
gactcatgcatctct

SEQ ID NO: 12016 - DNA, 15 bp, Homo sapiens
agactcatgcatctc

SEQ ID NO: 12017 - DNA, 15 bp, Homo sapiens
aagactcatgcatct

SEQ ID NO: 12018 - DNA, 15 bp, Homo sapiens
aaagactcatgcatc

SEQ ID NO: 12019 - DNA, 15 bp, Homo sapiens
aaaagactcatgcat

SEQ ID NO: 12020 - DNA, 15 bp, Homo sapiens
caaaagactcatgca

SEQ ID NO: 12021 - DNA, 15 bp, Homo sapiens
ccaaaagactcatgc

SEQ ID NO: 12022 - DNA, 15 bp, Homo sapiens
tccaaaagactcatg

SEQ ID NO: 12023 - DNA, 15 bp, Homo sapiens
ttccaaaagactcat

SEQ ID NO: 12024 - DNA, 15 bp, Homo sapiens
cttccaaaagactca

SEQ ID NO: 12025 - DNA, 15 bp, Homo sapiens
ccttccaaaagactc

SEQ ID NO: 12026 - DNA, 15 bp, Homo sapiens
tccttccaaaagact

SEQ ID NO: 12027 - DNA, 15 bp, Homo sapiens
gtccttccaaaagac

SEQ ID NO: 12028 - DNA, 15 bp, Homo sapiens
ggtccttccaaaaga

SEQ ID NO: 12029 - DNA, 15 bp, Homo sapiens
tggtccttccaaaag

SEQ ID NO: 12030 - DNA, 15 bp, Homo sapiens
ctggtccttccaaaa

SEQ ID NO: 12031 - DNA, 15 bp, Homo sapiens
gctggtccttccaaa

SEQ ID NO: 12032 - DNA, 15 bp, Homo sapiens
tgctggtccttccaa

SEQ ID NO: 12033 - DNA, 15 bp, Homo sapiens
atgctggtccttcca

SEQ ID NO: 12034 - DNA, 15 bp, Homo sapiens
catgctggtccttcc

SEQ ID NO: 12035 - DNA, 15 bp, Homo sapiens
acatgctggtccttc

SEQ ID NO: 12036 - DNA, 15 bp, Homo sapiens
cacatgctggtcctt

SEQ ID NO: 12037 - DNA, 15 bp, Homo sapiens
acacatgctggtcct

SEQ ID NO: 12038 - DNA, 15 bp, Homo sapiens
tacacatgctggtcc

SEQ ID NO: 12039 - DNA, 15 bp, Homo sapiens
ctacacatgctggtc

SEQ ID NO: 12040 - DNA, 15 bp, Homo sapiens
tctacacatgctggt

SEQ ID NO: 12041 - DNA, 15 bp, Homo sapiens
ctctacacatgctgg

SEQ ID NO: 12042 - DNA, 15 bp, Homo sapiens
cctctacacatgctg

SEQ ID NO: 12043 - DNA, 15 bp, Homo sapiens
gcctctacacatgct

SEQ ID NO: 12044 - DNA, 15 bp, Homo sapiens
agcctctacacatgc

SEQ ID NO: 12045 - DNA, 15 bp, Homo sapiens
gagcctctacacatg

SEQ ID NO: 12046 - DNA, 15 bp, Homo sapiens
agagcctctacacat

SEQ ID NO: 12047 - DNA, 15 bp, Homo sapiens
cagagcctctacaca

SEQ ID NO: 12048 - DNA, 15 bp, Homo sapiens
tcagagcctctacac

SEQ ID NO: 12049 - DNA, 15 bp, Homo sapiens
gtcagagcctctaca

SEQ ID NO: 12050 - DNA, 15 bp, Homo sapiens
tgtcagagcctctac

SEQ ID NO: 12051 - DNA, 15 bp, Homo sapiens
ctgtcagagcctcta

SEQ ID NO: 12052 - DNA, 15 bp, Homo sapiens
cctgtcagagcctct

SEQ ID NO: 12053 - DNA, 15 bp, Homo sapiens
tcctgtcagagcctc

SEQ ID NO: 12054 - DNA, 15 bp, Homo sapiens
ctcctgtcagagcct

SEQ ID NO: 12055 - DNA, 15 bp, Homo sapiens
tctcctgtcagagcc

SEQ ID NO: 12056 - DNA, 15 bp, Homo sapiens
ctctcctgtcagagc

SEQ ID NO: 12057 - DNA, 15 bp, Homo sapiens
tctctcctgtcagag

SEQ ID NO: 12058 - DNA, 15 bp, Homo sapiens
ttctctcctgtcaga

SEQ ID NO: 12059 - DNA, 15 bp, Homo sapiens
attctctcctgtcag

SEQ ID NO: 12060 - DNA, 15 bp, Homo sapiens
gattctctcctgtca

SEQ ID NO: 12061 - DNA, 15 bp, Homo sapiens
agattctctcctgtc

SEQ ID NO: 12062 - DNA, 15 bp, Homo sapiens
gagattctctcctgt

SEQ ID NO: 12063 - DNA, 15 bp, Homo sapiens
agagattctctcctg

SEQ ID NO: 12064 - DNA, 15 bp, Homo sapiens
gagagattctctcct

SEQ ID NO: 12065 - DNA, 15 bp, Homo sapiens
tgagagattctctcc

SEQ ID NO: 12066 - DNA, 15 bp, Homo sapiens
ctgagagattctctc

SEQ ID NO: 12067 - DNA, 15 bp, Homo sapiens
cctgagagattctct

SEQ ID NO: 12068 - DNA, 15 bp, Homo sapiens
gcctgagagattctc

SEQ ID NO: 12069 - DNA, 15 bp, Homo sapiens
ggcctgagagattct

SEQ ID NO: 12070 - DNA, 15 bp, Homo sapiens
gggcctgagagattc

SEQ ID NO: 12071 - DNA, 15 bp, Homo sapiens
tgggcctgagagatt

SEQ ID NO: 12072 - DNA, 15 bp, Homo sapiens
atgggcctgagagat

SEQ ID NO: 12073 - DNA, 15 bp, Homo sapiens
aatgggcctgagaga

SEQ ID NO: 12074 - DNA, 15 bp, Homo sapiens
gaatgggcctgagag

SEQ ID NO: 12075 - DNA, 15 bp, Homo sapiens
tgaatgggcctgaga

SEQ ID NO: 12076 - DNA, 15 bp, Homo sapiens
ctgaatgggcctgag

SEQ ID NO: 12077 - DNA, 15 bp, Homo sapiens
tctgaatgggcctga

SEQ ID NO: 12078 - DNA, 15 bp, Homo sapiens
ctctgaatgggcctg

SEQ ID NO: 12079 - DNA, 15 bp, Homo sapiens
tctctgaatgggcct

SEQ ID NO: 12080 - DNA, 15 bp, Homo sapiens
ctctctgaatgggcc

SEQ ID NO: 12081 - DNA, 15 bp, Homo sapiens
actctctgaatgggc

SEQ ID NO: 12082 - DNA, 15 bp, Homo sapiens
gactctctgaatggg

SEQ ID NO: 12083 - DNA, 15 bp, Homo sapiens
ggactctctgaatgg

SEQ ID NO: 12084 - DNA, 15 bp, Homo sapiens
tggactctctgaatg

SEQ ID NO: 12085 - DNA, 15 bp, Homo sapiens
gtggactctctgaat

SEQ ID NO: 12086 - DNA, 15 bp, Homo sapiens
agtggactctctgaa

SEQ ID NO: 12087 - DNA, 15 bp, Homo sapiens
cagtggactctctga

SEQ ID NO: 12088 - DNA, 15 bp, Homo sapiens
acagtggactctctg

SEQ ID NO: 12089 - DNA, 15 bp, Homo sapiens
cacagtggactctct

SEQ ID NO: 12090 - DNA, 15 bp, Homo sapiens
acacagtggactctc

SEQ ID NO: 12091 - DNA, 15 bp, Homo sapiens
cacacagtggactct

SEQ ID NO: 12092 - DNA, 15 bp, Homo sapiens
tcacacagtggactc

SEQ ID NO: 12093 - DNA, 15 bp, Homo sapiens
ttcacacagtggact

SEQ ID NO: 12094 - DNA, 15 bp, Homo sapiens
cttcacacagtggac

SEQ ID NO: 12095 - DNA, 15 bp, Homo sapiens
tcttcacacagtgga

SEQ ID NO: 12096 - DNA, 15 bp, Homo sapiens
gtcttcacacagtgg

SEQ ID NO: 12097 - DNA, 15 bp, Homo sapiens
cgtcttcacacagtg

SEQ ID NO: 12098 - DNA, 15 bp, Homo sapiens
tcgtcttcacacagt

SEQ ID NO: 12099 - DNA, 15 bp, Homo sapiens
ctcgtcttcacacag

SEQ ID NO: 12100 - DNA, 15 bp, Homo sapiens
cctcgtcttcacaca

SEQ ID NO: 12101 - DNA, 15 bp, Homo sapiens
gcctcgtcttcacac

SEQ ID NO: 12102 - DNA, 15 bp, Homo sapiens
tgcctcgtcttcaca

SEQ ID NO: 12103 - DNA, 15 bp, Homo sapiens
atgcctcgtcttcac

SEQ ID NO: 12104 - DNA, 15 bp, Homo sapiens
catgcctcgtcttca

SEQ ID NO: 12105 - DNA, 15 bp, Homo sapiens
tcatgcctcgtcttc

SEQ ID NO: 12106 - DNA, 15 bp, Homo sapiens
ttcatgcctcgtctt

SEQ ID NO: 12107 - DNA, 15 bp, Homo sapiens
gttcatgcctcgtct

SEQ ID NO: 12108 - DNA, 15 bp, Homo sapiens
tgttcatgcctcgtc

SEQ ID NO: 12109 - DNA, 15 bp, Homo sapiens
ttgttcatgcctcgt

SEQ ID NO: 12110 - DNA, 15 bp, Homo sapiens
gttgttcatgcctcg

SEQ ID NO: 12111 - DNA, 15 bp, Homo sapiens
ggttgttcatgcctc

SEQ ID NO: 12112 - DNA, 15 bp, Homo sapiens
tggttgttcatgcct

SEQ ID NO: 12113 - DNA, 15 bp, Homo sapiens
ctggttgttcatgcc

SEQ ID NO: 12114 - DNA, 15 bp, Homo sapiens
gctggttgttcatgc

SEQ ID NO: 12115 - DNA, 15 bp, Homo sapiens
ggctggttgttcatg

SEQ ID NO: 12116 - DNA, 15 bp, Homo sapiens
tggctggttgttcat

SEQ ID NO: 12117 - DNA, 15 bp, Homo sapiens
ctggctggttgttca

SEQ ID NO: 12118 - DNA, 15 bp, Homo sapiens
cctggctggttgttc

SEQ ID NO: 12119 - DNA, 15 bp, Homo sapiens
tcctggctggttgtt

SEQ ID NO: 12120 - DNA, 15 bp, Homo sapiens
gtcctggctggttgt

SEQ ID NO: 12121 - DNA, 15 bp, Homo sapiens
tgtcctggctggttg

SEQ ID NO: 12122 - DNA, 15 bp, Homo sapiens
atgtcctggctggtt

SEQ ID NO: 12123 - DNA, 15 bp, Homo sapiens
catgtcctggctggt

SEQ ID NO: 12124 - DNA, 15 bp, Homo sapiens
acatgtcctggctgg

SEQ ID NO: 12125 - DNA, 15 bp, Homo sapiens
cacatgtcctggctg

SEQ ID NO: 12126 - DNA, 15 bp, Homo sapiens
ccacatgtcctggct

SEQ ID NO: 12127 - DNA, 15 bp, Homo sapiens
tccacatgtcctggc

SEQ ID NO: 12128 - DNA, 15 bp, Homo sapiens
ctccacatgtcctgg

SEQ ID NO: 12129 - DNA, 15 bp, Homo sapiens
tctccacatgtcctg

SEQ ID NO: 12130 - DNA, 15 bp, Homo sapiens
ctctccacatgtcct

SEQ ID NO: 12131 - DNA, 15 bp, Homo sapiens
cctctccacatgtcc

SEQ ID NO: 12132 - DNA, 15 bp, Homo sapiens
tcctctccacatgtc

SEQ ID NO: 12133 - DNA, 15 bp, Homo sapiens
ctcctctccacatgt

SEQ ID NO: 12134 - DNA, 15 bp, Homo sapiens
gctcctctccacatg

SEQ ID NO: 12135 - DNA, 15 bp, Homo sapiens
tgctcctctccacat

SEQ ID NO: 12136 - DNA, 15 bp, Homo sapiens
atgctcctctccaca

SEQ ID NO: 12137 - DNA, 15 bp, Homo sapiens
aatgctcctctccac

SEQ ID NO: 12138 - DNA, 15 bp, Homo sapiens
aaatgctcctctcca

SEQ ID NO: 12139 - DNA, 15 bp, Homo sapiens
aaaatgctcctctcc

SEQ ID NO: 12140 - DNA, 15 bp, Homo sapiens
aaaaatgctcctctc

SEQ ID NO: 12141 - DNA, 15 bp, Homo sapiens
gaaaaatgctcctct

SEQ ID NO: 12142 - DNA, 15 bp, Homo sapiens
agaaaaatgctcctc

SEQ ID NO: 12143 - DNA, 15 bp, Homo sapiens
aagaaaaatgctcct

SEQ ID NO: 12144 - DNA, 15 bp, Homo sapiens
aaagaaaaatgctcc

SEQ ID NO: 12145 - DNA, 15 bp, Homo sapiens
aaaagaaaaatgctc

SEQ ID NO: 12146 - DNA, 15 bp, Homo sapiens
aaaaagaaaaatgct

SEQ ID NO: 12147 - DNA, 15 bp, Homo sapiens
aaaaaagaaaaatgc

SEQ ID NO: 12148 - DNA, 15 bp, Homo sapiens
aaaaaaagaaaaatg

SEQ ID NO: 12149 - DNA, 15 bp, Homo sapiens
gaaaaaaagaaaaat

SEQ ID NO: 12150 - DNA, 15 bp, Homo sapiens
agaaaaaaagaaaaa

SEQ ID NO: 12151 - DNA, 15 bp, Homo sapiens
aagaaaaaaagaaaa

SEQ ID NO: 12152 - DNA, 15 bp, Homo sapiens
aaagaaaaaaagaaa

SEQ ID NO: 12153 - DNA, 15 bp, Homo sapiens
aaaagaaaaaaagaa

SEQ ID NO: 12154 - DNA, 15 bp, Homo sapiens
aaaaagaaaaaaaga

SEQ ID NO: 12155 - DNA, 15 bp, Homo sapiens
aaaaaagaaaaaaag

SEQ ID NO: 12156 - DNA, 15 bp, Homo sapiens
gaaaaaagaaaaaaa

SEQ ID NO: 12157 - DNA, 15 bp, Homo sapiens
gaaagaaaaaagaaa

SEQ ID NO: 12158 - DNA, 15 bp, Homo sapiens
agaaagaaaaaagaa

SEQ ID NO: 12159 - DNA, 15 bp, Homo sapiens
aagaaagaaaaaaga

SEQ ID NO: 12160 - DNA, 15 bp, Homo sapiens
aaagaaagaaaaaag

SEQ ID NO: 12161 - DNA, 15 bp, Homo sapiens
aaaagaaagaaaaaa

SEQ ID NO: 12162 - DNA, 15 bp, Homo sapiens
aaaaagaaagaaaaa

SEQ ID NO: 12163 - DNA, 15 bp, Homo sapiens
aaaaaagaaagaaaa

SEQ ID NO: 12164 - DNA, 15 bp, Homo sapiens
acgtctcaaaaaaaa

SEQ ID NO: 12165 - DNA, 15 bp, Homo sapiens
gacgtctcaaaaaaa

SEQ ID NO: 12166 - DNA, 15 bp, Homo sapiens
agacgtctcaaaaaa

SEQ ID NO: 12167 - DNA, 15 bp, Homo sapiens
aagacgtctcaaaaa

SEQ ID NO: 12168 - DNA, 15 bp, Homo sapiens
aaagacgtctcaaaa

SEQ ID NO: 12169 - DNA, 15 bp, Homo sapiens
gaaagacgtctcaaa

SEQ ID NO: 12170 - DNA, 15 bp, Homo sapiens
agaaagacgtctcaa

SEQ ID NO: 12171 - DNA, 15 bp, Homo sapiens
gagaaagacgtctca

SEQ ID NO: 12172 - DNA, 15 bp, Homo sapiens
agagaaagacgtctc

SEQ ID NO: 12173 - DNA, 15 bp, Homo sapiens
cagagaaagacgtct

SEQ ID NO: 12174 - DNA, 15 bp, Homo sapiens
acagagaaagacgtc

SEQ ID NO: 12175 - DNA, 15 bp, Homo sapiens
gacagagaaagacgt

SEQ ID NO: 12176 - DNA, 15 bp, Homo sapiens
tgacagagaaagacg

SEQ ID NO: 12177 - DNA, 15 bp, Homo sapiens
gtgacagagaaagac

SEQ ID NO: 12178 - DNA, 15 bp, Homo sapiens
ggtgacagagaaaga

SEQ ID NO: 12179 - DNA, 15 bp, Homo sapiens
gggtgacagagaaag

SEQ ID NO: 12180 - DNA, 15 bp, Homo sapiens
tgggtgacagagaaa

SEQ ID NO: 12181 - DNA, 15 bp, Homo sapiens
ctgggtgacagagaa

SEQ ID NO: 12182 - DNA, 15 bp, Homo sapiens
cctgggtgacagaga

SEQ ID NO: 12183 - DNA, 15 bp, Homo sapiens
atgccattgcactcc

SEQ ID NO: 12184 - DNA, 15 bp, Homo sapiens
catgccattgcactc

SEQ ID NO: 12185 - DNA, 15 bp, Homo sapiens
tcatgccattgcact

SEQ ID NO: 12186 - DNA, 15 bp, Homo sapiens
atcatgccattgcac

SEQ ID NO: 12187 - DNA, 15 bp, Homo sapiens
gatcatgccattgca

SEQ ID NO: 12188 - DNA, 15 bp, Homo sapiens
agatcatgccattgc

SEQ ID NO: 12189 - DNA, 15 bp, Homo sapiens
gagatcatgccattg

SEQ ID NO: 12190 - DNA, 15 bp, Homo sapiens
cgagatcatgccatt

SEQ ID NO: 12191 - DNA, 15 bp, Homo sapiens
ccgagatcatgccat

SEQ ID NO: 12192 - DNA, 15 bp, Homo sapiens
gccgagatcatgcca

SEQ ID NO: 12193 - DNA, 15 bp, Homo sapiens
agccgagatcatgcc

SEQ ID NO: 12194 - DNA, 15 bp, Homo sapiens
gagccgagatcatgc

SEQ ID NO: 12195 - DNA, 15 bp, Homo sapiens
tgagccgagatcatg

SEQ ID NO: 12196 - DNA, 15 bp, Homo sapiens
gtgagccgagatcat

SEQ ID NO: 12197 - DNA, 15 bp, Homo sapiens
agtgagccgagatca

SEQ ID NO: 12198 - DNA, 15 bp, Homo sapiens
gggttgcagtgagcc

SEQ ID NO: 12199 - DNA, 15 bp, Homo sapiens
ggggttgcagtgagc

SEQ ID NO: 12200 - DNA, 15 bp, Homo sapiens
gggggttgcagtgag

SEQ ID NO: 12201 - DNA, 15 bp, Homo sapiens
tgggggttgcagtga

SEQ ID NO: 12202 - DNA, 15 bp, Homo sapiens
gtgggggttgcagtg

SEQ ID NO: 12203 - DNA, 15 bp, Homo sapiens
agtgggggttgcagt

SEQ ID NO: 12204 - DNA, 15 bp, Homo sapiens
aagtgggggttgcag

SEQ ID NO: 12205 - DNA, 15 bp, Homo sapiens
gaagtgggggttgca

SEQ ID NO: 12206 - DNA, 15 bp, Homo sapiens
ggaagtgggggttgc

SEQ ID NO: 12207 - DNA, 15 bp, Homo sapiens
tggaagtgggggttg

SEQ ID NO: 12208 - DNA, 15 bp, Homo sapiens
ctggaagtgggggtt

SEQ ID NO: 12209 - DNA, 15 bp, Homo sapiens
cctggaagtgggggt

SEQ ID NO: 12210 - DNA, 15 bp, Homo sapiens
ccctggaagtggggg

SEQ ID NO: 12211 - DNA, 15 bp, Homo sapiens
accctggaagtgggg

SEQ ID NO: 12212 - DNA, 15 bp, Homo sapiens
aaccctggaagtggg

SEQ ID NO: 12213 - DNA, 15 bp, Homo sapiens
gaaccctggaagtgg

SEQ ID NO: 12214 - DNA, 15 bp, Homo sapiens
tgaaccctggaagtg

SEQ ID NO: 12215 - DNA, 15 bp, Homo sapiens
ttgaaccctggaagt

SEQ ID NO: 12216 - DNA, 15 bp, Homo sapiens
cttgaaccctggaag

SEQ ID NO: 12217 - DNA, 15 bp, Homo sapiens
gcttgaaccctggaa

SEQ ID NO: 12218 - DNA, 15 bp, Homo sapiens
tgcttgaaccctgga

SEQ ID NO: 12219 - DNA, 15 bp, Homo sapiens
ttgcttgaaccctgg

SEQ ID NO: 12220 - DNA, 15 bp, Homo sapiens
attgcttgaaccctg

SEQ ID NO: 12221 - DNA, 15 bp, Homo sapiens
aattgcttgaaccct

SEQ ID NO: 12222 - DNA, 15 bp, Homo sapiens
gaagaattgcttgaa

SEQ ID NO: 12223 - DNA, 15 bp, Homo sapiens
agaagaattgcttga

SEQ ID NO: 12224 - DNA, 15 bp, Homo sapiens
cagaagaattgcttg

SEQ ID NO: 12225 - DNA, 15 bp, Homo sapiens
gcagaagaattgctt

SEQ ID NO: 12226 - DNA, 15 bp, Homo sapiens
ggcagaagaattgct

SEQ ID NO: 12227 - DNA, 15 bp, Homo sapiens
aggcagaagaattgc

SEQ ID NO: 12228 - DNA, 15 bp, Homo sapiens
aaggcagaagaattg

SEQ ID NO: 12229 - DNA, 15 bp, Homo sapiens
taaggcagaagaatt

SEQ ID NO: 12230 - DNA, 15 bp, Homo sapiens
ctaaggcagaagaat

SEQ ID NO: 12231 - DNA, 15 bp, Homo sapiens
gctaaggcagaagaa

SEQ ID NO: 12232 - DNA, 15 bp, Homo sapiens
ggctaaggcagaaga

SEQ ID NO: 12233 - DNA, 15 bp, Homo sapiens
aggctaaggcagaag

SEQ ID NO: 12234 - DNA, 15 bp, Homo sapiens
gaggctaaggcagaa

SEQ ID NO: 12235 - DNA, 15 bp, Homo sapiens
ggaggctaaggcaga

SEQ ID NO: 12236 - DNA, 15 bp, Homo sapiens
gggaggctaaggcag

SEQ ID NO: 12237 - DNA, 15 bp, Homo sapiens
tgggaggctaaggca

SEQ ID NO: 12238 - DNA, 15 bp, Homo sapiens
ttgggaggctaaggc

SEQ ID NO: 12239 - DNA, 15 bp, Homo sapiens
cttgggaggctaagg

SEQ ID NO: 12240 - DNA, 15 bp, Homo sapiens
gcttgggaggctaag

SEQ ID NO: 12241 - DNA, 15 bp, Homo sapiens
tgcttgggaggctaa

SEQ ID NO: 12242 - DNA, 15 bp, Homo sapiens
ctgcttgggaggcta

SEQ ID NO: 12243 - DNA, 15 bp, Homo sapiens
tagctgcttgggagg

SEQ ID NO: 12244 - DNA, 15 bp, Homo sapiens
ctagctgcttgggag

SEQ ID NO: 12245 - DNA, 15 bp, Homo sapiens
cctagctgcttggga

SEQ ID NO: 12246 - DNA, 15 bp, Homo sapiens
tcctagctgcttggg

SEQ ID NO: 12247 - DNA, 15 bp, Homo sapiens
atcctagctgcttgg

SEQ ID NO: 12248 - DNA, 15 bp, Homo sapiens
aatcctagctgcttg

SEQ ID NO: 12249 - DNA, 15 bp, Homo sapiens
taatcctagctgctt

SEQ ID NO: 12250 - DNA, 15 bp, Homo sapiens
gtaatcctagctgct

SEQ ID NO: 12251 - DNA, 15 bp, Homo sapiens
tgtaatcctagctgc

SEQ ID NO: 12252 - DNA, 15 bp, Homo sapiens
ctgtaatcctagctg

SEQ ID NO: 12253 - DNA, 15 bp, Homo sapiens
cctgtaatcctagct

SEQ ID NO: 12254 - DNA, 15 bp, Homo sapiens
gcctgtaatcctagc

SEQ ID NO: 12255 - DNA, 15 bp, Homo sapiens
tgcctgtaatcctag

SEQ ID NO: 12256 - DNA, 15 bp, Homo sapiens
gtgcctgtaatccta

SEQ ID NO: 12257 - DNA, 15 bp, Homo sapiens
ggtgcctgtaatcct

SEQ ID NO: 12258 - DNA, 15 bp, Homo sapiens
accgggcatggtggc

SEQ ID NO: 12259 - DNA, 15 bp, Homo sapiens
aaccgggcatggtgg

SEQ ID NO: 12260 - DNA, 15 bp, Homo sapiens
taaccgggcatggtg

SEQ ID NO: 12261 - DNA, 15 bp, Homo sapiens
ttaaccgggcatggt

SEQ ID NO: 12262 - DNA, 15 bp, Homo sapiens
attaaccgggcatgg

SEQ ID NO: 12263 - DNA, 15 bp, Homo sapiens
aattaaccgggcatg

SEQ ID NO: 12264 - DNA, 15 bp, Homo sapiens
aaattaaccgggcat

SEQ ID NO: 12265 - DNA, 15 bp, Homo sapiens
aaaattaaccgggca

SEQ ID NO: 12266 - DNA, 15 bp, Homo sapiens
aaaaattaaccgggc

SEQ ID NO: 12267 - DNA, 15 bp, Homo sapiens
caaaaattaaccggg

SEQ ID NO: 12268 - DNA, 15 bp, Homo sapiens
acaaaaattaaccgg

SEQ ID NO: 12269 - DNA, 15 bp, Homo sapiens
tacaaaaattaaccg

SEQ ID NO: 12270 - DNA, 15 bp, Homo sapiens
atacaaaaattaacc

SEQ ID NO: 12271 - DNA, 15 bp, Homo sapiens
aatacaaaaattaac

SEQ ID NO: 12272 - DNA, 15 bp, Homo sapiens
aaatacaaaaattaa

SEQ ID NO: 12273 - DNA, 15 bp, Homo sapiens
tccgtctctactaaa

SEQ ID NO: 12274 - DNA, 15 bp, Homo sapiens
ctccgtctctactaa

SEQ ID NO: 12275 - DNA, 15 bp, Homo sapiens
actccgtctctacta

SEQ ID NO: 12276 - DNA, 15 bp, Homo sapiens
aactccgtctctact

SEQ ID NO: 12277 - DNA, 15 bp, Homo sapiens
aaactccgtctctac

SEQ ID NO: 12278 - DNA, 15 bp, Homo sapiens
gaaactccgtctcta

SEQ ID NO: 12279 - DNA, 15 bp, Homo sapiens
tgaaactccgtctct

SEQ ID NO: 12280 - DNA, 15 bp, Homo sapiens
gtgaaactccgtctc

SEQ ID NO: 12281 - DNA, 15 bp, Homo sapiens
ggtgaaactccgtct

SEQ ID NO: 12282 - DNA, 15 bp, Homo sapiens
tggtgaaactccgtc

SEQ ID NO: 12283 - DNA, 15 bp, Homo sapiens
atggtgaaactccgt

SEQ ID NO: 12284 - DNA, 15 bp, Homo sapiens
catggtgaaactccg

SEQ ID NO: 12285 - DNA, 15 bp, Homo sapiens
acatggtgaaactcc

SEQ ID NO: 12286 - DNA, 15 bp, Homo sapiens
aacatggtgaaactc

SEQ ID NO: 12287 - DNA, 15 bp, Homo sapiens
caacatggtgaaact

SEQ ID NO: 12288 - DNA, 15 bp, Homo sapiens
aggccaacatggtga

SEQ ID NO: 12289 - DNA, 15 bp, Homo sapiens
gaggccaacatggtg

SEQ ID NO: 12290 - DNA, 15 bp, Homo sapiens
tgaggccaacatggt

SEQ ID NO: 12291 - DNA, 15 bp, Homo sapiens
ttgaggccaacatgg

SEQ ID NO: 12292 - DNA, 15 bp, Homo sapiens
tttgaggccaacatg

SEQ ID NO: 12293 - DNA, 15 bp, Homo sapiens
gtttgaggccaacat

SEQ ID NO: 12294 - DNA, 15 bp, Homo sapiens
agtttgaggccaaca

SEQ ID NO: 12295 - DNA, 15 bp, Homo sapiens
gagtttgaggccaac

SEQ ID NO: 12296 - DNA, 15 bp, Homo sapiens
ggagtttgaggccaa

SEQ ID NO: 12297 - DNA, 15 bp, Homo sapiens
aggagtttgaggcca

SEQ ID NO: 12298 - DNA, 15 bp, Homo sapiens
caggagtttgaggcc

SEQ ID NO: 12299 - DNA, 15 bp, Homo sapiens
tcaggagtttgaggc

SEQ ID NO: 12300 - DNA, 15 bp, Homo sapiens
gtcaggagtttgagg

SEQ ID NO: 12301 - DNA, 15 bp, Homo sapiens
ggtcaggagtttgag

SEQ ID NO: 12302 - DNA, 15 bp, Homo sapiens
aggtcaggagtttga

SEQ ID NO: 12303 - DNA, 15 bp, Homo sapiens
aaggtcaggagtttg

SEQ ID NO: 12304 - DNA, 15 bp, Homo sapiens
taaggtcaggagttt

SEQ ID NO: 12305 - DNA, 15 bp, Homo sapiens
ctaaggtcaggagtt

SEQ ID NO: 12306 - DNA, 15 bp, Homo sapiens
cctaaggtcaggagt

SEQ ID NO: 12307 - DNA, 15 bp, Homo sapiens
acctaaggtcaggag

SEQ ID NO: 12308 - DNA, 15 bp, Homo sapiens
cacctaaggtcagga

SEQ ID NO: 12309 - DNA, 15 bp, Homo sapiens
tcacctaaggtcagg

SEQ ID NO: 12310 - DNA, 15 bp, Homo sapiens
atcacctaaggtcag

SEQ ID NO: 12311 - DNA, 15 bp, Homo sapiens
gatcacctaaggtca

SEQ ID NO: 12312 - DNA, 15 bp, Homo sapiens
ggatcacctaaggtc

SEQ ID NO: 12313 - DNA, 15 bp, Homo sapiens
tggatcacctaaggt

SEQ ID NO: 12314 - DNA, 15 bp, Homo sapiens
gtggatcacctaagg

SEQ ID NO: 12315 - DNA, 15 bp, Homo sapiens
ggtggatcacctaag

SEQ ID NO: 12316 - DNA, 15 bp, Homo sapiens
gggtggatcacctaa

SEQ ID NO: 12317 - DNA, 15 bp, Homo sapiens
cgggtggatcaccta

SEQ ID NO: 12318 - DNA, 15 bp, Homo sapiens
acgggtggatcacct

SEQ ID NO: 12319 - DNA, 15 bp, Homo sapiens
gacgggtggatcacc

SEQ ID NO: 12320 - DNA, 15 bp, Homo sapiens
agacgggtggatcac

SEQ ID NO: 12321 - DNA, 15 bp, Homo sapiens
gagacgggtggatca

SEQ ID NO: 12322 - DNA, 15 bp, Homo sapiens
cgagacgggtggatc

SEQ ID NO: 12323 - DNA, 15 bp, Homo sapiens
ccgagacgggtggat

SEQ ID NO: 12324 - DNA, 15 bp, Homo sapiens
gccgagacgggtgga

SEQ ID NO: 12325 - DNA, 15 bp, Homo sapiens
ggccgagacgggtgg

SEQ ID NO: 12326 - DNA, 15 bp, Homo sapiens
aggccgagacgggtg

SEQ ID NO: 12327 - DNA, 15 bp, Homo sapiens
gaggccgagacgggt

SEQ ID NO: 12328 - DNA, 15 bp, Homo sapiens
ggaggccgagacggg

SEQ ID NO: 12329 - DNA, 15 bp, Homo sapiens
gggaggccgagacgg

SEQ ID NO: 12330 - DNA, 15 bp, Homo sapiens
tgggaggccgagacg

SEQ ID NO: 12331 - DNA, 15 bp, Homo sapiens
ctgggaggccgagac

SEQ ID NO: 12332 - DNA, 15 bp, Homo sapiens
tctgggaggccgaga

SEQ ID NO: 12333 - DNA, 15 bp, Homo sapiens
ctctgggaggccgag

SEQ ID NO: 12334 - DNA, 15 bp, Homo sapiens
actctgggaggccga

SEQ ID NO: 12335 - DNA, 15 bp, Homo sapiens
cactctgggaggccg

SEQ ID NO: 12336 - DNA, 15 bp, Homo sapiens
gcactctgggaggcc

SEQ ID NO: 12337 - DNA, 15 bp, Homo sapiens
agcactctgggaggc

SEQ ID NO: 12338 - DNA, 15 bp, Homo sapiens
cagcactctgggagg

SEQ ID NO: 12339 - DNA, 15 bp, Homo sapiens
ccagcactctgggag

SEQ ID NO: 12340 - DNA, 15 bp, Homo sapiens
cccagcactctggga

SEQ ID NO: 12341 - DNA, 15 bp, Homo sapiens
tcccagcactctggg

SEQ ID NO: 12342 - DNA, 15 bp, Homo sapiens
atcccagcactctgg

SEQ ID NO: 12343 - DNA, 15 bp, Homo sapiens
aatcccagcactctg

SEQ ID NO: 12344 - DNA, 15 bp, Homo sapiens
taatcccagcactct

SEQ ID NO: 12345 - DNA, 15 bp, Homo sapiens
gtaatcccagcactc

SEQ ID NO: 12346 - DNA, 15 bp, Homo sapiens
tcacctgtaatccca

SEQ ID NO: 12347 - DNA, 15 bp, Homo sapiens
ctcacctgtaatccc

SEQ ID NO: 12348 - DNA, 15 bp, Homo sapiens
tctcacctgtaatcc

SEQ ID NO: 12349 - DNA, 15 bp, Homo sapiens
ctctcacctgtaatc

SEQ ID NO: 12350 - DNA, 15 bp, Homo sapiens
gctctcacctgtaat

SEQ ID NO: 12351 - DNA, 15 bp, Homo sapiens
ggctctcacctgtaa

SEQ ID NO: 12352 - DNA, 15 bp, Homo sapiens
gggctctcacctgta

SEQ ID NO: 12353 - DNA, 15 bp, Homo sapiens
ggggctctcacctgt

SEQ ID NO: 12354 - DNA, 15 bp, Homo sapiens
gggggctctcacctg

SEQ ID NO: 12355 - DNA, 15 bp, Homo sapiens
tgggggctctcacct

SEQ ID NO: 12356 - DNA, 15 bp, Homo sapiens
gtgggggctctcacc

SEQ ID NO: 12357 - DNA, 15 bp, Homo sapiens
cgtgggggctctcac

SEQ ID NO: 12358 - DNA, 15 bp, Homo sapiens
gcgtgggggctctca

SEQ ID NO: 12359 - DNA, 15 bp, Homo sapiens
ggcgtgggggctctc

SEQ ID NO: 12360 - DNA, 15 bp, Homo sapiens
gggcgtgggggctct

SEQ ID NO: 12361 - DNA, 15 bp, Homo sapiens
cgggcgtgggggctc

SEQ ID NO: 12362 - DNA, 15 bp, Homo sapiens
ccgggcgtgggggct

SEQ ID NO: 12363 - DNA, 15 bp, Homo sapiens
gccgggcgtgggggc

SEQ ID NO: 12364 - DNA, 15 bp, Homo sapiens
ggccgggcgtggggg

SEQ ID NO: 12365 - DNA, 15 bp, Homo sapiens
tggccgggcgtgggg

SEQ ID NO: 12366 - DNA, 15 bp, Homo sapiens
ctggccgggcgtggg

SEQ ID NO: 12367 - DNA, 15 bp, Homo sapiens
cctggccgggcgtgg

SEQ ID NO: 12368 - DNA, 15 bp, Homo sapiens
gcctggccgggcgtg

SEQ ID NO: 12369 - DNA, 15 bp, Homo sapiens
agcctggccgggcgt

SEQ ID NO: 12370 - DNA, 15 bp, Homo sapiens
gagcctggccgggcg

SEQ ID NO: 12371 - DNA, 15 bp, Homo sapiens
cgagcctggccgggc

SEQ ID NO: 12372 - DNA, 15 bp, Homo sapiens
ccgagcctggccggg

SEQ ID NO: 12373 - DNA, 15 bp, Homo sapiens
gccgagcctggccgg

SEQ ID NO: 12374 - DNA, 15 bp, Homo sapiens
agccgagcctggccg

SEQ ID NO: 12375 - DNA, 15 bp, Homo sapiens
aagccgagcctggcc

SEQ ID NO: 12376 - DNA, 15 bp, Homo sapiens
aaagccgagcctggc

SEQ ID NO: 12377 - DNA, 15 bp, Homo sapiens
gaaagccgagcctgg

SEQ ID NO: 12378 - DNA, 15 bp, Homo sapiens
agaaagccgagcctg

SEQ ID NO: 12379 - DNA, 15 bp, Homo sapiens
aagaaagccgagcct

SEQ ID NO: 12380 - DNA, 15 bp, Homo sapiens
aaagaaagccgagcc

SEQ ID NO: 12381 - DNA, 15 bp, Homo sapiens
gaaagaaagccgagc

SEQ ID NO: 12382 - DNA, 15 bp, Homo sapiens
ggaaagaaagccgag

SEQ ID NO: 12383 - DNA, 15 bp, Homo sapiens
tggaaagaaagccga

SEQ ID NO: 12384 - DNA, 15 bp, Homo sapiens
ctggaaagaaagccg

SEQ ID NO: 12385 - DNA, 15 bp, Homo sapiens
cctggaaagaaagcc

SEQ ID NO: 12386 - DNA, 15 bp, Homo sapiens
gcctggaaagaaagc

SEQ ID NO: 12387 - DNA, 15 bp, Homo sapiens
ggcctggaaagaaag

SEQ ID NO: 12388 - DNA, 15 bp, Homo sapiens
gggcctggaaagaaa

SEQ ID NO: 12389 - DNA, 15 bp, Homo sapiens
ggggcctggaaagaa

SEQ ID NO: 12390 - DNA, 15 bp, Homo sapiens
cggggcctggaaaga

SEQ ID NO: 12391 - DNA, 15 bp, Homo sapiens
acggggcctggaaag

SEQ ID NO: 12392 - DNA, 15 bp, Homo sapiens
gacggggcctggaaa

SEQ ID NO: 12393 - DNA, 15 bp, Homo sapiens
tgacggggcctggaa

SEQ ID NO: 12394 - DNA, 15 bp, Homo sapiens
gtgacggggcctgga

SEQ ID NO: 12395 - DNA, 15 bp, Homo sapiens
tgtgacggggcctgg

SEQ ID NO: 12396 - DNA, 15 bp, Homo sapiens
gtgtgacggggcctg

SEQ ID NO: 12397 - DNA, 15 bp, Homo sapiens
agtgtgacggggcct

SEQ ID NO: 12398 - DNA, 15 bp, Homo sapiens
gagtgtgacggggcc

SEQ ID NO: 12399 - DNA, 15 bp, Homo sapiens
agagtgtgacggggc

SEQ ID NO: 12400 - DNA, 15 bp, Homo sapiens
aagagtgtgacgggg

SEQ ID NO: 12401 - DNA, 15 bp, Homo sapiens
taagagtgtgacggg

SEQ ID NO: 12402 - DNA, 15 bp, Homo sapiens
ctaagagtgtgacgg

SEQ ID NO: 12403 - DNA, 15 bp, Homo sapiens
tctaagagtgtgacg

SEQ ID NO: 12404 - DNA, 15 bp, Homo sapiens
atctaagagtgtgac

SEQ ID NO: 12405 - DNA, 15 bp, Homo sapiens
catctaagagtgtga

SEQ ID NO: 12406 - DNA, 15 bp, Homo sapiens
acatctaagagtgtg

SEQ ID NO: 12407 - DNA, 15 bp, Homo sapiens
aacatctaagagtgt

SEQ ID NO: 12408 - DNA, 15 bp, Homo sapiens
gaacatctaagagtg

SEQ ID NO: 12409 - DNA, 15 bp, Homo sapiens
ggaacatctaagagt

SEQ ID NO: 12410 - DNA, 15 bp, Homo sapiens
gggaacatctaagag

SEQ ID NO: 12411 - DNA, 15 bp, Homo sapiens
agggaacatctaaga

SEQ ID NO: 12412 - DNA, 15 bp, Homo sapiens
cagggaacatctaag

SEQ ID NO: 12413 - DNA, 15 bp, Homo sapiens
ccagggaacatctaa

SEQ ID NO: 12414 - DNA, 15 bp, Homo sapiens
cccagggaacatcta

SEQ ID NO: 12415 - DNA, 15 bp, Homo sapiens
gcccagggaacatct

SEQ ID NO: 12416 - DNA, 15 bp, Homo sapiens
ggcccagggaacatc

SEQ ID NO: 12417 - DNA, 15 bp, Homo sapiens
gggcccagggaacat

SEQ ID NO: 12418 - DNA, 15 bp, Homo sapiens
ggggcccagggaaca

SEQ ID NO: 12419 - DNA, 15 bp, Homo sapiens
tggggcccagggaac

SEQ ID NO: 12420 - DNA, 15 bp, Homo sapiens
ctggggcccagggaa

SEQ ID NO: 12421 - DNA, 15 bp, Homo sapiens
tctggggcccaggga

SEQ ID NO: 12422 - DNA, 15 bp, Homo sapiens
ttctggggcccaggg

SEQ ID NO: 12423 - DNA, 15 bp, Homo sapiens
cttctggggcccagg

SEQ ID NO: 12424 - DNA, 15 bp, Homo sapiens
ccttctggggcccag

SEQ ID NO: 12425 - DNA, 15 bp, Homo sapiens
gccttctggggccca

SEQ ID NO: 12426 - DNA, 15 bp, Homo sapiens
tgccttctggggccc

SEQ ID NO: 12427 - DNA, 15 bp, Homo sapiens
ctgccttctggggcc

SEQ ID NO: 12428 - DNA, 15 bp, Homo sapiens
gctgccttctggggc

SEQ ID NO: 12429 - DNA, 15 bp, Homo sapiens
cgctgccttctgggg

SEQ ID NO: 12430 - DNA, 15 bp, Homo sapiens
acgctgccttctggg

SEQ ID NO: 12431 - DNA, 15 bp, Homo sapiens
cacgctgccttctgg

SEQ ID NO: 12432 - DNA, 15 bp, Homo sapiens
tcacgctgccttctg

SEQ ID NO: 12433 - DNA, 15 bp, Homo sapiens
ctcacgctgccttct

SEQ ID NO: 12434 - DNA, 15 bp, Homo sapiens
cctcacgctgccttc

SEQ ID NO: 12435 - DNA, 15 bp, Homo sapiens
acctcacgctgcctt

SEQ ID NO: 12436 - DNA, 15 bp, Homo sapiens
cacctcacgctgcct

SEQ ID NO: 12437 - DNA, 15 bp, Homo sapiens
gcacctcacgctgcc

SEQ ID NO: 12438 - DNA, 15 bp, Homo sapiens
agcacctcacgctgc

SEQ ID NO: 12439 - DNA, 15 bp, Homo sapiens
gagcacctcacgctg

SEQ ID NO: 12440 - DNA, 15 bp, Homo sapiens
agagcacctcacgct

SEQ ID NO: 12441 - DNA, 15 bp, Homo sapiens
cagagcacctcacgc

SEQ ID NO: 12442 - DNA, 15 bp, Homo sapiens
gcagagcacctcacg

SEQ ID NO: 12443 - DNA, 15 bp, Homo sapiens
ggcagagcacctcac

SEQ ID NO: 12444 - DNA, 15 bp, Homo sapiens
gggcagagcacctca

SEQ ID NO: 12445 - DNA, 15 bp, Homo sapiens
tgggcagagcacctc

SEQ ID NO: 12446 - DNA, 15 bp, Homo sapiens
atgggcagagcacct

SEQ ID NO: 12447 - DNA, 15 bp, Homo sapiens
gatgggcagagcacc

SEQ ID NO: 12448 - DNA, 15 bp, Homo sapiens
agatgggcagagcac

SEQ ID NO: 12449 - DNA, 15 bp, Homo sapiens
tagatgggcagagca

SEQ ID NO: 12450 - DNA, 15 bp, Homo sapiens
atagatgggcagagc

SEQ ID NO: 12451 - DNA, 15 bp, Homo sapiens
catagatgggcagag

SEQ ID NO: 12452 - DNA, 15 bp, Homo sapiens
gcatagatgggcaga

SEQ ID NO: 12453 - DNA, 15 bp, Homo sapiens
agcatagatgggcag

SEQ ID NO: 12454 - DNA, 15 bp, Homo sapiens
cagcatagatgggca

SEQ ID NO: 12455 - DNA, 15 bp, Homo sapiens
acagcatagatgggc

SEQ ID NO: 12456 - DNA, 15 bp, Homo sapiens
gacagcatagatggg

SEQ ID NO: 12457 - DNA, 15 bp, Homo sapiens
ggacagcatagatgg

SEQ ID NO: 12458 - DNA, 15 bp, Homo sapiens
aggacagcatagatg

SEQ ID NO: 12459 - DNA, 15 bp, Homo sapiens
aaggacagcatagat

SEQ ID NO: 12460 - DNA, 15 bp, Homo sapiens
aaaggacagcataga

SEQ ID NO: 12461 - DNA, 15 bp, Homo sapiens
aaaaggacagcatag

SEQ ID NO: 12462 - DNA, 15 bp, Homo sapiens
gaaaaggacagcata

SEQ ID NO: 12463 - DNA, 15 bp, Homo sapiens
ggaaaaggacagcat

SEQ ID NO: 12464 - DNA, 15 bp, Homo sapiens
tggaaaaggacagca

SEQ ID NO: 12465 - DNA, 15 bp, Homo sapiens
gtggaaaaggacagc

SEQ ID NO: 12466 - DNA, 15 bp, Homo sapiens
ggtggaaaaggacag

SEQ ID NO: 12467 - DNA, 15 bp, Homo sapiens
gggtggaaaaggaca

SEQ ID NO: 12468 - DNA, 15 bp, Homo sapiens
ggggtggaaaaggac

SEQ ID NO: 12469 - DNA, 15 bp, Homo sapiens
tggggtggaaaagga

SEQ ID NO: 12470 - DNA, 15 bp, Homo sapiens
gtggggtggaaaagg

SEQ ID NO: 12471 - DNA, 15 bp, Homo sapiens
ggtggggtggaaaag

SEQ ID NO: 12472 - DNA, 15 bp, Homo sapiens
gggtggggtggaaaa

SEQ ID NO: 12473 - DNA, 15 bp, Homo sapiens
agggtggggtggaaa

SEQ ID NO: 12474 - DNA, 15 bp, Homo sapiens
tagggtggggtggaa

SEQ ID NO: 12475 - DNA, 15 bp, Homo sapiens
atagggtggggtgga

SEQ ID NO: 12476 - DNA, 15 bp, Homo sapiens
gatagggtggggtgg

SEQ ID NO: 12477 - DNA, 15 bp, Homo sapiens
ggatagggtggggtg

SEQ ID NO: 12478 - DNA, 15 bp, Homo sapiens
tggatagggtggggt

SEQ ID NO: 12479 - DNA, 15 bp, Homo sapiens
gtggatagggtgggg

SEQ ID NO: 12480 - DNA, 15 bp, Homo sapiens
agtggatagggtggg

SEQ ID NO: 12481 - DNA, 15 bp, Homo sapiens
cagtggatagggtgg

SEQ ID NO: 12482 - DNA, 15 bp, Homo sapiens
ccagtggatagggtg

SEQ ID NO: 12483 - DNA, 15 bp, Homo sapiens
cccagtggatagggt

SEQ ID NO: 12484 - DNA, 15 bp, Homo sapiens
gcccagtggataggg

SEQ ID NO: 12485 - DNA, 15 bp, Homo sapiens
ggcccagtggatagg

SEQ ID NO: 12486 - DNA, 15 bp, Homo sapiens
gggcccagtggatag

SEQ ID NO: 12487 - DNA, 15 bp, Homo sapiens
ggggcccagtggata

SEQ ID NO: 12488 - DNA, 15 bp, Homo sapiens
aggggcccagtggat

SEQ ID NO: 12489 - DNA, 15 bp, Homo sapiens
caggggcccagtgga

SEQ ID NO: 12490 - DNA, 15 bp, Homo sapiens
ccaggggcccagtgg

SEQ ID NO: 12491 - DNA, 15 bp, Homo sapiens
cccaggggcccagtg

SEQ ID NO: 12492 - DNA, 15 bp, Homo sapiens
ccccaggggcccagt

SEQ ID NO: 12493 - DNA, 15 bp, Homo sapiens
gccccaggggcccag

SEQ ID NO: 12494 - DNA, 15 bp, Homo sapiens
agccccaggggccca

SEQ ID NO: 12495 - DNA, 15 bp, Homo sapiens
gagccccaggggccc

SEQ ID NO: 12496 - DNA, 15 bp, Homo sapiens
ggagccccaggggcc

SEQ ID NO: 12497 - DNA, 15 bp, Homo sapiens
gggagccccaggggc

SEQ ID NO: 12498 - DNA, 15 bp, Homo sapiens
tgggagccccagggg

SEQ ID NO: 12499 - DNA, 15 bp, Homo sapiens
gtgggagccccaggg

SEQ ID NO: 12500 - DNA, 15 bp, Homo sapiens
agtgggagccccagg

SEQ ID NO: 12501 - DNA, 15 bp, Homo sapiens
gagtgggagccccag

SEQ ID NO: 12502 - DNA, 15 bp, Homo sapiens
ggagtgggagcccca

SEQ ID NO: 12503 - DNA, 15 bp, Homo sapiens
tggagtgggagcccc

SEQ ID NO: 12504 - DNA, 15 bp, Homo sapiens
gtggagtgggagccc

SEQ ID NO: 12505 - DNA, 15 bp, Homo sapiens
agtggagtgggagcc

SEQ ID NO: 12506 - DNA, 15 bp, Homo sapiens
gagtggagtgggagc

SEQ ID NO: 12507 - DNA, 15 bp, Homo sapiens
ggagtggagtgggag

SEQ ID NO: 12508 - DNA, 15 bp, Homo sapiens
tggagtggagtggga

SEQ ID NO: 12509 - DNA, 15 bp, Homo sapiens
ctggagtggagtggg

SEQ ID NO: 12510 - DNA, 15 bp, Homo sapiens
cctggagtggagtgg

SEQ ID NO: 12511 - DNA, 15 bp, Homo sapiens
acctggagtggagtg

SEQ ID NO: 12512 - DNA, 15 bp, Homo sapiens
gacctggagtggagt

SEQ ID NO: 12513 - DNA, 15 bp, Homo sapiens
agacctggagtggag

SEQ ID NO: 12514 - DNA, 15 bp, Homo sapiens
gagacctggagtgga

SEQ ID NO: 12515 - DNA, 15 bp, Homo sapiens
agagacctggagtgg

SEQ ID NO: 12516 - DNA, 15 bp, Homo sapiens
aagagacctggagtg

SEQ ID NO: 12517 - DNA, 15 bp, Homo sapiens
gaagagacctggagt

SEQ ID NO: 12518 - DNA, 15 bp, Homo sapiens
tgaagagacctggag

SEQ ID NO: 12519 - DNA, 15 bp, Homo sapiens
atgaagagacctgga

SEQ ID NO: 12520 - DNA, 15 bp, Homo sapiens
catgaagagacctgg

SEQ ID NO: 12521 - DNA, 15 bp, Homo sapiens
ccatgaagagacctg

SEQ ID NO: 12522 - DNA, 15 bp, Homo sapiens
tccatgaagagacct

SEQ ID NO: 12523 - DNA, 15 bp, Homo sapiens
gtccatgaagagacc

SEQ ID NO: 12524 - DNA, 15 bp, Homo sapiens
ggtccatgaagagac

SEQ ID NO: 12525 - DNA, 15 bp, Homo sapiens
gggtccatgaagaga

SEQ ID NO: 12526 - DNA, 15 bp, Homo sapiens
agggtccatgaagag

SEQ ID NO: 12527 - DNA, 15 bp, Homo sapiens
aagggtccatgaaga

SEQ ID NO: 12528 - DNA, 15 bp, Homo sapiens
gaagggtccatgaag

SEQ ID NO: 12529 - DNA, 15 bp, Homo sapiens
agaagggtccatgaa

SEQ ID NO: 12530 - DNA, 15 bp, Homo sapiens
aagaagggtccatga

SEQ ID NO: 12531 - DNA, 15 bp, Homo sapiens
aaagaagggtccatg

SEQ ID NO: 12532 - DNA, 15 bp, Homo sapiens
gaaagaagggtccat

SEQ ID NO: 12533 - DNA, 15 bp, Homo sapiens
ggaaagaagggtcca

SEQ ID NO: 12534 - DNA, 15 bp, Homo sapiens
gggaaagaagggtcc

SEQ ID NO: 12535 - DNA, 15 bp, Homo sapiens
agggaaagaagggtc

SEQ ID NO: 12536 - DNA, 15 bp, Homo sapiens
aagggaaagaagggt

SEQ ID NO: 12537 - DNA, 15 bp, Homo sapiens
gaagggaaagaaggg

SEQ ID NO: 12538 - DNA, 15 bp, Homo sapiens
tgaagggaaagaagg

SEQ ID NO: 12539 - DNA, 15 bp, Homo sapiens
gtgaagggaaagaag

SEQ ID NO: 12540 - DNA, 15 bp, Homo sapiens
agtgaagggaaagaa

SEQ ID NO: 12541 - DNA, 15 bp, Homo sapiens
aagtgaagggaaaga

SEQ ID NO: 12542 - DNA, 15 bp, Homo sapiens
gaagtgaagggaaag

SEQ ID NO: 12543 - DNA, 15 bp, Homo sapiens
agaagtgaagggaaa

SEQ ID NO: 12544 - DNA, 15 bp, Homo sapiens
cagaagtgaagggaa

SEQ ID NO: 12545 - DNA, 15 bp, Homo sapiens
acagaagtgaaggga

SEQ ID NO: 12546 - DNA, 15 bp, Homo sapiens
gacagaagtgaaggg

SEQ ID NO: 12547 - DNA, 15 bp, Homo sapiens
ggacagaagtgaagg

SEQ ID NO: 12548 - DNA, 15 bp, Homo sapiens
gggacagaagtgaag

SEQ ID NO: 12549 - DNA, 15 bp, Homo sapiens
tgggacagaagtgaa

SEQ ID NO: 12550 - DNA, 15 bp, Homo sapiens
ctgggacagaagtga

SEQ ID NO: 12551 - DNA, 15 bp, Homo sapiens
cctgggacagaagtg

SEQ ID NO: 12552 - DNA, 15 bp, Homo sapiens
tcctgggacagaagt

SEQ ID NO: 12553 - DNA, 15 bp, Homo sapiens
ctcctgggacagaag

SEQ ID NO: 12554 - DNA, 15 bp, Homo sapiens
tctcctgggacagaa

SEQ ID NO: 12555 - DNA, 15 bp, Homo sapiens
gtctcctgggacaga

SEQ ID NO: 12556 - DNA, 15 bp, Homo sapiens
ggtctcctgggacag

SEQ ID NO: 12557 - DNA, 15 bp, Homo sapiens
aggtctcctgggaca

SEQ ID NO: 12558 - DNA, 15 bp, Homo sapiens
caggtctcctgggac

SEQ ID NO: 12559 - DNA, 15 bp, Homo sapiens
ccaggtctcctggga

SEQ ID NO: 12560 - DNA, 15 bp, Homo sapiens
cccaggtctcctggg

SEQ ID NO: 12561 - DNA, 15 bp, Homo sapiens
tcccaggtctcctgg

SEQ ID NO: 12562 - DNA, 15 bp, Homo sapiens
ctcccaggtctcctg

SEQ ID NO: 12563 - DNA, 15 bp, Homo sapiens
tctcccaggtctcct

SEQ ID NO: 12564 - DNA, 15 bp, Homo sapiens
gtctcccaggtctcc

SEQ ID NO: 12565 - DNA, 15 bp, Homo sapiens
agtctcccaggtctc

SEQ ID NO: 12566 - DNA, 15 bp, Homo sapiens
gagtctcccaggtct

SEQ ID NO: 12567 - DNA, 15 bp, Homo sapiens
tgagtctcccaggtc

SEQ ID NO: 12568 - DNA, 15 bp, Homo sapiens
atgagtctcccaggt

SEQ ID NO: 12569 - DNA, 15 bp, Homo sapiens
catgagtctcccagg

SEQ ID NO: 12570 - DNA, 15 bp, Homo sapiens
ccatgagtctcccag

SEQ ID NO: 12571 - DNA, 15 bp, Homo sapiens
cccatgagtctccca

SEQ ID NO: 12572 - DNA, 15 bp, Homo sapiens
tcccatgagtctccc

SEQ ID NO: 12573 - DNA, 15 bp, Homo sapiens
ttcccatgagtctcc

SEQ ID NO: 12574 - DNA, 15 bp, Homo sapiens
gttcccatgagtctc

SEQ ID NO: 12575 - DNA, 15 bp, Homo sapiens
tgttcccatgagtct

SEQ ID NO: 12576 - DNA, 15 bp, Homo sapiens
ctgttcccatgagtc

SEQ ID NO: 12577 - DNA, 15 bp, Homo sapiens
cctgttcccatgagt

SEQ ID NO: 12578 - DNA, 15 bp, Homo sapiens
gcctgttcccatgag

SEQ ID NO: 12579 - DNA, 15 bp, Homo sapiens
tgcctgttcccatga

SEQ ID NO: 12580 - DNA, 15 bp, Homo sapiens
atgcctgttcccatg

SEQ ID NO: 12581 - DNA, 15 bp, Homo sapiens
gatgcctgttcccat

SEQ ID NO: 12582 - DNA, 15 bp, Homo sapiens
tgatgcctgttccca

SEQ ID NO: 12583 - DNA, 15 bp, Homo sapiens
atgatgcctgttccc

SEQ ID NO: 12584 - DNA, 15 bp, Homo sapiens
gatgatgcctgttcc

SEQ ID NO: 12585 - DNA, 15 bp, Homo sapiens
agatgatgcctgttc

SEQ ID NO: 12586 - DNA, 15 bp, Homo sapiens
aagatgatgcctgtt

SEQ ID NO: 12587 - DNA, 15 bp, Homo sapiens
gaagatgatgcctgt

SEQ ID NO: 12588 - DNA, 15 bp, Homo sapiens
agaagatgatgcctg

SEQ ID NO: 12589 - DNA, 15 bp, Homo sapiens
gagaagatgatgcct

SEQ ID NO: 12590 - DNA, 15 bp, Homo sapiens
ggagaagatgatgcc

SEQ ID NO: 12591 - DNA, 15 bp, Homo sapiens
tggagaagatgatgc

SEQ ID NO: 12592 - DNA, 15 bp, Homo sapiens
ctggagaagatgatg

SEQ ID NO: 12593 - DNA, 15 bp, Homo sapiens
gctggagaagatgat

SEQ ID NO: 12594 - DNA, 15 bp, Homo sapiens
tgctggagaagatga

SEQ ID NO: 12595 - DNA, 15 bp, Homo sapiens
gtgctggagaagatg

SEQ ID NO: 12596 - DNA, 15 bp, Homo sapiens
tgtgctggagaagat

SEQ ID NO: 12597 - DNA, 15 bp, Homo sapiens
ctgtgctggagaaga

SEQ ID NO: 12598 - DNA, 15 bp, Homo sapiens
actgtgctggagaag

SEQ ID NO: 12599 - DNA, 15 bp, Homo sapiens
aactgtgctggagaa

SEQ ID NO: 12600 - DNA, 15 bp, Homo sapiens
gaactgtgctggaga

SEQ ID NO: 12601 - DNA, 15 bp, Homo sapiens
tgaactgtgctggag

SEQ ID NO: 12602 - DNA, 15 bp, Homo sapiens
atgaactgtgctgga

SEQ ID NO: 12603 - DNA, 15 bp, Homo sapiens
aatgaactgtgctgg

SEQ ID NO: 12604 - DNA, 15 bp, Homo sapiens
caatgaactgtgctg

SEQ ID NO: 12605 - DNA, 15 bp, Homo sapiens
acaatgaactgtgct

SEQ ID NO: 12606 - DNA, 15 bp, Homo sapiens
gacaatgaactgtgc

SEQ ID NO: 12607 - DNA, 15 bp, Homo sapiens
agacaatgaactgtg

SEQ ID NO: 12608 - DNA, 15 bp, Homo sapiens
tagacaatgaactgt

SEQ ID NO: 12609 - DNA, 15 bp, Homo sapiens
ttagacaatgaactg

SEQ ID NO: 12610 - DNA, 15 bp, Homo sapiens
attagacaatgaact

SEQ ID NO: 12611 - DNA, 15 bp, Homo sapiens
cattagacaatgaac

SEQ ID NO: 12612 - DNA, 15 bp, Homo sapiens
gcattagacaatgaa

SEQ ID NO: 12613 - DNA, 15 bp, Homo sapiens
tgcattagacaatga

SEQ ID NO: 12614 - DNA, 15 bp, Homo sapiens
gtgcattagacaatg

SEQ ID NO: 12615 - DNA, 15 bp, Homo sapiens
cgtgcattagacaat

SEQ ID NO: 12616 - DNA, 15 bp, Homo sapiens
tcgtgcattagacaa

SEQ ID NO: 12617 - DNA, 15 bp, Homo sapiens
ttcgtgcattagaca

SEQ ID NO: 12618 - DNA, 15 bp, Homo sapiens
tttcgtgcattagac

SEQ ID NO: 12619 - DNA, 15 bp, Homo sapiens
ctttcgtgcattaga

SEQ ID NO: 12620 - DNA, 15 bp, Homo sapiens
actttcgtgcattag

SEQ ID NO: 12621 - DNA, 15 bp, Homo sapiens
cactttcgtgcatta

SEQ ID NO: 12622 - DNA, 15 bp, Homo sapiens
gcactttcgtgcatt

SEQ ID NO: 12623 - DNA, 15 bp, Homo sapiens
agcactttcgtgcat

SEQ ID NO: 12624 - DNA, 15 bp, Homo sapiens
cagcactttcgtgca

SEQ ID NO: 12625 - DNA, 15 bp, Homo sapiens
ccagcactttcgtgc

SEQ ID NO: 12626 - DNA, 15 bp, Homo sapiens
cccagcactttcgtg

SEQ ID NO: 12627 - DNA, 15 bp, Homo sapiens
gcccagcactttcgt

SEQ ID NO: 12628 - DNA, 15 bp, Homo sapiens
agcccagcactttcg

SEQ ID NO: 12629 - DNA, 15 bp, Homo sapiens
cagcccagcactttc

SEQ ID NO: 12630 - DNA, 15 bp, Homo sapiens
acagcccagcacttt

SEQ ID NO: 12631 - DNA, 15 bp, Homo sapiens
cacagcccagcactt

SEQ ID NO: 12632 - DNA, 15 bp, Homo sapiens
tcacagcccagcact

SEQ ID NO: 12633 - DNA, 15 bp, Homo sapiens
ctcacagcccagcac

SEQ ID NO: 12634 - DNA, 15 bp, Homo sapiens
tctcacagcccagca

SEQ ID NO: 12635 - DNA, 15 bp, Homo sapiens
ttctcacagcccagc

SEQ ID NO: 12636 - DNA, 15 bp, Homo sapiens
cttctcacagcccag

SEQ ID NO: 12637 - DNA, 15 bp, Homo sapiens
ccttctcacagccca

SEQ ID NO: 12638 - DNA, 15 bp, Homo sapiens
accttctcacagccc

SEQ ID NO: 12639 - DNA, 15 bp, Homo sapiens
gaccttctcacagcc

SEQ ID NO: 12640 - DNA, 15 bp, Homo sapiens
tgaccttctcacagc

SEQ ID NO: 12641 - DNA, 15 bp, Homo sapiens
ctgaccttctcacag

SEQ ID NO: 12642 - DNA, 15 bp, Homo sapiens
cctgaccttctcaca

SEQ ID NO: 12643 - DNA, 15 bp, Homo sapiens
tcctgaccttctcac

SEQ ID NO: 12644 - DNA, 15 bp, Homo sapiens
ctcctgaccttctca

SEQ ID NO: 12645 - DNA, 15 bp, Homo sapiens
gctcctgaccttctc

SEQ ID NO: 12646 - DNA, 15 bp, Homo sapiens
agctcctgaccttct

SEQ ID NO: 12647 - DNA, 15 bp, Homo sapiens
aagctcctgaccttc

SEQ ID NO: 12648 - DNA, 15 bp, Homo sapiens
taagctcctgacctt

SEQ ID NO: 12649 - DNA, 15 bp, Homo sapiens
gtaagctcctgacct

SEQ ID NO: 12650 - DNA, 15 bp, Homo sapiens
tgtaagctcctgacc

SEQ ID NO: 12651 - DNA, 15 bp, Homo sapiens
atgtaagctcctgac

SEQ ID NO: 12652 - DNA, 15 bp, Homo sapiens
catgtaagctcctga

SEQ ID NO: 12653 - DNA, 15 bp, Homo sapiens
ccatgtaagctcctg

SEQ ID NO: 12654 - DNA, 15 bp, Homo sapiens
tccatgtaagctcct

SEQ ID NO: 12655 - DNA, 15 bp, Homo sapiens
ttccatgtaagctcc

SEQ ID NO: 12656 - DNA, 15 bp, Homo sapiens
attccatgtaagctc

SEQ ID NO: 12657 - DNA, 15 bp, Homo sapiens
cattccatgtaagct

SEQ ID NO: 12658 - DNA, 15 bp, Homo sapiens
ccattccatgtaagc

SEQ ID NO: 12659 - DNA, 15 bp, Homo sapiens
cccattccatgtaag

SEQ ID NO: 12660 - DNA, 15 bp, Homo sapiens
tcccattccatgtaa

SEQ ID NO: 12661 - DNA, 15 bp, Homo sapiens
ctcccattccatgta

SEQ ID NO: 12662 - DNA, 15 bp, Homo sapiens
actcccattccatgt

SEQ ID NO: 12663 - DNA, 15 bp, Homo sapiens
gactcccattccatg

SEQ ID NO: 12664 - DNA, 15 bp, Homo sapiens
tgactcccattccat

SEQ ID NO: 12665 - DNA, 15 bp, Homo sapiens
ctgactcccattcca

SEQ ID NO: 12666 - DNA, 15 bp, Homo sapiens
gctgactcccattcc

SEQ ID NO: 12667 - DNA, 15 bp, Homo sapiens
agctgactcccattc

SEQ ID NO: 12668 - DNA, 15 bp, Homo sapiens
cagctgactcccatt

SEQ ID NO: 12669 - DNA, 15 bp, Homo sapiens
acagctgactcccat

SEQ ID NO: 12670 - DNA, 15 bp, Homo sapiens
cacagctgactccca

SEQ ID NO: 12671 - DNA, 15 bp, Homo sapiens
ccacagctgactccc

SEQ ID NO: 12672 - DNA, 15 bp, Homo sapiens
accacagctgactcc

SEQ ID NO: 12673 - DNA, 15 bp, Homo sapiens
taccacagctgactc

SEQ ID NO: 12674 - DNA, 15 bp, Homo sapiens
gtaccacagctgact

SEQ ID NO: 12675 - DNA, 15 bp, Homo sapiens
tgtaccacagctgac

SEQ ID NO: 12676 - DNA, 15 bp, Homo sapiens
ttgtaccacagctga

SEQ ID NO: 12677 - DNA, 15 bp, Homo sapiens
tttgtaccacagctg

SEQ ID NO: 12678 - DNA, 15 bp, Homo sapiens
ctttgtaccacagct

SEQ ID NO: 12679 - DNA, 15 bp, Homo sapiens
actttgtaccacagc

SEQ ID NO: 12680 - DNA, 15 bp, Homo sapiens
tactttgtaccacag

SEQ ID NO: 12681 - DNA, 15 bp, Homo sapiens
gtactttgtaccaca

SEQ ID NO: 12682 - DNA, 15 bp, Homo sapiens
cgtactttgtaccac

SEQ ID NO: 12683 - DNA, 15 bp, Homo sapiens
gcgtactttgtacca

SEQ ID NO: 12684 - DNA, 15 bp, Homo sapiens
agcgtactttgtacc

SEQ ID NO: 12685 - DNA, 15 bp, Homo sapiens
cagcgtactttgtac

SEQ ID NO: 12686 - DNA, 15 bp, Homo sapiens
gcagcgtactttgta

SEQ ID NO: 12687 - DNA, 15 bp, Homo sapiens
agcagcgtactttgt

SEQ ID NO: 12688 - DNA, 15 bp, Homo sapiens
aagcagcgtactttg

SEQ ID NO: 12689 - DNA, 15 bp, Homo sapiens
taagcagcgtacttt

SEQ ID NO: 12690 - DNA, 15 bp, Homo sapiens
ctaagcagcgtactt

SEQ ID NO: 12691 - DNA, 15 bp, Homo sapiens
actaagcagcgtact

SEQ ID NO: 12692 - DNA, 15 bp, Homo sapiens
aactaagcagcgtac

SEQ ID NO: 12693 - DNA, 15 bp, Homo sapiens
gaactaagcagcgta

SEQ ID NO: 12694 - DNA, 15 bp, Homo sapiens
agaactaagcagcgt

SEQ ID NO: 12695 - DNA, 15 bp, Homo sapiens
tagaactaagcagcg

SEQ ID NO: 12696 - DNA, 15 bp, Homo sapiens
gtagaactaagcagc

SEQ ID NO: 12697 - DNA, 15 bp, Homo sapiens
agtagaactaagcag

SEQ ID NO: 12698 - DNA, 15 bp, Homo sapiens
cagtagaactaagca

SEQ ID NO: 12699 - DNA, 15 bp, Homo sapiens
tcagtagaactaagc

SEQ ID NO: 12700 - DNA, 15 bp, Homo sapiens
atcagtagaactaag

SEQ ID NO: 12701 - DNA, 15 bp, Homo sapiens
aatcagtagaactaa

SEQ ID NO: 12702 - DNA, 15 bp, Homo sapiens
aaatcagtagaacta

SEQ ID NO: 12703 - DNA, 15 bp, Homo sapiens
aaaatcagtagaact

SEQ ID NO: 12704 - DNA, 15 bp, Homo sapiens
aaaaatcagtagaac

SEQ ID NO: 12705 - DNA, 15 bp, Homo sapiens
aaaaaatcagtagaa

SEQ ID NO: 12706 - DNA, 15 bp, Homo sapiens
taaaaaatcagtaga

SEQ ID NO: 12707 - DNA, 15 bp, Homo sapiens
ataaaaaatcagtag

SEQ ID NO: 12708 - DNA, 15 bp, Homo sapiens
aataaaaaatcagta

SEQ ID NO: 12709 - DNA, 15 bp, Homo sapiens
aaataaaaaatcagt

SEQ ID NO: 12710 - DNA, 15 bp, Homo sapiens
aaaataaaaaatcag

SEQ ID NO: 12711 - DNA, 15 bp, Homo sapiens
aaaaataaaaaatca

SEQ ID NO: 12712 - DNA, 15 bp, Homo sapiens
aaaaaataaaaaatc

SEQ ID NO: 12713 - DNA, 15 bp, Homo sapiens
taaaaaataaaaaat

SEQ ID NO: 12714 - DNA, 15 bp, Homo sapiens
ataaaaaataaaaaa

SEQ ID NO: 12715 - DNA, 15 bp, Homo sapiens
aataaaaaataaaaa

SEQ ID NO: 12716 - DNA, 15 bp, Homo sapiens
aaataaaaaataaaa

SEQ ID NO: 12717 - DNA, 15 bp, Homo sapiens
aaaataaaaaataaa

SEQ ID NO: 12718 - DNA, 15 bp, Homo sapiens
aaaaataaaaaataa

SEQ ID NO: 12719 - DNA, 15 bp, Homo sapiens
taaaaataaaaaata

SEQ ID NO: 12720 - DNA, 15 bp, Homo sapiens
gtaaaaataaaaaat

SEQ ID NO: 12721 - DNA, 15 bp, Homo sapiens
tgtaaaaataaaaaa

SEQ ID NO: 12722 - DNA, 15 bp, Homo sapiens
atgtaaaaataaaaa

SEQ ID NO: 12723 - DNA, 15 bp, Homo sapiens
tatgtaaaaataaaa

SEQ ID NO: 12724 - DNA, 15 bp, Homo sapiens
ttatgtaaaaataaa

SEQ ID NO: 12725 - DNA, 15 bp, Homo sapiens
cttatgtaaaaataa

SEQ ID NO: 12726 - DNA, 15 bp, Homo sapiens
tcttatgtaaaaata

SEQ ID NO: 12727 - DNA, 15 bp, Homo sapiens
gtcttatgtaaaaat

SEQ ID NO: 12728 - DNA, 15 bp, Homo sapiens
agtcttatgtaaaaa

SEQ ID NO: 12729 - DNA, 15 bp, Homo sapiens
aagtcttatgtaaaa

SEQ ID NO: 12730 - DNA, 15 bp, Homo sapiens
aaagtcttatgtaaa

SEQ ID NO: 12731 - DNA, 15 bp, Homo sapiens
caaagtcttatgtaa

SEQ ID NO: 12732 - DNA, 15 bp, Homo sapiens
tcaaagtcttatgta

SEQ ID NO: 12733 - DNA, 15 bp, Homo sapiens
atcaaagtcttatgt

SEQ ID NO: 12734 - DNA, 15 bp, Homo sapiens
catcaaagtcttatg

SEQ ID NO: 12735 - DNA, 15 bp, Homo sapiens
ccatcaaagtcttat

SEQ ID NO: 12736 - DNA, 15 bp, Homo sapiens
accatcaaagtctta

SEQ ID NO: 12737 - DNA, 15 bp, Homo sapiens
taccatcaaagtctt

SEQ ID NO: 12738 - DNA, 15 bp, Homo sapiens
ttaccatcaaagtct

SEQ ID NO: 12739 - DNA, 15 bp, Homo sapiens
tttaccatcaaagtc

SEQ ID NO: 12740 - DNA, 15 bp, Homo sapiens
ctttaccatcaaagt

SEQ ID NO: 12741 - DNA, 15 bp, Homo sapiens
cctttaccatcaaag

SEQ ID NO: 12742 - DNA, 15 bp, Homo sapiens
tcctttaccatcaaa

SEQ ID NO: 12743 - DNA, 15 bp, Homo sapiens
ttcctttaccatcaa

SEQ ID NO: 12744 - DNA, 15 bp, Homo sapiens
cttcctttaccatca

SEQ ID NO: 12745 - DNA, 15 bp, Homo sapiens
gcttcctttaccatc

SEQ ID NO: 12746 - DNA, 15 bp, Homo sapiens
tgcttcctttaccat

SEQ ID NO: 12747 - DNA, 15 bp, Homo sapiens
ctgcttcctttacca

SEQ ID NO: 12748 - DNA, 15 bp, Homo sapiens
actgcttcctttacc

SEQ ID NO: 12749 - DNA, 15 bp, Homo sapiens
cactgcttcctttac

SEQ ID NO: 12750 - DNA, 15 bp, Homo sapiens
acactgcttccttta

SEQ ID NO: 12751 - DNA, 15 bp, Homo sapiens
cacactgcttccttt

SEQ ID NO: 12752 - DNA, 15 bp, Homo sapiens
acacactgcttcctt

SEQ ID NO: 12753 - DNA, 15 bp, Homo sapiens
cacacactgcttcct

SEQ ID NO: 12754 - DNA, 15 bp, Homo sapiens
tcacacactgcttcc

SEQ ID NO: 12755 - DNA, 15 bp, Homo sapiens
ctcacacactgcttc

SEQ ID NO: 12756 - DNA, 15 bp, Homo sapiens
gctcacacactgctt

SEQ ID NO: 12757 - DNA, 15 bp, Homo sapiens
tgctcacacactgct

SEQ ID NO: 12758 - DNA, 15 bp, Homo sapiens
ttgctcacacactgc

SEQ ID NO: 12759 - DNA, 15 bp, Homo sapiens
cttgctcacacactg

SEQ ID NO: 12760 - DNA, 15 bp, Homo sapiens
gcttgctcacacact

SEQ ID NO: 12761 - DNA, 15 bp, Homo sapiens
agcttgctcacacac

SEQ ID NO: 12762 - DNA, 15 bp, Homo sapiens
cagcttgctcacaca

SEQ ID NO: 12763 - DNA, 15 bp, Homo sapiens
tcagcttgctcacac

SEQ ID NO: 12764 - DNA, 15 bp, Homo sapiens
gtcagcttgctcaca

SEQ ID NO: 12765 - DNA, 15 bp, Homo sapiens
agtcagcttgctcac

SEQ ID NO: 12766 - DNA, 15 bp, Homo sapiens
gagtcagcttgctca

SEQ ID NO: 12767 - DNA, 15 bp, Homo sapiens
ggagtcagcttgctc

SEQ ID NO: 12768 - DNA, 15 bp, Homo sapiens
aggagtcagcttgct

SEQ ID NO: 12769 - DNA, 15 bp, Homo sapiens
caggagtcagcttgc

SEQ ID NO: 12770 - DNA, 15 bp, Homo sapiens
acaggagtcagcttg

SEQ ID NO: 12771 - DNA, 15 bp, Homo sapiens
gacaggagtcagctt

SEQ ID NO: 12772 - DNA, 15 bp, Homo sapiens
agacaggagtcagct

SEQ ID NO: 12773 - DNA, 15 bp, Homo sapiens
aagacaggagtcagc

SEQ ID NO: 12774 - DNA, 15 bp, Homo sapiens
caagacaggagtcag

SEQ ID NO: 12775 - DNA, 15 bp, Homo sapiens
acaagacaggagtca

SEQ ID NO: 12776 - DNA, 15 bp, Homo sapiens
gacaagacaggagtc

SEQ ID NO: 12777 - DNA, 15 bp, Homo sapiens
tgacaagacaggagt

SEQ ID NO: 12778 - DNA, 15 bp, Homo sapiens
ttgacaagacaggag

SEQ ID NO: 12779 - DNA, 15 bp, Homo sapiens
cttgacaagacagga

SEQ ID NO: 12780 - DNA, 15 bp, Homo sapiens
acttgacaagacagg

SEQ ID NO: 12781 - DNA, 15 bp, Homo sapiens
tacttgacaagacag

SEQ ID NO: 12782 - DNA, 15 bp, Homo sapiens
gtacttgacaagaca

SEQ ID NO: 12783 - DNA, 15 bp, Homo sapiens
ggtacttgacaagac

SEQ ID NO: 12784 - DNA, 15 bp, Homo sapiens
tggtacttgacaaga

SEQ ID NO: 12785 - DNA, 15 bp, Homo sapiens
ctggtacttgacaag

SEQ ID NO: 12786 - DNA, 15 bp, Homo sapiens
cctggtacttgacaa

SEQ ID NO: 12787 - DNA, 15 bp, Homo sapiens
acctggtacttgaca

SEQ ID NO: 12788 - DNA, 15 bp, Homo sapiens
gacctggtacttgac

SEQ ID NO: 12789 - DNA, 15 bp, Homo sapiens
ggacctggtacttga

SEQ ID NO: 12790 - DNA, 15 bp, Homo sapiens
tggacctggtacttg

SEQ ID NO: 12791 - DNA, 15 bp, Homo sapiens
gtggacctggtactt

SEQ ID NO: 12792 - DNA, 15 bp, Homo sapiens
agtggacctggtact

SEQ ID NO: 12793 - DNA, 15 bp, Homo sapiens
gagtggacctggtac

SEQ ID NO: 12794 - DNA, 15 bp, Homo sapiens
agagtggacctggta

SEQ ID NO: 12795 - DNA, 15 bp, Homo sapiens
cagagtggacctggt

SEQ ID NO: 12796 - DNA, 15 bp, Homo sapiens
tcagagtggacctgg

SEQ ID NO: 12797 - DNA, 15 bp, Homo sapiens
atcagagtggacctg

SEQ ID NO: 12798 - DNA, 15 bp, Homo sapiens
catcagagtggacct

SEQ ID NO: 12799 - DNA, 15 bp, Homo sapiens
tcatcagagtggacc

SEQ ID NO: 12800 - DNA, 15 bp, Homo sapiens
ctcatcagagtggac

SEQ ID NO: 12801 - DNA, 15 bp, Homo sapiens
gctcatcagagtgga

SEQ ID NO: 12802 - DNA, 15 bp, Homo sapiens
ggctcatcagagtgg

SEQ ID NO: 12803 - DNA, 15 bp, Homo sapiens
gggctcatcagagtg

SEQ ID NO: 12804 - DNA, 15 bp, Homo sapiens
ggggctcatcagagt

SEQ ID NO: 12805 - DNA, 15 bp, Homo sapiens
aggggctcatcagag

SEQ ID NO: 12806 - DNA, 15 bp, Homo sapiens
caggggctcatcaga

SEQ ID NO: 12807 - DNA, 15 bp, Homo sapiens
acaggggctcatcag

SEQ ID NO: 12808 - DNA, 15 bp, Homo sapiens
cacaggggctcatca

SEQ ID NO: 12809 - DNA, 15 bp, Homo sapiens
ccacaggggctcatc

SEQ ID NO: 12810 - DNA, 15 bp, Homo sapiens
tccacaggggctcat

SEQ ID NO: 12811 - DNA, 15 bp, Homo sapiens
gtccacaggggctca

SEQ ID NO: 12812 - DNA, 15 bp, Homo sapiens
tgtccacaggggctc

SEQ ID NO: 12813 - DNA, 15 bp, Homo sapiens
ctgtccacaggggct

SEQ ID NO: 12814 - DNA, 15 bp, Homo sapiens
gctgtccacaggggc

SEQ ID NO: 12815 - DNA, 15 bp, Homo sapiens
tgctgtccacagggg

SEQ ID NO: 12816 - DNA, 15 bp, Homo sapiens
gtgctgtccacaggg

SEQ ID NO: 12817 - DNA, 15 bp, Homo sapiens
agtgctgtccacagg

SEQ ID NO: 12818 - DNA, 15 bp, Homo sapiens
cagtgctgtccacag

SEQ ID NO: 12819 - DNA, 15 bp, Homo sapiens
gcagtgctgtccaca

SEQ ID NO: 12820 - DNA, 15 bp, Homo sapiens
agcagtgctgtccac

SEQ ID NO: 12821 - DNA, 15 bp, Homo sapiens
cagcagtgctgtcca

SEQ ID NO: 12822 - DNA, 15 bp, Homo sapiens
acagcagtgctgtcc

SEQ ID NO: 12823 - DNA, 15 bp, Homo sapiens
tacagcagtgctgtc

SEQ ID NO: 12824 - DNA, 15 bp, Homo sapiens
ttacagcagtgctgt

SEQ ID NO: 12825 - DNA, 15 bp, Homo sapiens
gttacagcagtgctg

SEQ ID NO: 12826 - DNA, 15 bp, Homo sapiens
agttacagcagtgct

SEQ ID NO: 12827 - DNA, 15 bp, Homo sapiens
gagttacagcagtgc

SEQ ID NO: 12828 - DNA, 15 bp, Homo sapiens
ggagttacagcagtg

SEQ ID NO: 12829 - DNA, 15 bp, Homo sapiens
gggagttacagcagt

SEQ ID NO: 12830 - DNA, 15 bp, Homo sapiens
ggggagttacagcag

SEQ ID NO: 12831 - DNA, 15 bp, Homo sapiens
tggggagttacagca

SEQ ID NO: 12832 - DNA, 15 bp, Homo sapiens
ttggggagttacagc

SEQ ID NO: 12833 - DNA, 15 bp, Homo sapiens
cttggggagttacag

SEQ ID NO: 12834 - DNA, 15 bp, Homo sapiens
gcttggggagttaca

SEQ ID NO: 12835 - DNA, 15 bp, Homo sapiens
ggcttggggagttac

SEQ ID NO: 12836 - DNA, 15 bp, Homo sapiens
aggcttggggagtta

SEQ ID NO: 12837 - DNA, 15 bp, Homo sapiens
caggcttggggagtt

SEQ ID NO: 12838 - DNA, 15 bp, Homo sapiens
ccaggcttggggagt

SEQ ID NO: 12839 - DNA, 15 bp, Homo sapiens
cccaggcttggggag

SEQ ID NO: 12840 - DNA, 15 bp, Homo sapiens
gcccaggcttgggga

SEQ ID NO: 12841 - DNA, 15 bp, Homo sapiens
agcccaggcttgggg

SEQ ID NO: 12842 - DNA, 15 bp, Homo sapiens
gagcccaggcttggg

SEQ ID NO: 12843 - DNA, 15 bp, Homo sapiens
tgagcccaggcttgg

SEQ ID NO: 12844 - DNA, 15 bp, Homo sapiens
ctgagcccaggcttg

SEQ ID NO: 12845 - DNA, 15 bp, Homo sapiens
cctgagcccaggctt

SEQ ID NO: 12846 - DNA, 15 bp, Homo sapiens
tcctgagcccaggct

SEQ ID NO: 12847 - DNA, 15 bp, Homo sapiens
ctcctgagcccaggc

SEQ ID NO: 12848 - DNA, 15 bp, Homo sapiens
cctcctgagcccagg

SEQ ID NO: 12849 - DNA, 15 bp, Homo sapiens
acctcctgagcccag

SEQ ID NO: 12850 - DNA, 15 bp, Homo sapiens
cacctcctgagccca

SEQ ID NO: 12851 - DNA, 15 bp, Homo sapiens
ccacctcctgagccc

SEQ ID NO: 12852 - DNA, 15 bp, Homo sapiens
cccacctcctgagcc

SEQ ID NO: 12853 - DNA, 15 bp, Homo sapiens
gcccacctcctgagc

SEQ ID NO: 12854 - DNA, 15 bp, Homo sapiens
ggcccacctcctgag

SEQ ID NO: 12855 - DNA, 15 bp, Homo sapiens
gggcccacctcctga

SEQ ID NO: 12856 - DNA, 15 bp, Homo sapiens
agggcccacctcctg

SEQ ID NO: 12857 - DNA, 15 bp, Homo sapiens
tagggcccacctcct

SEQ ID NO: 12858 - DNA, 15 bp, Homo sapiens
ttagggcccacctcc

SEQ ID NO: 12859 - DNA, 15 bp, Homo sapiens
cttagggcccacctc

SEQ ID NO: 12860 - DNA, 15 bp, Homo sapiens
gcttagggcccacct

SEQ ID NO: 12861 - DNA, 15 bp, Homo sapiens
cgcttagggcccacc

SEQ ID NO: 12862 - DNA, 15 bp, Homo sapiens
gcgcttagggcccac

SEQ ID NO: 12863 - DNA, 15 bp, Homo sapiens
agcgcttagggccca

SEQ ID NO: 12864 - DNA, 15 bp, Homo sapiens
cagcgcttagggccc

SEQ ID NO: 12865 - DNA, 15 bp, Homo sapiens
acagcgcttagggcc

SEQ ID NO: 12866 - DNA, 15 bp, Homo sapiens
aacagcgcttagggc

SEQ ID NO: 12867 - DNA, 15 bp, Homo sapiens
gaacagcgcttaggg

SEQ ID NO: 12868 - DNA, 15 bp, Homo sapiens
ggaacagcgcttagg

SEQ ID NO: 12869 - DNA, 15 bp, Homo sapiens
gggaacagcgcttag

SEQ ID NO: 12870 - DNA, 15 bp, Homo sapiens
tgggaacagcgctta

SEQ ID NO: 12871 - DNA, 15 bp, Homo sapiens
ctgggaacagcgctt

SEQ ID NO: 12872 - DNA, 15 bp, Homo sapiens
gctgggaacagcgct

SEQ ID NO: 12873 - DNA, 15 bp, Homo sapiens
agctgggaacagcgc

SEQ ID NO: 12874 - DNA, 15 bp, Homo sapiens
gagctgggaacagcg

SEQ ID NO: 12875 - DNA, 15 bp, Homo sapiens
agagctgggaacagc

SEQ ID NO: 12876 - DNA, 15 bp, Homo sapiens
aagagctgggaacag

SEQ ID NO: 12877 - DNA, 15 bp, Homo sapiens
gaagagctgggaaca

SEQ ID NO: 12878 - DNA, 15 bp, Homo sapiens
ggaagagctgggaac

SEQ ID NO: 12879 - DNA, 15 bp, Homo sapiens
aggaagagctgggaa

SEQ ID NO: 12880 - DNA, 15 bp, Homo sapiens
gaggaagagctggga

SEQ ID NO: 12881 - DNA, 15 bp, Homo sapiens
ggaggaagagctggg

SEQ ID NO: 12882 - DNA, 15 bp, Homo sapiens
tggaggaagagctgg

SEQ ID NO: 12883 - DNA, 15 bp, Homo sapiens
atggaggaagagctg

SEQ ID NO: 12884 - DNA, 15 bp, Homo sapiens
catggaggaagagct

SEQ ID NO: 12885 - DNA, 15 bp, Homo sapiens
gcatggaggaagagc

SEQ ID NO: 12886 - DNA, 15 bp, Homo sapiens
agcatggaggaagag

SEQ ID NO: 12887 - DNA, 15 bp, Homo sapiens
cagcatggaggaaga

SEQ ID NO: 12888 - DNA, 15 bp, Homo sapiens
acagcatggaggaag

SEQ ID NO: 12889 - DNA, 15 bp, Homo sapiens
gacagcatggaggaa

SEQ ID NO: 12890 - DNA, 15 bp, Homo sapiens
tgacagcatggagga

SEQ ID NO: 12891 - DNA, 15 bp, Homo sapiens
ctgacagcatggagg

SEQ ID NO: 12892 - DNA, 15 bp, Homo sapiens
gctgacagcatggag

SEQ ID NO: 12893 - DNA, 15 bp, Homo sapiens
agctgacagcatgga

SEQ ID NO: 12894 - DNA, 15 bp, Homo sapiens
gagctgacagcatgg

SEQ ID NO: 12895 - DNA, 15 bp, Homo sapiens
agagctgacagcatg

SEQ ID NO: 12896 - DNA, 15 bp, Homo sapiens
aagagctgacagcat

SEQ ID NO: 12897 - DNA, 15 bp, Homo sapiens
gaagagctgacagca

SEQ ID NO: 12898 - DNA, 15 bp, Homo sapiens
ggaagagctgacagc

SEQ ID NO: 12899 - DNA, 15 bp, Homo sapiens
tggaagagctgacag

SEQ ID NO: 12900 - DNA, 15 bp, Homo sapiens
gtggaagagctgaca

SEQ ID NO: 12901 - DNA, 15 bp, Homo sapiens
ggtggaagagctgac

SEQ ID NO: 12902 - DNA, 15 bp, Homo sapiens
tggtggaagagctga

SEQ ID NO: 12903 - DNA, 15 bp, Homo sapiens
atggtggaagagctg

SEQ ID NO: 12904 - DNA, 15 bp, Homo sapiens
aatggtggaagagct

SEQ ID NO: 12905 - DNA, 15 bp, Homo sapiens
gaatggtggaagagc

SEQ ID NO: 12906 - DNA, 15 bp, Homo sapiens
agaatggtggaagag

SEQ ID NO: 12907 - DNA, 15 bp, Homo sapiens
aagaatggtggaaga

SEQ ID NO: 12908 - DNA, 15 bp, Homo sapiens
gaagaatggtggaag

SEQ ID NO: 12909 - DNA, 15 bp, Homo sapiens
ggaagaatggtggaa

SEQ ID NO: 12910 - DNA, 15 bp, Homo sapiens
aggaagaatggtgga

SEQ ID NO: 12911 - DNA, 15 bp, Homo sapiens
caggaagaatggtgg

SEQ ID NO: 12912 - DNA, 15 bp, Homo sapiens
ccaggaagaatggtg

SEQ ID NO: 12913 - DNA, 15 bp, Homo sapiens
gccaggaagaatggt

SEQ ID NO: 12914 - DNA, 15 bp, Homo sapiens
cgccaggaagaatgg

SEQ ID NO: 12915 - DNA, 15 bp, Homo sapiens
acgccaggaagaatg

SEQ ID NO: 12916 - DNA, 15 bp, Homo sapiens
gacgccaggaagaat

SEQ ID NO: 12917 - DNA, 15 bp, Homo sapiens
tgacgccaggaagaa

SEQ ID NO: 12918 - DNA, 15 bp, Homo sapiens
atgacgccaggaaga

SEQ ID NO: 12919 - DNA, 15 bp, Homo sapiens
aatgacgccaggaag

SEQ ID NO: 12920 - DNA, 15 bp, Homo sapiens
gaatgacgccaggaa

SEQ ID NO: 12921 - DNA, 15 bp, Homo sapiens
agaatgacgccagga

SEQ ID NO: 12922 - DNA, 15 bp, Homo sapiens
tagaatgacgccagg

SEQ ID NO: 12923 - DNA, 15 bp, Homo sapiens
ttagaatgacgccag

SEQ ID NO: 12924 - DNA, 15 bp, Homo sapiens
cttagaatgacgcca

SEQ ID NO: 12925 - DNA, 15 bp, Homo sapiens
ccttagaatgacgcc

SEQ ID NO: 12926 - DNA, 15 bp, Homo sapiens
accttagaatgacgc

SEQ ID NO: 12927 - DNA, 15 bp, Homo sapiens
gaccttagaatgacg

SEQ ID NO: 12928 - DNA, 15 bp, Homo sapiens
ggaccttagaatgac

SEQ ID NO: 12929 - DNA, 15 bp, Homo sapiens
aggaccttagaatga

SEQ ID NO: 12930 - DNA, 15 bp, Homo sapiens
caggaccttagaatg

SEQ ID NO: 12931 - DNA, 15 bp, Homo sapiens
acaggaccttagaat

SEQ ID NO: 12932 - DNA, 15 bp, Homo sapiens
gacaggaccttagaa

SEQ ID NO: 12933 - DNA, 15 bp, Homo sapiens
agacaggaccttaga

SEQ ID NO: 12934 - DNA, 15 bp, Homo sapiens
aagacaggaccttag

SEQ ID NO: 12935 - DNA, 15 bp, Homo sapiens
gaagacaggacctta

SEQ ID NO: 12936 - DNA, 15 bp, Homo sapiens
ggaagacaggacctt

SEQ ID NO: 12937 - DNA, 15 bp, Homo sapiens
gggaagacaggacct

SEQ ID NO: 12938 - DNA, 15 bp, Homo sapiens
ggggaagacaggacc

SEQ ID NO: 12939 - DNA, 15 bp, Homo sapiens
gggggaagacaggac

SEQ ID NO: 12940 - DNA, 15 bp, Homo sapiens
cgggggaagacagga

SEQ ID NO: 12941 - DNA, 15 bp, Homo sapiens
gcgggggaagacagg

SEQ ID NO: 12942 - DNA, 15 bp, Homo sapiens
ggcgggggaagacag

SEQ ID NO: 12943 - DNA, 15 bp, Homo sapiens
gggcgggggaagaca

SEQ ID NO: 12944 - DNA, 15 bp, Homo sapiens
agggcgggggaagac

SEQ ID NO: 12945 - DNA, 15 bp, Homo sapiens
gagggcgggggaaga

SEQ ID NO: 12946 - DNA, 15 bp, Homo sapiens
agagggcgggggaag

SEQ ID NO: 12947 - DNA, 15 bp, Homo sapiens
aagagggcgggggaa

SEQ ID NO: 12948 - DNA, 15 bp, Homo sapiens
gaagagggcggggga

SEQ ID NO: 12949 - DNA, 15 bp, Homo sapiens
ggaagagggcggggg

SEQ ID NO: 12950 - DNA, 15 bp, Homo sapiens
aggaagagggcgggg

SEQ ID NO: 12951 - DNA, 15 bp, Homo sapiens
aaggaagagggcggg

SEQ ID NO: 12952 - DNA, 15 bp, Homo sapiens
gaaggaagagggcgg

SEQ ID NO: 12953 - DNA, 15 bp, Homo sapiens
ggaaggaagagggcg

SEQ ID NO: 12954 - DNA, 15 bp, Homo sapiens
aggaaggaagagggc

SEQ ID NO: 12955 - DNA, 15 bp, Homo sapiens
caggaaggaagaggg

SEQ ID NO: 12956 - DNA, 15 bp, Homo sapiens
ccaggaaggaagagg

SEQ ID NO: 12957 - DNA, 15 bp, Homo sapiens
gccaggaaggaagag

SEQ ID NO: 12958 - DNA, 15 bp, Homo sapiens
agccaggaaggaaga

SEQ ID NO: 12959 - DNA, 15 bp, Homo sapiens
aagccaggaaggaag

SEQ ID NO: 12960 - DNA, 15 bp, Homo sapiens
gaagccaggaaggaa

SEQ ID NO: 12961 - DNA, 15 bp, Homo sapiens
agaagccaggaagga

SEQ ID NO: 12962 - DNA, 15 bp, Homo sapiens
tagaagccaggaagg

SEQ ID NO: 12963 - DNA, 15 bp, Homo sapiens
gtagaagccaggaag

SEQ ID NO: 12964 - DNA, 15 bp, Homo sapiens
cgtagaagccaggaa

SEQ ID NO: 12965 - DNA, 15 bp, Homo sapiens
gcgtagaagccagga

SEQ ID NO: 12966 - DNA, 15 bp, Homo sapiens
agcgtagaagccagg

SEQ ID NO: 12967 - DNA, 15 bp, Homo sapiens
gagcgtagaagccag

SEQ ID NO: 12968 - DNA, 15 bp, Homo sapiens
tgagcgtagaagcca

SEQ ID NO: 12969 - DNA, 15 bp, Homo sapiens
ctgagcgtagaagcc

SEQ ID NO: 12970 - DNA, 15 bp, Homo sapiens
gctgagcgtagaagc

SEQ ID NO: 12971 - DNA, 15 bp, Homo sapiens
agctgagcgtagaag

SEQ ID NO: 12972 - DNA, 15 bp, Homo sapiens
gagctgagcgtagaa

SEQ ID NO: 12973 - DNA, 15 bp, Homo sapiens
tgagctgagcgtaga

SEQ ID NO: 12974 - DNA, 15 bp, Homo sapiens
ttgagctgagcgtag

SEQ ID NO: 12975 - DNA, 15 bp, Homo sapiens
cttgagctgagcgta

SEQ ID NO: 12976 - DNA, 15 bp, Homo sapiens
acttgagctgagcgt

SEQ ID NO: 12977 - DNA, 15 bp, Homo sapiens
tacttgagctgagcg

SEQ ID NO: 12978 - DNA, 15 bp, Homo sapiens
ctacttgagctgagc

SEQ ID NO: 12979 - DNA, 15 bp, Homo sapiens
actacttgagctgag

SEQ ID NO: 12980 - DNA, 15 bp, Homo sapiens
tactacttgagctga

SEQ ID NO: 12981 - DNA, 15 bp, Homo sapiens
ctactacttgagctg

SEQ ID NO: 12982 - DNA, 15 bp, Homo sapiens
gctactacttgagct

SEQ ID NO: 12983 - DNA, 15 bp, Homo sapiens
agctactacttgagc

SEQ ID NO: 12984 - DNA, 15 bp, Homo sapiens
cagctactacttgag

SEQ ID NO: 12985 - DNA, 15 bp, Homo sapiens
acagctactacttga

SEQ ID NO: 12986 - DNA, 15 bp, Homo sapiens
aacagctactacttg

SEQ ID NO: 12987 - DNA, 15 bp, Homo sapiens
aaacagctactactt

SEQ ID NO: 12988 - DNA, 15 bp, Homo sapiens
caaacagctactact

SEQ ID NO: 12989 - DNA, 15 bp, Homo sapiens
ccaaacagctactac

SEQ ID NO: 12990 - DNA, 15 bp, Homo sapiens
cccaaacagctacta

SEQ ID NO: 12991 - DNA, 15 bp, Homo sapiens
acccaaacagctact

SEQ ID NO: 12992 - DNA, 15 bp, Homo sapiens
tacccaaacagctac

SEQ ID NO: 12993 - DNA, 15 bp, Homo sapiens
gtacccaaacagcta

SEQ ID NO: 12994 - DNA, 15 bp, Homo sapiens
agtacccaaacagct

SEQ ID NO: 12995 - DNA, 15 bp, Homo sapiens
aagtacccaaacagc

SEQ ID NO: 12996 - DNA, 15 bp, Homo sapiens
aaagtacccaaacag

SEQ ID NO: 12997 - DNA, 15 bp, Homo sapiens
aaaagtacccaaaca

SEQ ID NO: 12998 - DNA, 15 bp, Homo sapiens
gaaaagtacccaaac

SEQ ID NO: 12999 - DNA, 15 bp, Homo sapiens
tgaaaagtacccaaa

SEQ ID NO: 13000 - DNA, 15 bp, Homo sapiens
gtgaaaagtacccaa

SEQ ID NO: 13001 - DNA, 15 bp, Homo sapiens
ggtgaaaagtaccca

SEQ ID NO: 13002 - DNA, 15 bp, Homo sapiens
gggtgaaaagtaccc

SEQ ID NO: 13003 - DNA, 15 bp, Homo sapiens
tgggtgaaaagtacc

SEQ ID NO: 13004 - DNA, 15 bp, Homo sapiens
ctgggtgaaaagtac

SEQ ID NO: 13005 - DNA, 15 bp, Homo sapiens
tctgggtgaaaagta

SEQ ID NO: 13006 - DNA, 15 bp, Homo sapiens
gtctgggtgaaaagt

SEQ ID NO: 13007 - DNA, 15 bp, Homo sapiens
agtctgggtgaaaag

SEQ ID NO: 13008 - DNA, 15 bp, Homo sapiens
aagtctgggtgaaaa

SEQ ID NO: 13009 - DNA, 15 bp, Homo sapiens
taagtctgggtgaaa

SEQ ID NO: 13010 - DNA, 15 bp, Homo sapiens
ctaagtctgggtgaa

SEQ ID NO: 13011 - DNA, 15 bp, Homo sapiens
cctaagtctgggtga

SEQ ID NO: 13012 - DNA, 15 bp, Homo sapiens
tcctaagtctgggtg

SEQ ID NO: 13013 - DNA, 15 bp, Homo sapiens
ttcctaagtctgggt

SEQ ID NO: 13014 - DNA, 15 bp, Homo sapiens
tttcctaagtctggg

SEQ ID NO: 13015 - DNA, 15 bp, Homo sapiens
atttcctaagtctgg

SEQ ID NO: 13016 - DNA, 15 bp, Homo sapiens
catttcctaagtctg

SEQ ID NO: 13017 - DNA, 15 bp, Homo sapiens
acatttcctaagtct

SEQ ID NO: 13018 - DNA, 15 bp, Homo sapiens
aacatttcctaagtc

SEQ ID NO: 13019 - DNA, 15 bp, Homo sapiens
taacatttcctaagt

SEQ ID NO: 13020 - DNA, 15 bp, Homo sapiens
ataacatttcctaag

SEQ ID NO: 13021 - DNA, 15 bp, Homo sapiens
gataacatttcctaa

SEQ ID NO: 13022 - DNA, 15 bp, Homo sapiens
tgataacatttccta

SEQ ID NO: 13023 - DNA, 15 bp, Homo sapiens
ctgataacatttcct

SEQ ID NO: 13024 - DNA, 15 bp, Homo sapiens
actgataacatttcc

SEQ ID NO: 13025 - DNA, 15 bp, Homo sapiens
aactgataacatttc

SEQ ID NO: 13026 - DNA, 15 bp, Homo sapiens
caactgataacattt

SEQ ID NO: 13027 - DNA, 15 bp, Homo sapiens
ccaactgataacatt

SEQ ID NO: 13028 - DNA, 15 bp, Homo sapiens
accaactgataacat

SEQ ID NO: 13029 - DNA, 15 bp, Homo sapiens
gaccaactgataaca

SEQ ID NO: 13030 - DNA, 15 bp, Homo sapiens
cgaccaactgataac

SEQ ID NO: 13031 - DNA, 15 bp, Homo sapiens
acgaccaactgataa

SEQ ID NO: 13032 - DNA, 15 bp, Homo sapiens
tacgaccaactgata

SEQ ID NO: 13033 - DNA, 15 bp, Homo sapiens
atacgaccaactgat

SEQ ID NO: 13034 - DNA, 15 bp, Homo sapiens
aatacgaccaactga

SEQ ID NO: 13035 - DNA, 15 bp, Homo sapiens
gaatacgaccaactg

SEQ ID NO: 13036 - DNA, 15 bp, Homo sapiens
ggaatacgaccaact

SEQ ID NO: 13037 - DNA, 15 bp, Homo sapiens
aggaatacgaccaac

SEQ ID NO: 13038 - DNA, 15 bp, Homo sapiens
caggaatacgaccaa

SEQ ID NO: 13039 - DNA, 15 bp, Homo sapiens
acaggaatacgacca

SEQ ID NO: 13040 - DNA, 15 bp, Homo sapiens
gacaggaatacgacc

SEQ ID NO: 13041 - DNA, 15 bp, Homo sapiens
tgacaggaatacgac

SEQ ID NO: 13042 - DNA, 15 bp, Homo sapiens
ctgacaggaatacga

SEQ ID NO: 13043 - DNA, 15 bp, Homo sapiens
gctgacaggaatacg

SEQ ID NO: 13044 - DNA, 15 bp, Homo sapiens
ggctgacaggaatac

SEQ ID NO: 13045 - DNA, 15 bp, Homo sapiens
gggctgacaggaata

SEQ ID NO: 13046 - DNA, 15 bp, Homo sapiens
agggctgacaggaat

SEQ ID NO: 13047 - DNA, 15 bp, Homo sapiens
gagggctgacaggaa

SEQ ID NO: 13048 - DNA, 15 bp, Homo sapiens
agagggctgacagga

SEQ ID NO: 13049 - DNA, 15 bp, Homo sapiens
aagagggctgacagg

SEQ ID NO: 13050 - DNA, 15 bp, Homo sapiens
taagagggctgacag

SEQ ID NO: 13051 - DNA, 15 bp, Homo sapiens
gtaagagggctgaca

SEQ ID NO: 13052 - DNA, 15 bp, Homo sapiens
agtaagagggctgac

SEQ ID NO: 13053 - DNA, 15 bp, Homo sapiens
tagtaagagggctga

SEQ ID NO: 13054 - DNA, 15 bp, Homo sapiens
atagtaagagggctg

SEQ ID NO: 13055 - DNA, 15 bp, Homo sapiens
catagtaagagggct

SEQ ID NO: 13056 - DNA, 15 bp, Homo sapiens
ccatagtaagagggc

SEQ ID NO: 13057 - DNA, 15 bp, Homo sapiens
tccatagtaagaggg

SEQ ID NO: 13058 - DNA, 15 bp, Homo sapiens
ttccatagtaagagg

SEQ ID NO: 13059 - DNA, 15 bp, Homo sapiens
gttccatagtaagag

SEQ ID NO: 13060 - DNA, 15 bp, Homo sapiens
agttccatagtaaga

SEQ ID NO: 13061 - DNA, 15 bp, Homo sapiens
gagttccatagtaag

SEQ ID NO: 13062 - DNA, 15 bp, Homo sapiens
tgagttccatagtaa

SEQ ID NO: 13063 - DNA, 15 bp, Homo sapiens
ttgagttccatagta

SEQ ID NO: 13064 - DNA, 15 bp, Homo sapiens
tttgagttccatagt

SEQ ID NO: 13065 - DNA, 15 bp, Homo sapiens
atttgagttccatag

SEQ ID NO: 13066 - DNA, 15 bp, Homo sapiens
tatttgagttccata

SEQ ID NO: 13067 - DNA, 15 bp, Homo sapiens
ctatttgagttccat

SEQ ID NO: 13068 - DNA, 15 bp, Homo sapiens
cctatttgagttcca

SEQ ID NO: 13069 - DNA, 15 bp, Homo sapiens
tcctatttgagttcc

SEQ ID NO: 13070 - DNA, 15 bp, Homo sapiens
gtcctatttgagttc

SEQ ID NO: 13071 - DNA, 15 bp, Homo sapiens
tgtcctatttgagtt

SEQ ID NO: 13072 - DNA, 15 bp, Homo sapiens
ctgtcctatttgagt

SEQ ID NO: 13073 - DNA, 15 bp, Homo sapiens
tctgtcctatttgag

SEQ ID NO: 13074 - DNA, 15 bp, Homo sapiens
atctgtcctatttga

SEQ ID NO: 13075 - DNA, 15 bp, Homo sapiens
aatctgtcctatttg

SEQ ID NO: 13076 - DNA, 15 bp, Homo sapiens
gaatctgtcctattt

SEQ ID NO: 13077 - DNA, 15 bp, Homo sapiens
tgaatctgtcctatt

SEQ ID NO: 13078 - DNA, 15 bp, Homo sapiens
ctgaatctgtcctat

SEQ ID NO: 13079 - DNA, 15 bp, Homo sapiens
gctgaatctgtccta

SEQ ID NO: 13080 - DNA, 15 bp, Homo sapiens
agctgaatctgtcct

SEQ ID NO: 13081 - DNA, 15 bp, Homo sapiens
cagctgaatctgtcc

SEQ ID NO: 13082 - DNA, 15 bp, Homo sapiens
tcagctgaatctgtc

SEQ ID NO: 13083 - DNA, 15 bp, Homo sapiens
ttcagctgaatctgt

SEQ ID NO: 13084 - DNA, 15 bp, Homo sapiens
attcagctgaatctg

SEQ ID NO: 13085 - DNA, 15 bp, Homo sapiens
aattcagctgaatct

SEQ ID NO: 13086 - DNA, 15 bp, Homo sapiens
gaattcagctgaatc

SEQ ID NO: 13087 - DNA, 15 bp, Homo sapiens
ggaattcagctgaat

SEQ ID NO: 13088 - DNA, 15 bp, Homo sapiens
gggaattcagctgaa

SEQ ID NO: 13089 - DNA, 15 bp, Homo sapiens
tgggaattcagctga

SEQ ID NO: 13090 - DNA, 15 bp, Homo sapiens
ctgggaattcagctg

SEQ ID NO: 13091 - DNA, 15 bp, Homo sapiens
gctgggaattcagct

SEQ ID NO: 13092 - DNA, 15 bp, Homo sapiens
ggctgggaattcagc

SEQ ID NO: 13093 - DNA, 15 bp, Homo sapiens
gggctgggaattcag

SEQ ID NO: 13094 - DNA, 15 bp, Homo sapiens
agggctgggaattca

SEQ ID NO: 13095 - DNA, 15 bp, Homo sapiens
cagggctgggaattc

SEQ ID NO: 13096 - DNA, 15 bp, Homo sapiens
acagggctgggaatt

SEQ ID NO: 13097 - DNA, 15 bp, Homo sapiens
cacagggctgggaat

SEQ ID NO: 13098 - DNA, 15 bp, Homo sapiens
ccacagggctgggaa

SEQ ID NO: 13099 - DNA, 15 bp, Homo sapiens
accacagggctggga

SEQ ID NO: 13100 - DNA, 15 bp, Homo sapiens
aaccacagggctggg

SEQ ID NO: 13101 - DNA, 15 bp, Homo sapiens
caaccacagggctgg

SEQ ID NO: 13102 - DNA, 15 bp, Homo sapiens
gcaaccacagggctg

SEQ ID NO: 13103 - DNA, 15 bp, Homo sapiens
tgcaaccacagggct

SEQ ID NO: 13104 - DNA, 15 bp, Homo sapiens
gtgcaaccacagggc

SEQ ID NO: 13105 - DNA, 15 bp, Homo sapiens
agtgcaaccacaggg

SEQ ID NO: 13106 - DNA, 15 bp, Homo sapiens
gagtgcaaccacagg

SEQ ID NO: 13107 - DNA, 15 bp, Homo sapiens
agagtgcaaccacag

SEQ ID NO: 13108 - DNA, 15 bp, Homo sapiens
aagagtgcaaccaca

SEQ ID NO: 13109 - DNA, 15 bp, Homo sapiens
aaagagtgcaaccac

SEQ ID NO: 13110 - DNA, 15 bp, Homo sapiens
caaagagtgcaacca

SEQ ID NO: 13111 - DNA, 15 bp, Homo sapiens
acaaagagtgcaacc

SEQ ID NO: 13112 - DNA, 15 bp, Homo sapiens
gacaaagagtgcaac

SEQ ID NO: 13113 - DNA, 15 bp, Homo sapiens
agacaaagagtgcaa

SEQ ID NO: 13114 - DNA, 15 bp, Homo sapiens
cagacaaagagtgca

SEQ ID NO: 13115 - DNA, 15 bp, Homo sapiens
gcagacaaagagtgc

SEQ ID NO: 13116 - DNA, 15 bp, Homo sapiens
ggcagacaaagagtg

SEQ ID NO: 13117 - DNA, 15 bp, Homo sapiens
gggcagacaaagagt

SEQ ID NO: 13118 - DNA, 15 bp, Homo sapiens
agggcagacaaagag

SEQ ID NO: 13119 - DNA, 15 bp, Homo sapiens
cagggcagacaaaga

SEQ ID NO: 13120 - DNA, 15 bp, Homo sapiens
gcagggcagacaaag

SEQ ID NO: 13121 - DNA, 15 bp, Homo sapiens
agcagggcagacaaa

SEQ ID NO: 13122 - DNA, 15 bp, Homo sapiens
aagcagggcagacaa

SEQ ID NO: 13123 - DNA, 15 bp, Homo sapiens
gaagcagggcagaca

SEQ ID NO: 13124 - DNA, 15 bp, Homo sapiens
ggaagcagggcagac

SEQ ID NO: 13125 - DNA, 15 bp, Homo sapiens
gggaagcagggcaga

SEQ ID NO: 13126 - DNA, 15 bp, Homo sapiens
ggggaagcagggcag

SEQ ID NO: 13127 - DNA, 15 bp, Homo sapiens
tggggaagcagggca

SEQ ID NO: 13128 - DNA, 15 bp, Homo sapiens
ttggggaagcagggc

SEQ ID NO: 13129 - DNA, 15 bp, Homo sapiens
cttggggaagcaggg

SEQ ID NO: 13130 - DNA, 15 bp, Homo sapiens
ccttggggaagcagg

SEQ ID NO: 13131 - DNA, 15 bp, Homo sapiens
accttggggaagcag

SEQ ID NO: 13132 - DNA, 15 bp, Homo sapiens
taccttggggaagca

SEQ ID NO: 13133 - DNA, 15 bp, Homo sapiens
ctaccttggggaagc

SEQ ID NO: 13134 - DNA, 15 bp, Homo sapiens
gctaccttggggaag

SEQ ID NO: 13135 - DNA, 15 bp, Homo sapiens
ggctaccttggggaa

SEQ ID NO: 13136 - DNA, 15 bp, Homo sapiens
aggctaccttgggga

SEQ ID NO: 13137 - DNA, 15 bp, Homo sapiens
caggctaccttgggg

SEQ ID NO: 13138 - DNA, 15 bp, Homo sapiens
gcaggctaccttggg

SEQ ID NO: 13139 - DNA, 15 bp, Homo sapiens
agcaggctaccttgg

SEQ ID NO: 13140 - DNA, 15 bp, Homo sapiens
gagcaggctaccttg

SEQ ID NO: 13141 - DNA, 15 bp, Homo sapiens
ggagcaggctacctt

SEQ ID NO: 13142 - DNA, 15 bp, Homo sapiens
gggagcaggctacct

SEQ ID NO: 13143 - DNA, 15 bp, Homo sapiens
agggagcaggctacc

SEQ ID NO: 13144 - DNA, 15 bp, Homo sapiens
tagggagcaggctac

SEQ ID NO: 13145 - DNA, 15 bp, Homo sapiens
ttagggagcaggcta

SEQ ID NO: 13146 - DNA, 15 bp, Homo sapiens
tttagggagcaggct

SEQ ID NO: 13147 - DNA, 15 bp, Homo sapiens
ctttagggagcaggc

SEQ ID NO: 13148 - DNA, 15 bp, Homo sapiens
cctttagggagcagg

SEQ ID NO: 13149 - DNA, 15 bp, Homo sapiens
acctttagggagcag

SEQ ID NO: 13150 - DNA, 15 bp, Homo sapiens
gacctttagggagca

SEQ ID NO: 13151 - DNA, 15 bp, Homo sapiens
tgacctttagggagc

SEQ ID NO: 13152 - DNA, 15 bp, Homo sapiens
gtgacctttagggag

SEQ ID NO: 13153 - DNA, 15 bp, Homo sapiens
ggtgacctttaggga

SEQ ID NO: 13154 - DNA, 15 bp, Homo sapiens
cggtgacctttaggg

SEQ ID NO: 13155 - DNA, 15 bp, Homo sapiens
tcggtgacctttagg

SEQ ID NO: 13156 - DNA, 15 bp, Homo sapiens
ctcggtgacctttag

SEQ ID NO: 13157 - DNA, 15 bp, Homo sapiens
tctcggtgaccttta

SEQ ID NO: 13158 - DNA, 15 bp, Homo sapiens
atctcggtgaccttt

SEQ ID NO: 13159 - DNA, 15 bp, Homo sapiens
tatctcggtgacctt

SEQ ID NO: 13160 - DNA, 15 bp, Homo sapiens
gtatctcggtgacct

SEQ ID NO: 13161 - DNA, 15 bp, Homo sapiens
agtatctcggtgacc

SEQ ID NO: 13162 - DNA, 15 bp, Homo sapiens
gagtatctcggtgac

SEQ ID NO: 13163 - DNA, 15 bp, Homo sapiens
ggagtatctcggtga

SEQ ID NO: 13164 - DNA, 15 bp, Homo sapiens
gggagtatctcggtg

SEQ ID NO: 13165 - DNA, 15 bp, Homo sapiens
ggggagtatctcggt

SEQ ID NO: 13166 - DNA, 15 bp, Homo sapiens
tggggagtatctcgg

SEQ ID NO: 13167 - DNA, 15 bp, Homo sapiens
atggggagtatctcg

SEQ ID NO: 13168 - DNA, 15 bp, Homo sapiens
catggggagtatctc

SEQ ID NO: 13169 - DNA, 15 bp, Homo sapiens
gcatggggagtatct

SEQ ID NO: 13170 - DNA, 15 bp, Homo sapiens
tgcatggggagtatc

SEQ ID NO: 13171 - DNA, 15 bp, Homo sapiens
ttgcatggggagtat

SEQ ID NO: 13172 - DNA, 15 bp, Homo sapiens
cttgcatggggagta

SEQ ID NO: 13173 - DNA, 15 bp, Homo sapiens
ccttgcatggggagt

SEQ ID NO: 13174 - DNA, 15 bp, Homo sapiens
accttgcatggggag

SEQ ID NO: 13175 - DNA, 15 bp, Homo sapiens
aaccttgcatgggga

SEQ ID NO: 13176 - DNA, 15 bp, Homo sapiens
aaaccttgcatgggg

SEQ ID NO: 13177 - DNA, 15 bp, Homo sapiens
aaaaccttgcatggg

SEQ ID NO: 13178 - DNA, 15 bp, Homo sapiens
aaaaaccttgcatgg

SEQ ID NO: 13179 - DNA, 15 bp, Homo sapiens
caaaaaccttgcatg

SEQ ID NO: 13180 - DNA, 15 bp, Homo sapiens
acaaaaaccttgcat

SEQ ID NO: 13181 - DNA, 15 bp, Homo sapiens
aacaaaaaccttgca

SEQ ID NO: 13182 - DNA, 15 bp, Homo sapiens
caacaaaaaccttgc

SEQ ID NO: 13183 - DNA, 15 bp, Homo sapiens
acaacaaaaaccttg

SEQ ID NO: 13184 - DNA, 15 bp, Homo sapiens
tacaacaaaaacctt

SEQ ID NO: 13185 - DNA, 15 bp, Homo sapiens
atacaacaaaaacct

SEQ ID NO: 13186 - DNA, 15 bp, Homo sapiens
aatacaacaaaaacc

SEQ ID NO: 13187 - DNA, 15 bp, Homo sapiens
taatacaacaaaaac

SEQ ID NO: 13188 - DNA, 15 bp, Homo sapiens
gtaatacaacaaaaa

SEQ ID NO: 13189 - DNA, 15 bp, Homo sapiens
tgtaatacaacaaaa

SEQ ID NO: 13190 - DNA, 15 bp, Homo sapiens
gtgtaatacaacaaa

SEQ ID NO: 13191 - DNA, 15 bp, Homo sapiens
tgtgtaatacaacaa

SEQ ID NO: 13192 - DNA, 15 bp, Homo sapiens
atgtgtaatacaaca

SEQ ID NO: 13193 - DNA, 15 bp, Homo sapiens
catgtgtaatacaac

SEQ ID NO: 13194 - DNA, 15 bp, Homo sapiens
tcatgtgtaatacaa

SEQ ID NO: 13195 - DNA, 15 bp, Homo sapiens
gtcatgtgtaataca

SEQ ID NO: 13196 - DNA, 15 bp, Homo sapiens
tgtcatgtgtaatac

SEQ ID NO: 13197 - DNA, 15 bp, Homo sapiens
ttgtcatgtgtaata

SEQ ID NO: 13198 - DNA, 15 bp, Homo sapiens
gttgtcatgtgtaat

SEQ ID NO: 13199 - DNA, 15 bp, Homo sapiens
tgttgtcatgtgtaa

SEQ ID NO: 13200 - DNA, 15 bp, Homo sapiens
atgttgtcatgtgta

SEQ ID NO: 13201 - DNA, 15 bp, Homo sapiens
catgttgtcatgtgt

SEQ ID NO: 13202 - DNA, 15 bp, Homo sapiens
ccatgttgtcatgtg

SEQ ID NO: 13203 - DNA, 15 bp, Homo sapiens
tccatgttgtcatgt

SEQ ID NO: 13204 - DNA, 15 bp, Homo sapiens
ttccatgttgtcatg

SEQ ID NO: 13205 - DNA, 15 bp, Homo sapiens
attccatgttgtcat

SEQ ID NO: 13206 - DNA, 15 bp, Homo sapiens
tattccatgttgtca

SEQ ID NO: 13207 - DNA, 15 bp, Homo sapiens
ttattccatgttgtc

SEQ ID NO: 13208 - DNA, 15 bp, Homo sapiens
tttattccatgttgt

SEQ ID NO: 13209 - DNA, 15 bp, Homo sapiens
ctttattccatgttg

SEQ ID NO: 13210 - DNA, 15 bp, Homo sapiens
actttattccatgtt

SEQ ID NO: 13211 - DNA, 15 bp, Homo sapiens
cactttattccatgt

SEQ ID NO: 13212 - DNA, 15 bp, Homo sapiens
acactttattccatg

SEQ ID NO: 13213 - DNA, 15 bp, Homo sapiens
aacactttattccat

SEQ ID NO: 13214 - DNA, 15 bp, Homo sapiens
aaacactttattcca

SEQ ID NO: 13215 - DNA, 15 bp, Homo sapiens
aaaacactttattcc

SEQ ID NO: 13216 - DNA, 15 bp, Homo sapiens
caaaacactttattc

SEQ ID NO: 13217 - DNA, 15 bp, Homo sapiens
gcaaaacactttatt

SEQ ID NO: 13218 - DNA, 15 bp, Homo sapiens
tgcaaaacactttat

SEQ ID NO: 13219 - DNA, 15 bp, Homo sapiens
ttgcaaaacacttta

SEQ ID NO: 13220 - DNA, 15 bp, Homo sapiens
tttgcaaaacacttt

SEQ ID NO: 13221 - DNA, 15 bp, Homo sapiens
atttgcaaaacactt

SEQ ID NO: 13222 - DNA, 15 bp, Homo sapiens
aatttgcaaaacact

SEQ ID NO: 13223 - DNA, 15 bp, Homo sapiens
aaatttgcaaaacac

SEQ ID NO: 13224 - DNA, 15 bp, Homo sapiens
taaatttgcaaaaca

SEQ ID NO: 13225 - DNA, 15 bp, Homo sapiens
gtaaatttgcaaaac

SEQ ID NO: 13226 - DNA, 15 bp, Homo sapiens
agtaaatttgcaaaa

SEQ ID NO: 13227 - DNA, 15 bp, Homo sapiens
cagtaaatttgcaaa

SEQ ID NO: 13228 - DNA, 15 bp, Homo sapiens
ccagtaaatttgcaa

SEQ ID NO: 13229 - DNA, 15 bp, Homo sapiens
tccagtaaatttgca

SEQ ID NO: 13230 - DNA, 15 bp, Homo sapiens
atccagtaaatttgc

SEQ ID NO: 13231 - DNA, 15 bp, Homo sapiens
catccagtaaatttg

SEQ ID NO: 13232 - DNA, 15 bp, Homo sapiens
tcatccagtaaattt

SEQ ID NO: 13233 - DNA, 15 bp, Homo sapiens
atcatccagtaaatt

SEQ ID NO: 13234 - DNA, 15 bp, Homo sapiens
tatcatccagtaaat

SEQ ID NO: 13235 - DNA, 15 bp, Homo sapiens
atatcatccagtaaa

SEQ ID NO: 13236 - DNA, 15 bp, Homo sapiens
gatatcatccagtaa

SEQ ID NO: 13237 - DNA, 15 bp, Homo sapiens
ggatatcatccagta

SEQ ID NO: 13238 - DNA, 15 bp, Homo sapiens
aggatatcatccagt

SEQ ID NO: 13239 - DNA, 15 bp, Homo sapiens
taggatatcatccag

SEQ ID NO: 13240 - DNA, 15 bp, Homo sapiens
gtaggatatcatcca

SEQ ID NO: 13241 - DNA, 15 bp, Homo sapiens
agtaggatatcatcc

SEQ ID NO: 13242 - DNA, 15 bp, Homo sapiens
tagtaggatatcatc

SEQ ID NO: 13243 - DNA, 15 bp, Homo sapiens
atagtaggatatcat

SEQ ID NO: 13244 - DNA, 15 bp, Homo sapiens
catagtaggatatca

SEQ ID NO: 13245 - DNA, 15 bp, Homo sapiens
acatagtaggatatc

SEQ ID NO: 13246 - DNA, 15 bp, Homo sapiens
cacatagtaggatat

SEQ ID NO: 13247 - DNA, 15 bp, Homo sapiens
ccacatagtaggata

SEQ ID NO: 13248 - DNA, 15 bp, Homo sapiens
tccacatagtaggat

SEQ ID NO: 13249 - DNA, 15 bp, Homo sapiens
ttccacatagtagga

SEQ ID NO: 13250 - DNA, 15 bp, Homo sapiens
gttccacatagtagg

SEQ ID NO: 13251 - DNA, 15 bp, Homo sapiens
tgttccacatagtag

SEQ ID NO: 13252 - DNA, 15 bp, Homo sapiens
atgttccacatagta

SEQ ID NO: 13253 - DNA, 15 bp, Homo sapiens
gatgttccacatagt

SEQ ID NO: 13254 - DNA, 15 bp, Homo sapiens
ggatgttccacatag

SEQ ID NO: 13255 - DNA, 15 bp, Homo sapiens
aggatgttccacata

SEQ ID NO: 13256 - DNA, 15 bp, Homo sapiens
taggatgttccacat

SEQ ID NO: 13257 - DNA, 15 bp, Homo sapiens
gtaggatgttccaca

SEQ ID NO: 13258 - DNA, 15 bp, Homo sapiens
tgtaggatgttccac

SEQ ID NO: 13259 - DNA, 15 bp, Homo sapiens
ttgtaggatgttcca

SEQ ID NO: 13260 - DNA, 15 bp, Homo sapiens
gttgtaggatgttcc

SEQ ID NO: 13261 - DNA, 15 bp, Homo sapiens
agttgtaggatgttc

SEQ ID NO: 13262 - DNA, 15 bp, Homo sapiens
aagttgtaggatgtt

SEQ ID NO: 13263 - DNA, 15 bp, Homo sapiens
taagttgtaggatgt

SEQ ID NO: 13264 - DNA, 15 bp, Homo sapiens
gtaagttgtaggatg

SEQ ID NO: 13265 - DNA, 15 bp, Homo sapiens
agtaagttgtaggat

SEQ ID NO: 13266 - DNA, 15 bp, Homo sapiens
gagtaagttgtagga

SEQ ID NO: 13267 - DNA, 15 bp, Homo sapiens
agagtaagttgtagg

SEQ ID NO: 13268 - DNA, 15 bp, Homo sapiens
aagagtaagttgtag

SEQ ID NO: 13269 - DNA, 15 bp, Homo sapiens
aaagagtaagttgta

SEQ ID NO: 13270 - DNA, 15 bp, Homo sapiens
aaaagagtaagttgt

SEQ ID NO: 13271 - DNA, 15 bp, Homo sapiens
gaaaagagtaagttg

SEQ ID NO: 13272 - DNA, 15 bp, Homo sapiens
tgaaaagagtaagtt

SEQ ID NO: 13273 - DNA, 15 bp, Homo sapiens
gtgaaaagagtaagt

SEQ ID NO: 13274 - DNA, 15 bp, Homo sapiens
agtgaaaagagtaag

SEQ ID NO: 13275 - DNA, 15 bp, Homo sapiens
gagtgaaaagagtaa

SEQ ID NO: 13276 - DNA, 15 bp, Homo sapiens
tgagtgaaaagagta

SEQ ID NO: 13277 - DNA, 15 bp, Homo sapiens
ttgagtgaaaagagt

SEQ ID NO: 13278 - DNA, 15 bp, Homo sapiens
gttgagtgaaaagag

SEQ ID NO: 13279 - DNA, 15 bp, Homo sapiens
tgttgagtgaaaaga

SEQ ID NO: 13280 - DNA, 15 bp, Homo sapiens
atgttgagtgaaaag

SEQ ID NO: 13281 - DNA, 15 bp, Homo sapiens
aatgttgagtgaaaa

SEQ ID NO: 13282 - DNA, 15 bp, Homo sapiens
aaatgttgagtgaaa

SEQ ID NO: 13283 - DNA, 15 bp, Homo sapiens
caaatgttgagtgaa

SEQ ID NO: 13284 - DNA, 15 bp, Homo sapiens
tcaaatgttgagtga

SEQ ID NO: 13285 - DNA, 15 bp, Homo sapiens
gtcaaatgttgagtg

SEQ ID NO: 13286 - DNA, 15 bp, Homo sapiens
agtcaaatgttgagt

SEQ ID NO: 13287 - DNA, 15 bp, Homo sapiens
aagtcaaatgttgag

SEQ ID NO: 13288 - DNA, 15 bp, Homo sapiens
aaagtcaaatgttga

SEQ ID NO: 13289 - DNA, 15 bp, Homo sapiens
aaaagtcaaatgttg

SEQ ID NO: 13290 - DNA, 15 bp, Homo sapiens
caaaagtcaaatgtt

SEQ ID NO: 13291 - DNA, 15 bp, Homo sapiens
tcaaaagtcaaatgt

SEQ ID NO: 13292 - DNA, 15 bp, Homo sapiens
ttcaaaagtcaaatg

SEQ ID NO: 13293 - DNA, 15 bp, Homo sapiens
gttcaaaagtcaaat

SEQ ID NO: 13294 - DNA, 15 bp, Homo sapiens
ggttcaaaagtcaaa

SEQ ID NO: 13295 - DNA, 15 bp, Homo sapiens
aggttcaaaagtcaa

SEQ ID NO: 13296 - DNA, 15 bp, Homo sapiens
caggttcaaaagtca

SEQ ID NO: 13297 - DNA, 15 bp, Homo sapiens
ccaggttcaaaagtc

SEQ ID NO: 13298 - DNA, 15 bp, Homo sapiens
accaggttcaaaagt

SEQ ID NO: 13299 - DNA, 15 bp, Homo sapiens
gaccaggttcaaaag

SEQ ID NO: 13300 - DNA, 15 bp, Homo sapiens
agaccaggttcaaaa

SEQ ID NO: 13301 - DNA, 15 bp, Homo sapiens
cagaccaggttcaaa

SEQ ID NO: 13302 - DNA, 15 bp, Homo sapiens
acagaccaggttcaa

SEQ ID NO: 13303 - DNA, 15 bp, Homo sapiens
tacagaccaggttca

SEQ ID NO: 13304 - DNA, 15 bp, Homo sapiens
atacagaccaggttc

SEQ ID NO: 13305 - DNA, 15 bp, Homo sapiens
aatacagaccaggtt

SEQ ID NO: 13306 - DNA, 15 bp, Homo sapiens
caatacagaccaggt

SEQ ID NO: 13307 - DNA, 15 bp, Homo sapiens
gcaatacagaccagg

SEQ ID NO: 13308 - DNA, 15 bp, Homo sapiens
agcaatacagaccag

SEQ ID NO: 13309 - DNA, 15 bp, Homo sapiens
gagcaatacagacca

SEQ ID NO: 13310 - DNA, 15 bp, Homo sapiens
ggagcaatacagacc

SEQ ID NO: 13311 - DNA, 15 bp, Homo sapiens
cggagcaatacagac

SEQ ID NO: 13312 - DNA, 15 bp, Homo sapiens
acggagcaatacaga

SEQ ID NO: 13313 - DNA, 15 bp, Homo sapiens
cacggagcaatacag

SEQ ID NO: 13314 - DNA, 15 bp, Homo sapiens
gcacggagcaataca

SEQ ID NO: 13315 - DNA, 15 bp, Homo sapiens
tgcacggagcaatac

SEQ ID NO: 13316 - DNA, 15 bp, Homo sapiens
ctgcacggagcaata

SEQ ID NO: 13317 - DNA, 15 bp, Homo sapiens
tctgcacggagcaat

SEQ ID NO: 13318 - DNA, 15 bp, Homo sapiens
gtctgcacggagcaa

SEQ ID NO: 13319 - DNA, 15 bp, Homo sapiens
ggtctgcacggagca

SEQ ID NO: 13320 - DNA, 15 bp, Homo sapiens
tggtctgcacggagc

SEQ ID NO: 13321 - DNA, 15 bp, Homo sapiens
ttggtctgcacggag

SEQ ID NO: 13322 - DNA, 15 bp, Homo sapiens
attggtctgcacgga

SEQ ID NO: 13323 - DNA, 15 bp, Homo sapiens
cattggtctgcacgg

SEQ ID NO: 13324 - DNA, 15 bp, Homo sapiens
acattggtctgcacg

SEQ ID NO: 13325 - DNA, 15 bp, Homo sapiens
aacattggtctgcac

SEQ ID NO: 13326 - DNA, 15 bp, Homo sapiens
gaacattggtctgca

SEQ ID NO: 13327 - DNA, 15 bp, Homo sapiens
tgaacattggtctgc

SEQ ID NO: 13328 - DNA, 15 bp, Homo sapiens
atgaacattggtctg

SEQ ID NO: 13329 - DNA, 15 bp, Homo sapiens
aatgaacattggtct

SEQ ID NO: 13330 - DNA, 15 bp, Homo sapiens
gaatgaacattggtc

SEQ ID NO: 13331 - DNA, 15 bp, Homo sapiens
tgaatgaacattggt

SEQ ID NO: 13332 - DNA, 15 bp, Homo sapiens
atgaatgaacattgg

SEQ ID NO: 13333 - DNA, 15 bp, Homo sapiens
aatgaatgaacattg

SEQ ID NO: 13334 - DNA, 15 bp, Homo sapiens
aaatgaatgaacatt

SEQ ID NO: 13335 - DNA, 15 bp, Homo sapiens
caaatgaatgaacat

SEQ ID NO: 13336 - DNA, 15 bp, Homo sapiens
tcaaatgaatgaaca

SEQ ID NO: 13337 - DNA, 15 bp, Homo sapiens
atcaaatgaatgaac

SEQ ID NO: 13338 - DNA, 15 bp, Homo sapiens
tatcaaatgaatgaa

SEQ ID NO: 13339 - DNA, 15 bp, Homo sapiens
atatcaaatgaatga

SEQ ID NO: 13340 - DNA, 15 bp, Homo sapiens
catatcaaatgaatg

SEQ ID NO: 13341 - DNA, 15 bp, Homo sapiens
acatatcaaatgaat

SEQ ID NO: 13342 - DNA, 15 bp, Homo sapiens
gacatatcaaatgaa

SEQ ID NO: 13343 - DNA, 15 bp, Homo sapiens
agacatatcaaatga

SEQ ID NO: 13344 - DNA, 15 bp, Homo sapiens
gagacatatcaaatg

SEQ ID NO: 13345 - DNA, 15 bp, Homo sapiens
ggagacatatcaaat

SEQ ID NO: 13346 - DNA, 15 bp, Homo sapiens
aggagacatatcaaa

SEQ ID NO: 13347 - DNA, 15 bp, Homo sapiens
aaggagacatatcaa

SEQ ID NO: 13348 - DNA, 15 bp, Homo sapiens
caaggagacatatca

SEQ ID NO: 13349 - DNA, 15 bp, Homo sapiens
acaaggagacatatc

SEQ ID NO: 13350 - DNA, 15 bp, Homo sapiens
cacaaggagacatat

SEQ ID NO: 13351 - DNA, 15 bp, Homo sapiens
gcacaaggagacata

SEQ ID NO: 13352 - DNA, 15 bp, Homo sapiens
ggcacaaggagacat

SEQ ID NO: 13353 - DNA, 15 bp, Homo sapiens
tggcacaaggagaca

SEQ ID NO: 13354 - DNA, 15 bp, Homo sapiens
atggcacaaggagac

SEQ ID NO: 13355 - DNA, 15 bp, Homo sapiens
tatggcacaaggaga

SEQ ID NO: 13356 - DNA, 15 bp, Homo sapiens
ctatggcacaaggag

SEQ ID NO: 13357 - DNA, 15 bp, Homo sapiens
tctatggcacaagga

SEQ ID NO: 13358 - DNA, 15 bp, Homo sapiens
ttctatggcacaagg

SEQ ID NO: 13359 - DNA, 15 bp, Homo sapiens
tttctatggcacaag

SEQ ID NO: 13360 - DNA, 15 bp, Homo sapiens
atttctatggcacaa

SEQ ID NO: 13361 - DNA, 15 bp, Homo sapiens
tatttctatggcaca

SEQ ID NO: 13362 - DNA, 15 bp, Homo sapiens
ctatttctatggcac

SEQ ID NO: 13363 - DNA, 15 bp, Homo sapiens
actatttctatggca

SEQ ID NO: 13364 - DNA, 15 bp, Homo sapiens
aactatttctatggc

SEQ ID NO: 13365 - DNA, 15 bp, Homo sapiens
aaactatttctatgg

SEQ ID NO: 13366 - DNA, 15 bp, Homo sapiens
aaaactatttctatg

SEQ ID NO: 13367 - DNA, 15 bp, Homo sapiens
taaaactatttctat

SEQ ID NO: 13368 - DNA, 15 bp, Homo sapiens
gtaaaactatttcta

SEQ ID NO: 13369 - DNA, 15 bp, Homo sapiens
tgtaaaactatttct

SEQ ID NO: 13370 - DNA, 15 bp, Homo sapiens
ttgtaaaactatttc

SEQ ID NO: 13371 - DNA, 15 bp, Homo sapiens
attgtaaaactattt

SEQ ID NO: 13372 - DNA, 15 bp, Homo sapiens
tattgtaaaactatt

SEQ ID NO: 13373 - DNA, 15 bp, Homo sapiens
ctattgtaaaactat

SEQ ID NO: 13374 - DNA, 15 bp, Homo sapiens
tctattgtaaaacta

SEQ ID NO: 13375 - DNA, 15 bp, Homo sapiens
ttctattgtaaaact

SEQ ID NO: 13376 - DNA, 15 bp, Homo sapiens
cttctattgtaaaac

SEQ ID NO: 13377 - DNA, 15 bp, Homo sapiens
gcttctattgtaaaa

SEQ ID NO: 13378 - DNA, 15 bp, Homo sapiens
ggcttctattgtaaa

SEQ ID NO: 13379 - DNA, 15 bp, Homo sapiens
aggcttctattgtaa

SEQ ID NO: 13380 - DNA, 15 bp, Homo sapiens
caggcttctattgta

SEQ ID NO: 13381 - DNA, 15 bp, Homo sapiens
acaggcttctattgt

SEQ ID NO: 13382 - DNA, 15 bp, Homo sapiens
gacaggcttctattg

SEQ ID NO: 13383 - DNA, 15 bp, Homo sapiens
ggacaggcttctatt

SEQ ID NO: 13384 - DNA, 15 bp, Homo sapiens
tggacaggcttctat

SEQ ID NO: 13385 - DNA, 15 bp, Homo sapiens
ctggacaggcttcta

SEQ ID NO: 13386 - DNA, 15 bp, Homo sapiens
tctggacaggcttct

SEQ ID NO: 13387 - DNA, 15 bp, Homo sapiens
ctctggacaggcttc

SEQ ID NO: 13388 - DNA, 15 bp, Homo sapiens
gctctggacaggctt

SEQ ID NO: 13389 - DNA, 15 bp, Homo sapiens
ggctctggacaggct

SEQ ID NO: 13390 - DNA, 15 bp, Homo sapiens
tggctctggacaggc

SEQ ID NO: 13391 - DNA, 15 bp, Homo sapiens
atggctctggacagg

SEQ ID NO: 13392 - DNA, 15 bp, Homo sapiens
catggctctggacag

SEQ ID NO: 13393 - DNA, 15 bp, Homo sapiens
tcatggctctggaca

SEQ ID NO: 13394 - DNA, 15 bp, Homo sapiens
ctcatggctctggac

SEQ ID NO: 13395 - DNA, 15 bp, Homo sapiens
cctcatggctctgga

SEQ ID NO: 13396 - DNA, 15 bp, Homo sapiens
ccctcatggctctgg

SEQ ID NO: 13397 - DNA, 15 bp, Homo sapiens
tccctcatggctctg

SEQ ID NO: 13398 - DNA, 15 bp, Homo sapiens
ctccctcatggctct

SEQ ID NO: 13399 - DNA, 15 bp, Homo sapiens
tctccctcatggctc

SEQ ID NO: 13400 - DNA, 15 bp, Homo sapiens
ttctccctcatggct

SEQ ID NO: 13401 - DNA, 15 bp, Homo sapiens
cttctccctcatggc

SEQ ID NO: 13402 - DNA, 15 bp, Homo sapiens
ccttctccctcatgg

SEQ ID NO: 13403 - DNA, 15 bp, Homo sapiens
cccttctccctcatg

SEQ ID NO: 13404 - DNA, 15 bp, Homo sapiens
ccccttctccctcat

SEQ ID NO: 13405 - DNA, 15 bp, Homo sapiens
tccccttctccctca

SEQ ID NO: 13406 - DNA, 15 bp, Homo sapiens
atccccttctccctc

SEQ ID NO: 13407 - DNA, 15 bp, Homo sapiens
aatccccttctccct

SEQ ID NO: 13408 - DNA, 15 bp, Homo sapiens
caatccccttctccc

SEQ ID NO: 13409 - DNA, 15 bp, Homo sapiens
acaatccccttctcc

SEQ ID NO: 13410 - DNA, 15 bp, Homo sapiens
tacaatccccttctc

SEQ ID NO: 13411 - DNA, 15 bp, Homo sapiens
ctacaatccccttct

SEQ ID NO: 13412 - DNA, 15 bp, Homo sapiens
tctacaatccccttc

SEQ ID NO: 13413 - DNA, 15 bp, Homo sapiens
ctctacaatcccctt

SEQ ID NO: 13414 - DNA, 15 bp, Homo sapiens
tctctacaatcccct

SEQ ID NO: 13415 - DNA, 15 bp, Homo sapiens
ttctctacaatcccc

SEQ ID NO: 13416 - DNA, 15 bp, Homo sapiens
tttctctacaatccc

SEQ ID NO: 13417 - DNA, 15 bp, Homo sapiens
gtttctctacaatcc

SEQ ID NO: 13418 - DNA, 15 bp, Homo sapiens
tgtttctctacaatc

SEQ ID NO: 13419 - DNA, 15 bp, Homo sapiens
ttgtttctctacaat

SEQ ID NO: 13420 - DNA, 15 bp, Homo sapiens
cttgtttctctacaa

SEQ ID NO: 13421 - DNA, 15 bp, Homo sapiens
ccttgtttctctaca

SEQ ID NO: 13422 - DNA, 15 bp, Homo sapiens
tccttgtttctctac

SEQ ID NO: 13423 - DNA, 15 bp, Homo sapiens
atccttgtttctcta

SEQ ID NO: 13424 - DNA, 15 bp, Homo sapiens
aatccttgtttctct

SEQ ID NO: 13425 - DNA, 15 bp, Homo sapiens
caatccttgtttctc

SEQ ID NO: 13426 - DNA, 15 bp, Homo sapiens
ccaatccttgtttct

SEQ ID NO: 13427 - DNA, 15 bp, Homo sapiens
gccaatccttgtttc

SEQ ID NO: 13428 - DNA, 15 bp, Homo sapiens
tgccaatccttgttt

SEQ ID NO: 13429 - DNA, 15 bp, Homo sapiens
atgccaatccttgtt

SEQ ID NO: 13430 - DNA, 15 bp, Homo sapiens
gatgccaatccttgt

SEQ ID NO: 13431 - DNA, 15 bp, Homo sapiens
agatgccaatccttg

SEQ ID NO: 13432 - DNA, 15 bp, Homo sapiens
cagatgccaatcctt

SEQ ID NO: 13433 - DNA, 15 bp, Homo sapiens
ccagatgccaatcct

SEQ ID NO: 13434 - DNA, 15 bp, Homo sapiens
accagatgccaatcc

SEQ ID NO: 13435 - DNA, 15 bp, Homo sapiens
aaccagatgccaatc

SEQ ID NO: 13436 - DNA, 15 bp, Homo sapiens
aaaccagatgccaat

SEQ ID NO: 13437 - DNA, 15 bp, Homo sapiens
taaaccagatgccaa

SEQ ID NO: 13438 - DNA, 15 bp, Homo sapiens
ataaaccagatgcca

SEQ ID NO: 13439 - DNA, 15 bp, Homo sapiens
cataaaccagatgcc

SEQ ID NO: 13440 - DNA, 15 bp, Homo sapiens
acataaaccagatgc

SEQ ID NO: 13441 - DNA, 15 bp, Homo sapiens
aacataaaccagatg

SEQ ID NO: 13442 - DNA, 15 bp, Homo sapiens
aaacataaaccagat

SEQ ID NO: 13443 - DNA, 15 bp, Homo sapiens
taaacataaaccaga

SEQ ID NO: 13444 - DNA, 15 bp, Homo sapiens
gtaaacataaaccag

SEQ ID NO: 13445 - DNA, 15 bp, Homo sapiens
tgtaaacataaacca

SEQ ID NO: 13446 - DNA, 15 bp, Homo sapiens
atgtaaacataaacc

SEQ ID NO: 13447 - DNA, 15 bp, Homo sapiens
gatgtaaacataaac

SEQ ID NO: 13448 - DNA, 15 bp, Homo sapiens
ggatgtaaacataaa

SEQ ID NO: 13449 - DNA, 15 bp, Homo sapiens
aggatgtaaacataa

SEQ ID NO: 13450 - DNA, 15 bp, Homo sapiens
aaggatgtaaacata

SEQ ID NO: 13451 - DNA, 15 bp, Homo sapiens
aaaggatgtaaacat

SEQ ID NO: 13452 - DNA, 15 bp, Homo sapiens
taaaggatgtaaaca

SEQ ID NO: 13453 - DNA, 15 bp, Homo sapiens
ctaaaggatgtaaac

SEQ ID NO: 13454 - DNA, 15 bp, Homo sapiens
actaaaggatgtaaa

SEQ ID NO: 13455 - DNA, 15 bp, Homo sapiens
gactaaaggatgtaa

SEQ ID NO: 13456 - DNA, 15 bp, Homo sapiens
ggactaaaggatgta

SEQ ID NO: 13457 - DNA, 15 bp, Homo sapiens
aggactaaaggatgt

SEQ ID NO: 13458 - DNA, 15 bp, Homo sapiens
caggactaaaggatg

SEQ ID NO: 13459 - DNA, 15 bp, Homo sapiens
acaggactaaaggat

SEQ ID NO: 13460 - DNA, 15 bp, Homo sapiens
aacaggactaaagga

SEQ ID NO: 13461 - DNA, 15 bp, Homo sapiens
taacaggactaaagg

SEQ ID NO: 13462 - DNA, 15 bp, Homo sapiens
ttaacaggactaaag

SEQ ID NO: 13463 - DNA, 15 bp, Homo sapiens
gttaacaggactaaa

SEQ ID NO: 13464 - DNA, 15 bp, Homo sapiens
ggttaacaggactaa

SEQ ID NO: 13465 - DNA, 15 bp, Homo sapiens
cggttaacaggacta

SEQ ID NO: 13466 - DNA, 15 bp, Homo sapiens
tcggttaacaggact

SEQ ID NO: 13467 - DNA, 15 bp, Homo sapiens
ctcggttaacaggac

SEQ ID NO: 13468 - DNA, 15 bp, Homo sapiens
tctcggttaacagga

SEQ ID NO: 13469 - DNA, 15 bp, Homo sapiens
ttctcggttaacagg

SEQ ID NO: 13470 - DNA, 15 bp, Homo sapiens
cttctcggttaacag

SEQ ID NO: 13471 - DNA, 15 bp, Homo sapiens
tcttctcggttaaca

SEQ ID NO: 13472 - DNA, 15 bp, Homo sapiens
ttcttctcggttaac

SEQ ID NO: 13473 - DNA, 15 bp, Homo sapiens
cttcttctcggttaa

SEQ ID NO: 13474 - DNA, 15 bp, Homo sapiens
tcttcttctcggtta

SEQ ID NO: 13475 - DNA, 15 bp, Homo sapiens
atcttcttctcggtt

SEQ ID NO: 13476 - DNA, 15 bp, Homo sapiens
tatcttcttctcggt

SEQ ID NO: 13477 - DNA, 15 bp, Homo sapiens
atatcttcttctcgg

SEQ ID NO: 13478 - DNA, 15 bp, Homo sapiens
aatatcttcttctcg

SEQ ID NO: 13479 - DNA, 15 bp, Homo sapiens
aaatatcttcttctc

SEQ ID NO: 13480 - DNA, 15 bp, Homo sapiens
aaaatatcttcttct

SEQ ID NO: 13481 - DNA, 15 bp, Homo sapiens
aaaaatatcttcttc

SEQ ID NO: 13482 - DNA, 15 bp, Homo sapiens
taaaaatatcttctt

SEQ ID NO: 13483 - DNA, 15 bp, Homo sapiens
ataaaaatatcttct

SEQ ID NO: 13484 - DNA, 15 bp, Homo sapiens
aataaaaatatcttc

SEQ ID NO: 13485 - DNA, 15 bp, Homo sapiens
aaataaaaatatctt

SEQ ID NO: 13486 - DNA, 15 bp, Homo sapiens
gaaataaaaatatct

SEQ ID NO: 13487 - DNA, 15 bp, Homo sapiens
ggaaataaaaatatc

SEQ ID NO: 13488 - DNA, 15 bp, Homo sapiens
tggaaataaaaatat

SEQ ID NO: 13489 - DNA, 15 bp, Homo sapiens
atggaaataaaaata

SEQ ID NO: 13490 - DNA, 15 bp, Homo sapiens
catggaaataaaaat

SEQ ID NO: 13491 - DNA, 15 bp, Homo sapiens
acatggaaataaaaa

SEQ ID NO: 13492 - DNA, 15 bp, Homo sapiens
aacatggaaataaaa

SEQ ID NO: 13493 - DNA, 15 bp, Homo sapiens
aaacatggaaataaa

SEQ ID NO: 13494 - DNA, 15 bp, Homo sapiens
caaacatggaaataa

SEQ ID NO: 13495 - DNA, 15 bp, Homo sapiens
gcaaacatggaaata

SEQ ID NO: 13496 - DNA, 15 bp, Homo sapiens
cgcaaacatggaaat

SEQ ID NO: 13497 - DNA, 15 bp, Homo sapiens
tcgcaaacatggaaa

SEQ ID NO: 13498 - DNA, 15 bp, Homo sapiens
ttcgcaaacatggaa

SEQ ID NO: 13499 - DNA, 15 bp, Homo sapiens
tttcgcaaacatgga

SEQ ID NO: 13500 - DNA, 15 bp, Homo sapiens
ctttcgcaaacatgg

SEQ ID NO: 13501 - DNA, 15 bp, Homo sapiens
gctttcgcaaacatg

SEQ ID NO: 13502 - DNA, 15 bp, Homo sapiens
agctttcgcaaacat

SEQ ID NO: 13503 - DNA, 15 bp, Homo sapiens
aagctttcgcaaaca

SEQ ID NO: 13504 - DNA, 15 bp, Homo sapiens
aaagctttcgcaaac

SEQ ID NO: 13505 - DNA, 15 bp, Homo sapiens
gaaagctttcgcaaa

SEQ ID NO: 13506 - DNA, 15 bp, Homo sapiens
ggaaagctttcgcaa

SEQ ID NO: 13507 - DNA, 15 bp, Homo sapiens
tggaaagctttcgca

SEQ ID NO: 13508 - DNA, 15 bp, Homo sapiens
gtggaaagctttcgc

SEQ ID NO: 13509 - DNA, 15 bp, Homo sapiens
tgtggaaagctttcg

SEQ ID NO: 13510 - DNA, 15 bp, Homo sapiens
ttgtggaaagctttc

SEQ ID NO: 13511 - DNA, 15 bp, Homo sapiens
tttgtggaaagcttt

SEQ ID NO: 13512 - DNA, 15 bp, Homo sapiens
ttttgtggaaagctt

SEQ ID NO: 13513 - DNA, 15 bp, Homo sapiens
tttttgtggaaagct

SEQ ID NO: 13514 - DNA, 15 bp, Homo sapiens
ttttttgtggaaagc

SEQ ID NO: 13515 - DNA, 15 bp, Homo sapiens
tttttttgtggaaag

SEQ ID NO: 13516 - DNA, 15 bp, Homo sapiens
ttttttttgtggaaa

SEQ ID NO: 13517 - DNA, 15 bp, Homo sapiens
cttttttttgtggaa

SEQ ID NO: 13518 - DNA, 15 bp, Homo sapiens
gcttttttttgtgga

SEQ ID NO: 13519 - DNA, 15 bp, Homo sapiens
tgcttttttttgtgg

SEQ ID NO: 13520 - DNA, 15 bp, Homo sapiens
atgcttttttttgtg

SEQ ID NO: 13521 - DNA, 15 bp, Homo sapiens
gatgcttttttttgt

SEQ ID NO: 13522 - DNA, 15 bp, Homo sapiens
ggatgcttttttttg

SEQ ID NO: 13523 - DNA, 15 bp, Homo sapiens
tggatgctttttttt

SEQ ID NO: 13524 - DNA, 15 bp, Homo sapiens
atggatgcttttttt

SEQ ID NO: 13525 - DNA, 15 bp, Homo sapiens
aatggatgctttttt

SEQ ID NO: 13526 - DNA, 15 bp, Homo sapiens
aaatggatgcttttt

SEQ ID NO: 13527 - DNA, 15 bp, Homo sapiens
aaaatggatgctttt

SEQ ID NO: 13528 - DNA, 15 bp, Homo sapiens
gaaaatggatgcttt

SEQ ID NO: 13529 - DNA, 15 bp, Homo sapiens
agaaaatggatgctt

SEQ ID NO: 13530 - DNA, 15 bp, Homo sapiens
tagaaaatggatgct

SEQ ID NO: 13531 - DNA, 15 bp, Homo sapiens
ctagaaaatggatgc

SEQ ID NO: 13532 - DNA, 15 bp, Homo sapiens
tctagaaaatggatg

SEQ ID NO: 13533 - DNA, 15 bp, Homo sapiens
gtctagaaaatggat

SEQ ID NO: 13534 - DNA, 15 bp, Homo sapiens
agtctagaaaatgga

SEQ ID NO: 13535 - DNA, 15 bp, Homo sapiens
aagtctagaaaatgg

SEQ ID NO: 13536 - DNA, 15 bp, Homo sapiens
taagtctagaaaatg

SEQ ID NO: 13537 - DNA, 15 bp, Homo sapiens
ataagtctagaaaat

SEQ ID NO: 13538 - DNA, 15 bp, Homo sapiens
aataagtctagaaaa

SEQ ID NO: 13539 - DNA, 15 bp, Homo sapiens
taataagtctagaaa

SEQ ID NO: 13540 - DNA, 15 bp, Homo sapiens
ttaataagtctagaa

SEQ ID NO: 13541 - DNA, 15 bp, Homo sapiens
attaataagtctaga

SEQ ID NO: 13542 - DNA, 15 bp, Homo sapiens
tattaataagtctag

SEQ ID NO: 13543 - DNA, 15 bp, Homo sapiens
ctattaataagtcta

SEQ ID NO: 13544 - DNA, 15 bp, Homo sapiens
cctattaataagtct

SEQ ID NO: 13545 - DNA, 15 bp, Homo sapiens
ccctattaataagtc

SEQ ID NO: 13546 - DNA, 15 bp, Homo sapiens
gccctattaataagt

SEQ ID NO: 13547 - DNA, 15 bp, Homo sapiens
tgccctattaataag

SEQ ID NO: 13548 - DNA, 15 bp, Homo sapiens
ctgccctattaataa

SEQ ID NO: 13549 - DNA, 15 bp, Homo sapiens
actgccctattaata

SEQ ID NO: 13550 - DNA, 15 bp, Homo sapiens
gactgccctattaat

SEQ ID NO: 13551 - DNA, 15 bp, Homo sapiens
ggactgccctattaa

SEQ ID NO: 13552 - DNA, 15 bp, Homo sapiens
tggactgccctatta

SEQ ID NO: 13553 - DNA, 15 bp, Homo sapiens
ttggactgccctatt

SEQ ID NO: 13554 - DNA, 15 bp, Homo sapiens
tttggactgccctat

SEQ ID NO: 13555 - DNA, 15 bp, Homo sapiens
ctttggactgcccta

SEQ ID NO: 13556 - DNA, 15 bp, Homo sapiens
cctttggactgccct

SEQ ID NO: 13557 - DNA, 15 bp, Homo sapiens
acctttggactgccc

SEQ ID NO: 13558 - DNA, 15 bp, Homo sapiens
aacctttggactgcc

SEQ ID NO: 13559 - DNA, 15 bp, Homo sapiens
aaacctttggactgc

SEQ ID NO: 13560 - DNA, 15 bp, Homo sapiens
aaaacctttggactg

SEQ ID NO: 13561 - DNA, 15 bp, Homo sapiens
taaaacctttggact

SEQ ID NO: 13562 - DNA, 15 bp, Homo sapiens
ataaaacctttggac

SEQ ID NO: 13563 - DNA, 15 bp, Homo sapiens
aataaaacctttgga

SEQ ID NO: 13564 - DNA, 15 bp, Homo sapiens
aaataaaacctttgg

SEQ ID NO: 13565 - DNA, 15 bp, Homo sapiens
aaaataaaacctttg

SEQ ID NO: 13566 - DNA, 15 bp, Homo sapiens
aaaaataaaaccttt

SEQ ID NO: 13567 - DNA, 15 bp, Homo sapiens
taaaaataaaacctt

SEQ ID NO: 13568 - DNA, 15 bp, Homo sapiens
ctaaaaataaaacct

SEQ ID NO: 13569 - DNA, 15 bp, Homo sapiens
tctaaaaataaaacc

SEQ ID NO: 13570 - DNA, 15 bp, Homo sapiens
atctaaaaataaaac

SEQ ID NO: 13571 - DNA, 15 bp, Homo sapiens
aatctaaaaataaaa

SEQ ID NO: 13572 - DNA, 15 bp, Homo sapiens
aaatctaaaaataaa

SEQ ID NO: 13573 - DNA, 15 bp, Homo sapiens
caaatctaaaaataa

SEQ ID NO: 13574 - DNA, 15 bp, Homo sapiens
tcaaatctaaaaata

SEQ ID NO: 13575 - DNA, 15 bp, Homo sapiens
ttcaaatctaaaaat

SEQ ID NO: 13576 - DNA, 15 bp, Homo sapiens
tttcaaatctaaaaa

SEQ ID NO: 13577 - DNA, 15 bp, Homo sapiens
ctttcaaatctaaaa

SEQ ID NO: 13578 - DNA, 15 bp, Homo sapiens
tctttcaaatctaaa

SEQ ID NO: 13579 - DNA, 15 bp, Homo sapiens
ttctttcaaatctaa

SEQ ID NO: 13580 - DNA, 15 bp, Homo sapiens
tttctttcaaatcta

SEQ ID NO: 13581 - DNA, 15 bp, Homo sapiens
ctttctttcaaatct

SEQ ID NO: 13582 - DNA, 15 bp, Homo sapiens
gctttctttcaaatc

SEQ ID NO: 13583 - DNA, 15 bp, Homo sapiens
tgctttctttcaaat

SEQ ID NO: 13584 - DNA, 15 bp, Homo sapiens
ttgctttctttcaaa

SEQ ID NO: 13585 - DNA, 15 bp, Homo sapiens
tttgctttctttcaa

SEQ ID NO: 13586 - DNA, 15 bp, Homo sapiens
ctttgctttctttca

SEQ ID NO: 13587 - DNA, 15 bp, Homo sapiens
actttgctttctttc

SEQ ID NO: 13588 - DNA, 15 bp, Homo sapiens
tactttgctttcttt

SEQ ID NO: 13589 - DNA, 15 bp, Homo sapiens
ctactttgctttctt

SEQ ID NO: 13590 - DNA, 15 bp, Homo sapiens
cctactttgctttct

SEQ ID NO: 13591 - DNA, 15 bp, Homo sapiens
gcctactttgctttc

SEQ ID NO: 13592 - DNA, 15 bp, Homo sapiens
agcctactttgcttt

SEQ ID NO: 13593 - DNA, 15 bp, Homo sapiens
aagcctactttgctt

SEQ ID NO: 13594 - DNA, 15 bp, Homo sapiens
gaagcctactttgct

SEQ ID NO: 13595 - DNA, 15 bp, Homo sapiens
agaagcctactttgc

SEQ ID NO: 13596 - DNA, 15 bp, Homo sapiens
cagaagcctactttg

SEQ ID NO: 13597 - DNA, 15 bp, Homo sapiens
tcagaagcctacttt

SEQ ID NO: 13598 - DNA, 15 bp, Homo sapiens
ctcagaagcctactt

SEQ ID NO: 13599 - DNA, 15 bp, Homo sapiens
tctcagaagcctact

SEQ ID NO: 13600 - DNA, 15 bp, Homo sapiens
atctcagaagcctac

SEQ ID NO: 13601 - DNA, 15 bp, Homo sapiens
tatctcagaagccta

SEQ ID NO: 13602 - DNA, 15 bp, Homo sapiens
atatctcagaagcct

SEQ ID NO: 13603 - DNA, 15 bp, Homo sapiens
catatctcagaagcc

SEQ ID NO: 13604 - DNA, 15 bp, Homo sapiens
gcatatctcagaagc

SEQ ID NO: 13605 - DNA, 15 bp, Homo sapiens
tgcatatctcagaag

SEQ ID NO: 13606 - DNA, 15 bp, Homo sapiens
gtgcatatctcagaa

SEQ ID NO: 13607 - DNA, 15 bp, Homo sapiens
tgtgcatatctcaga

SEQ ID NO: 13608 - DNA, 15 bp, Homo sapiens
atgtgcatatctcag

SEQ ID NO: 13609 - DNA, 15 bp, Homo sapiens
aatgtgcatatctca

SEQ ID NO: 13610 - DNA, 15 bp, Homo sapiens
aaatgtgcatatctc

SEQ ID NO: 13611 - DNA, 15 bp, Homo sapiens
gaaatgtgcatatct

SEQ ID NO: 13612 - DNA, 15 bp, Homo sapiens
ggaaatgtgcatatc

SEQ ID NO: 13613 - DNA, 15 bp, Homo sapiens
gggaaatgtgcatat

SEQ ID NO: 13614 - DNA, 15 bp, Homo sapiens
agggaaatgtgcata

SEQ ID NO: 13615 - DNA, 15 bp, Homo sapiens
cagggaaatgtgcat

SEQ ID NO: 13616 - DNA, 15 bp, Homo sapiens
acagggaaatgtgca

SEQ ID NO: 13617 - DNA, 15 bp, Homo sapiens
cacagggaaatgtgc

SEQ ID NO: 13618 - DNA, 15 bp, Homo sapiens
acacagggaaatgtg

SEQ ID NO: 13619 - DNA, 15 bp, Homo sapiens
gacacagggaaatgt

SEQ ID NO: 13620 - DNA, 15 bp, Homo sapiens
ggacacagggaaatg

SEQ ID NO: 13621 - DNA, 15 bp, Homo sapiens
gggacacagggaaat

SEQ ID NO: 13622 - DNA, 15 bp, Homo sapiens
agggacacagggaaa

SEQ ID NO: 13623 - DNA, 15 bp, Homo sapiens
cagggacacagggaa

SEQ ID NO: 13624 - DNA, 15 bp, Homo sapiens
acagggacacaggga

SEQ ID NO: 13625 - DNA, 15 bp, Homo sapiens
gacagggacacaggg

SEQ ID NO: 13626 - DNA, 15 bp, Homo sapiens
agacagggacacagg

SEQ ID NO: 13627 - DNA, 15 bp, Homo sapiens
gagacagggacacag

SEQ ID NO: 13628 - DNA, 15 bp, Homo sapiens
agagacagggacaca

SEQ ID NO: 13629 - DNA, 15 bp, Homo sapiens
aagagacagggacac

SEQ ID NO: 13630 - DNA, 15 bp, Homo sapiens
aaagagacagggaca

SEQ ID NO: 13631 - DNA, 15 bp, Homo sapiens
aaaagagacagggac

SEQ ID NO: 13632 - DNA, 15 bp, Homo sapiens
caaaagagacaggga

SEQ ID NO: 13633 - DNA, 15 bp, Homo sapiens
gcaaaagagacaggg

SEQ ID NO: 13634 - DNA, 15 bp, Homo sapiens
tgcaaaagagacagg

SEQ ID NO: 13635 - DNA, 15 bp, Homo sapiens
ttgcaaaagagacag

SEQ ID NO: 13636 - DNA, 15 bp, Homo sapiens
gttgcaaaagagaca

SEQ ID NO: 13637 - DNA, 15 bp, Homo sapiens
tgttgcaaaagagac

SEQ ID NO: 13638 - DNA, 15 bp, Homo sapiens
atgttgcaaaagaga

SEQ ID NO: 13639 - DNA, 15 bp, Homo sapiens
aatgttgcaaaagag

SEQ ID NO: 13640 - DNA, 15 bp, Homo sapiens
gaatgttgcaaaaga

SEQ ID NO: 13641 - DNA, 15 bp, Homo sapiens
ggaatgttgcaaaag

SEQ ID NO: 13642 - DNA, 15 bp, Homo sapiens
tggaatgttgcaaaa

SEQ ID NO: 13643 - DNA, 15 bp, Homo sapiens
gtggaatgttgcaaa

SEQ ID NO: 13644 - DNA, 15 bp, Homo sapiens
tgtggaatgttgcaa

SEQ ID NO: 13645 - DNA, 15 bp, Homo sapiens
atgtggaatgttgca

SEQ ID NO: 13646 - DNA, 15 bp, Homo sapiens
aatgtggaatgttgc

SEQ ID NO: 13647 - DNA, 15 bp, Homo sapiens
caatgtggaatgttg

SEQ ID NO: 13648 - DNA, 15 bp, Homo sapiens
gcaatgtggaatgtt

SEQ ID NO: 13649 - DNA, 15 bp, Homo sapiens
agcaatgtggaatgt

SEQ ID NO: 13650 - DNA, 15 bp, Homo sapiens
cagcaatgtggaatg

SEQ ID NO: 13651 - DNA, 15 bp, Homo sapiens
gcagcaatgtggaat

SEQ ID NO: 13652 - DNA, 15 bp, Homo sapiens
agcagcaatgtggaa

SEQ ID NO: 13653 - DNA, 15 bp, Homo sapiens
tagcagcaatgtgga

SEQ ID NO: 13654 - DNA, 15 bp, Homo sapiens
ttagcagcaatgtgg

SEQ ID NO: 13655 - DNA, 15 bp, Homo sapiens
tttagcagcaatgtg

SEQ ID NO: 13656 - DNA, 15 bp, Homo sapiens
ttttagcagcaatgt

SEQ ID NO: 13657 - DNA, 15 bp, Homo sapiens
gttttagcagcaatg

SEQ ID NO: 13658 - DNA, 15 bp, Homo sapiens
agttttagcagcaat

SEQ ID NO: 13659 - DNA, 15 bp, Homo sapiens
aagttttagcagcaa

SEQ ID NO: 13660 - DNA, 15 bp, Homo sapiens
caagttttagcagca

SEQ ID NO: 13661 - DNA, 15 bp, Homo sapiens
tcaagttttagcagc

SEQ ID NO: 13662 - DNA, 15 bp, Homo sapiens
ttcaagttttagcag

SEQ ID NO: 13663 - DNA, 15 bp, Homo sapiens
gttcaagttttagca

SEQ ID NO: 13664 - DNA, 15 bp, Homo sapiens
tgttcaagttttagc

SEQ ID NO: 13665 - DNA, 15 bp, Homo sapiens
atgttcaagttttag

SEQ ID NO: 13666 - DNA, 15 bp, Homo sapiens
catgttcaagtttta

SEQ ID NO: 13667 - DNA, 15 bp, Homo sapiens
tcatgttcaagtttt

SEQ ID NO: 13668 - DNA, 15 bp, Homo sapiens
ctcatgttcaagttt

SEQ ID NO: 13669 - DNA, 15 bp, Homo sapiens
gctcatgttcaagtt

SEQ ID NO: 13670 - DNA, 15 bp, Homo sapiens
tgctcatgttcaagt

SEQ ID NO: 13671 - DNA, 15 bp, Homo sapiens
gtgctcatgttcaag

SEQ ID NO: 13672 - DNA, 15 bp, Homo sapiens
agtgctcatgttcaa

SEQ ID NO: 13673 - DNA, 15 bp, Homo sapiens
aagtgctcatgttca

SEQ ID NO: 13674 - DNA, 15 bp, Homo sapiens
aaagtgctcatgttc

SEQ ID NO: 13675 - DNA, 15 bp, Homo sapiens
gaaagtgctcatgtt

SEQ ID NO: 13676 - DNA, 15 bp, Homo sapiens
tgaaagtgctcatgt

SEQ ID NO: 13677 - DNA, 15 bp, Homo sapiens
ttgaaagtgctcatg

SEQ ID NO: 13678 - DNA, 15 bp, Homo sapiens
cttgaaagtgctcat

SEQ ID NO: 13679 - DNA, 15 bp, Homo sapiens
gcttgaaagtgctca

SEQ ID NO: 13680 - DNA, 15 bp, Homo sapiens
tgcttgaaagtgctc

SEQ ID NO: 13681 - DNA, 15 bp, Homo sapiens
atgcttgaaagtgct

SEQ ID NO: 13682 - DNA, 15 bp, Homo sapiens
catgcttgaaagtgc

SEQ ID NO: 13683 - DNA, 15 bp, Homo sapiens
acatgcttgaaagtg

SEQ ID NO: 13684 - DNA, 15 bp, Homo sapiens
cacatgcttgaaagt

SEQ ID NO: 13685 - DNA, 15 bp, Homo sapiens
gcacatgcttgaaag

SEQ ID NO: 13686 - DNA, 15 bp, Homo sapiens
agcacatgcttgaaa

SEQ ID NO: 13687 - DNA, 15 bp, Homo sapiens
aagcacatgcttgaa

SEQ ID NO: 13688 - DNA, 15 bp, Homo sapiens
taagcacatgcttga

SEQ ID NO: 13689 - DNA, 15 bp, Homo sapiens
gtaagcacatgcttg

SEQ ID NO: 13690 - DNA, 15 bp, Homo sapiens
agtaagcacatgctt

SEQ ID NO: 13691 - DNA, 15 bp, Homo sapiens
aagtaagcacatgct

SEQ ID NO: 13692 - DNA, 15 bp, Homo sapiens
aaagtaagcacatgc

SEQ ID NO: 13693 - DNA, 15 bp, Homo sapiens
gaaagtaagcacatg

SEQ ID NO: 13694 - DNA, 15 bp, Homo sapiens
agaaagtaagcacat

SEQ ID NO: 13695 - DNA, 15 bp, Homo sapiens
tagaaagtaagcaca

SEQ ID NO: 13696 - DNA, 15 bp, Homo sapiens
atagaaagtaagcac

SEQ ID NO: 13697 - DNA, 15 bp, Homo sapiens
catagaaagtaagca

SEQ ID NO: 13698 - DNA, 15 bp, Homo sapiens
acatagaaagtaagc

SEQ ID NO: 13699 - DNA, 15 bp, Homo sapiens
tacatagaaagtaag

SEQ ID NO: 13700 - DNA, 15 bp, Homo sapiens
atacatagaaagtaa

SEQ ID NO: 13701 - DNA, 15 bp, Homo sapiens
catacatagaaagta

SEQ ID NO: 13702 - DNA, 15 bp, Homo sapiens
tcatacatagaaagt

SEQ ID NO: 13703 - DNA, 15 bp, Homo sapiens
gtcatacatagaaag

SEQ ID NO: 13704 - DNA, 15 bp, Homo sapiens
agtcatacatagaaa

SEQ ID NO: 13705 - DNA, 15 bp, Homo sapiens
gagtcatacatagaa

SEQ ID NO: 13706 - DNA, 15 bp, Homo sapiens
tgagtcatacataga

SEQ ID NO: 13707 - DNA, 15 bp, Homo sapiens
atgagtcatacatag

SEQ ID NO: 13708 - DNA, 15 bp, Homo sapiens
aatgagtcatacata

SEQ ID NO: 13709 - DNA, 15 bp, Homo sapiens
aaatgagtcatacat

SEQ ID NO: 13710 - DNA, 15 bp, Homo sapiens
aaaatgagtcataca

SEQ ID NO: 13711 - DNA, 15 bp, Homo sapiens
aaaaatgagtcatac

SEQ ID NO: 13712 - DNA, 15 bp, Homo sapiens
aaaaaatgagtcata

SEQ ID NO: 13713 - DNA, 15 bp, Homo sapiens
taaaaaatgagtcat

SEQ ID NO: 13714 - DNA, 15 bp, Homo sapiens
ttaaaaaatgagtca

SEQ ID NO: 13715 - DNA, 15 bp, Homo sapiens
tttaaaaaatgagtc

SEQ ID NO: 13716 - DNA, 15 bp, Homo sapiens
ttttaaaaaatgagt

SEQ ID NO: 13717 - DNA, 15 bp, Homo sapiens
gttttaaaaaatgag

SEQ ID NO: 13718 - DNA, 15 bp, Homo sapiens
tgttttaaaaaatga

SEQ ID NO: 13719 - DNA, 15 bp, Homo sapiens
atgttttaaaaaatg

SEQ ID NO: 13720 - DNA, 15 bp, Homo sapiens
aatgttttaaaaaat

SEQ ID NO: 13721 - DNA, 15 bp, Homo sapiens
taatgttttaaaaaa

SEQ ID NO: 13722 - DNA, 15 bp, Homo sapiens
ttaatgttttaaaaa

SEQ ID NO: 13723 - DNA, 15 bp, Homo sapiens
tttaatgttttaaaa

SEQ ID NO: 13724 - DNA, 15 bp, Homo sapiens
ctttaatgttttaaa

SEQ ID NO: 13725 - DNA, 15 bp, Homo sapiens
gctttaatgttttaa

SEQ ID NO: 13726 - DNA, 15 bp, Homo sapiens
tgctttaatgtttta

SEQ ID NO: 13727 - DNA, 15 bp, Homo sapiens
atgctttaatgtttt

SEQ ID NO: 13728 - DNA, 15 bp, Homo sapiens
aatgctttaatgttt

SEQ ID NO: 13729 - DNA, 15 bp, Homo sapiens
aaatgctttaatgtt

SEQ ID NO: 13730 - DNA, 15 bp, Homo sapiens
aaaatgctttaatgt

SEQ ID NO: 13731 - DNA, 15 bp, Homo sapiens
gaaaatgctttaatg

SEQ ID NO: 13732 - DNA, 15 bp, Homo sapiens
cgaaaatgctttaat

SEQ ID NO: 13733 - DNA, 15 bp, Homo sapiens
ccgaaaatgctttaa

SEQ ID NO: 13734 - DNA, 15 bp, Homo sapiens
gccgaaaatgcttta

SEQ ID NO: 13735 - DNA, 15 bp, Homo sapiens
ggccgaaaatgcttt

SEQ ID NO: 13736 - DNA, 15 bp, Homo sapiens
cggccgaaaatgctt

SEQ ID NO: 13737 - DNA, 15 bp, Homo sapiens
ccggccgaaaatgct

SEQ ID NO: 13738 - DNA, 15 bp, Homo sapiens
cccggccgaaaatgc

SEQ ID NO: 13739 - DNA, 15 bp, Homo sapiens
acccggccgaaaatg

SEQ ID NO: 13740 - DNA, 15 bp, Homo sapiens
cacccggccgaaaat

SEQ ID NO: 13741 - DNA, 15 bp, Homo sapiens
acacccggccgaaaa

SEQ ID NO: 13742 - DNA, 15 bp, Homo sapiens
cacacccggccgaaa

SEQ ID NO: 13743 - DNA, 15 bp, Homo sapiens
ccacacccggccgaa

SEQ ID NO: 13744 - DNA, 15 bp, Homo sapiens
accacacccggccga

SEQ ID NO: 13745 - DNA, 15 bp, Homo sapiens
caccacacccggccg

SEQ ID NO: 13746 - DNA, 15 bp, Homo sapiens
ccaccacacccggcc

SEQ ID NO: 13747 - DNA, 15 bp, Homo sapiens
gccaccacacccggc

SEQ ID NO: 13748 - DNA, 15 bp, Homo sapiens
agccaccacacccgg

SEQ ID NO: 13749 - DNA, 15 bp, Homo sapiens
gagccaccacacccg

SEQ ID NO: 13750 - DNA, 15 bp, Homo sapiens
tgagccaccacaccc

SEQ ID NO: 13751 - DNA, 15 bp, Homo sapiens
gtgagccaccacacc

SEQ ID NO: 13752 - DNA, 15 bp, Homo sapiens
cgtgagccaccacac

SEQ ID NO: 13753 - DNA, 15 bp, Homo sapiens
gcgtgagccaccaca

SEQ ID NO: 13754 - DNA, 15 bp, Homo sapiens
taggcgtgagccacc

SEQ ID NO: 13755 - DNA, 15 bp, Homo sapiens
ataggcgtgagccac

SEQ ID NO: 13756 - DNA, 15 bp, Homo sapiens
tataggcgtgagcca

SEQ ID NO: 13757 - DNA, 15 bp, Homo sapiens
atataggcgtgagcc

SEQ ID NO: 13758 - DNA, 15 bp, Homo sapiens
aatataggcgtgagc

SEQ ID NO: 13759 - DNA, 15 bp, Homo sapiens
gaatataggcgtgag

SEQ ID NO: 13760 - DNA, 15 bp, Homo sapiens
ggaatataggcgtga

SEQ ID NO: 13761 - DNA, 15 bp, Homo sapiens
aggaatataggcgtg

SEQ ID NO: 13762 - DNA, 15 bp, Homo sapiens
taggaatataggcgt

SEQ ID NO: 13763 - DNA, 15 bp, Homo sapiens
ctaggaatataggcg

SEQ ID NO: 13764 - DNA, 15 bp, Homo sapiens
gctaggaatataggc

SEQ ID NO: 13765 - DNA, 15 bp, Homo sapiens
tgctaggaatatagg

SEQ ID NO: 13766 - DNA, 15 bp, Homo sapiens
gtgctaggaatatag

SEQ ID NO: 13767 - DNA, 15 bp, Homo sapiens
agtgctaggaatata

SEQ ID NO: 13768 - DNA, 15 bp, Homo sapiens
aagtgctaggaatat

SEQ ID NO: 13769 - DNA, 15 bp, Homo sapiens
aaagtgctaggaata

SEQ ID NO: 13770 - DNA, 15 bp, Homo sapiens
taaagtgctaggaat

SEQ ID NO: 13771 - DNA, 15 bp, Homo sapiens
ctaaagtgctaggaa

SEQ ID NO: 13772 - DNA, 15 bp, Homo sapiens
tctaaagtgctagga

SEQ ID NO: 13773 - DNA, 15 bp, Homo sapiens
ttctaaagtgctagg

SEQ ID NO: 13774 - DNA, 15 bp, Homo sapiens
cttctaaagtgctag

SEQ ID NO: 13775 - DNA, 15 bp, Homo sapiens
ccttctaaagtgcta

SEQ ID NO: 13776 - DNA, 15 bp, Homo sapiens
gccttctaaagtgct

SEQ ID NO: 13777 - DNA, 15 bp, Homo sapiens
ggccttctaaagtgc

SEQ ID NO: 13778 - DNA, 15 bp, Homo sapiens
cggccttctaaagtg

SEQ ID NO: 13779 - DNA, 15 bp, Homo sapiens
tcggccttctaaagt

SEQ ID NO: 13780 - DNA, 15 bp, Homo sapiens
ctcggccttctaaag

SEQ ID NO: 13781 - DNA, 15 bp, Homo sapiens
cctcggccttctaaa

SEQ ID NO: 13782 - DNA, 15 bp, Homo sapiens
gcctcggccttctaa

SEQ ID NO: 13783 - DNA, 15 bp, Homo sapiens
cgcctcggccttcta

SEQ ID NO: 13784 - DNA, 15 bp, Homo sapiens
ccgcctcggccttct

SEQ ID NO: 13785 - DNA, 15 bp, Homo sapiens
cccgcctcggccttc

SEQ ID NO: 13786 - DNA, 15 bp, Homo sapiens
acccgcctcggcctt

SEQ ID NO: 13787 - DNA, 15 bp, Homo sapiens
tacccgcctcggcct

SEQ ID NO: 13788 - DNA, 15 bp, Homo sapiens
ctacccgcctcggcc

SEQ ID NO: 13789 - DNA, 15 bp, Homo sapiens
tctacccgcctcggc

SEQ ID NO: 13790 - DNA, 15 bp, Homo sapiens
atctacccgcctcgg

SEQ ID NO: 13791 - DNA, 15 bp, Homo sapiens
gatctacccgcctcg

SEQ ID NO: 13792 - DNA, 15 bp, Homo sapiens
tgatctacccgcctc

SEQ ID NO: 13793 - DNA, 15 bp, Homo sapiens
gtgatctacccgcct

SEQ ID NO: 13794 - DNA, 15 bp, Homo sapiens
agtgatctacccgcc

SEQ ID NO: 13795 - DNA, 15 bp, Homo sapiens
aagtgatctacccgc

SEQ ID NO: 13796 - DNA, 15 bp, Homo sapiens
caagtgatctacccg

SEQ ID NO: 13797 - DNA, 15 bp, Homo sapiens
tcaagtgatctaccc

SEQ ID NO: 13798 - DNA, 15 bp, Homo sapiens
ctcaagtgatctacc

SEQ ID NO: 13799 - DNA, 15 bp, Homo sapiens
cctcaagtgatctac

SEQ ID NO: 13800 - DNA, 15 bp, Homo sapiens
acctcaagtgatcta

SEQ ID NO: 13801 - DNA, 15 bp, Homo sapiens
gacctcaagtgatct

SEQ ID NO: 13802 - DNA, 15 bp, Homo sapiens
ctcctgacctcaagt

SEQ ID NO: 13803 - DNA, 15 bp, Homo sapiens
actcctgacctcaag

SEQ ID NO: 13804 - DNA, 15 bp, Homo sapiens
aactcctgacctcaa

SEQ ID NO: 13805 - DNA, 15 bp, Homo sapiens
ggtcttgaactcctg

SEQ ID NO: 13806 - DNA, 15 bp, Homo sapiens
tggtcttgaactcct

SEQ ID NO: 13807 - DNA, 15 bp, Homo sapiens
ctggtcttgaactcc

SEQ ID NO: 13808 - DNA, 15 bp, Homo sapiens
taggctggtcttgaa

SEQ ID NO: 13809 - DNA, 15 bp, Homo sapiens
ctaggctggtcttga

SEQ ID NO: 13810 - DNA, 15 bp, Homo sapiens
gctaggctggtcttg

SEQ ID NO: 13811 - DNA, 15 bp, Homo sapiens
ggctaggctggtctt

SEQ ID NO: 13812 - DNA, 15 bp, Homo sapiens
attggctaggctggt

SEQ ID NO: 13813 - DNA, 15 bp, Homo sapiens
tattggctaggctgg

SEQ ID NO: 13814 - DNA, 15 bp, Homo sapiens
atattggctaggctg

SEQ ID NO: 13815 - DNA, 15 bp, Homo sapiens
tatattggctaggct

SEQ ID NO: 13816 - DNA, 15 bp, Homo sapiens
ctatattggctaggc

SEQ ID NO: 13817 - DNA, 15 bp, Homo sapiens
actatattggctagg

SEQ ID NO: 13818 - DNA, 15 bp, Homo sapiens
cactatattggctag

SEQ ID NO: 13819 - DNA, 15 bp, Homo sapiens
tcactatattggcta

SEQ ID NO: 13820 - DNA, 15 bp, Homo sapiens
ttcactatattggct

SEQ ID NO: 13821 - DNA, 15 bp, Homo sapiens
tttcactatattggc

SEQ ID NO: 13822 - DNA, 15 bp, Homo sapiens
gtttcactatattgg

SEQ ID NO: 13823 - DNA, 15 bp, Homo sapiens
ggtttcactatattg

SEQ ID NO: 13824 - DNA, 15 bp, Homo sapiens
gggtttcactatatt

SEQ ID NO: 13825 - DNA, 15 bp, Homo sapiens
ggggtttcactatat

SEQ ID NO: 13826 - DNA, 15 bp, Homo sapiens
tggggtttcactata

SEQ ID NO: 13827 - DNA, 15 bp, Homo sapiens
atggggtttcactat

SEQ ID NO: 13828 - DNA, 15 bp, Homo sapiens
gatggggtttcacta

SEQ ID NO: 13829 - DNA, 15 bp, Homo sapiens
agatggggtttcact

SEQ ID NO: 13830 - DNA, 15 bp, Homo sapiens
gagatggggtttcac

SEQ ID NO: 13831 - DNA, 15 bp, Homo sapiens
ggagatggggtttca

SEQ ID NO: 13832 - DNA, 15 bp, Homo sapiens
tggagatggggtttc

SEQ ID NO: 13833 - DNA, 15 bp, Homo sapiens
gtggagatggggttt

SEQ ID NO: 13834 - DNA, 15 bp, Homo sapiens
agtggagatggggtt

SEQ ID NO: 13835 - DNA, 15 bp, Homo sapiens
tagtggagatggggt

SEQ ID NO: 13836 - DNA, 15 bp, Homo sapiens
ttagtggagatgggg

SEQ ID NO: 13837 - DNA, 15 bp, Homo sapiens
tttagtggagatggg

SEQ ID NO: 13838 - DNA, 15 bp, Homo sapiens
ttttagtggagatgg

SEQ ID NO: 13839 - DNA, 15 bp, Homo sapiens
tttttagtggagatg

SEQ ID NO: 13840 - DNA, 15 bp, Homo sapiens
atttttagtggagat

SEQ ID NO: 13841 - DNA, 15 bp, Homo sapiens
cggctaatttttgta

SEQ ID NO: 13842 - DNA, 15 bp, Homo sapiens
ccggctaatttttgt

SEQ ID NO: 13843 - DNA, 15 bp, Homo sapiens
cccggctaatttttg

SEQ ID NO: 13844 - DNA, 15 bp, Homo sapiens
ttacaggcgcccgcc

SEQ ID NO: 13845 - DNA, 15 bp, Homo sapiens
attacaggcgcccgc

SEQ ID NO: 13846 - DNA, 15 bp, Homo sapiens
gattacaggcgcccg

SEQ ID NO: 13847 - DNA, 15 bp, Homo sapiens
ggattacaggcgccc

SEQ ID NO: 13848 - DNA, 15 bp, Homo sapiens
gggattacaggcgcc

SEQ ID NO: 13849 - DNA, 15 bp, Homo sapiens
tgggattacaggcgc

SEQ ID NO: 13850 - DNA, 15 bp, Homo sapiens
agctgggattacagg

SEQ ID NO: 13851 - DNA, 15 bp, Homo sapiens
tagctgggattacag

SEQ ID NO: 13852 - DNA, 15 bp, Homo sapiens
gtagctgggattaca

SEQ ID NO: 13853 - DNA, 15 bp, Homo sapiens
agtagctgggattac

SEQ ID NO: 13854 - DNA, 15 bp, Homo sapiens
gagtagctgggatta

SEQ ID NO: 13855 - DNA, 15 bp, Homo sapiens
cgagtagctgggatt

SEQ ID NO: 13856 - DNA, 15 bp, Homo sapiens
ccgagtagctgggat

SEQ ID NO: 13857 - DNA, 15 bp, Homo sapiens
aattctcctgcctca

SEQ ID NO: 13858 - DNA, 15 bp, Homo sapiens
caattctcctgcctc

SEQ ID NO: 13859 - DNA, 15 bp, Homo sapiens
gcaattctcctgcct

SEQ ID NO: 13860 - DNA, 15 bp, Homo sapiens
agcaattctcctgcc

SEQ ID NO: 13861 - DNA, 15 bp, Homo sapiens
aagcaattctcctgc

SEQ ID NO: 13862 - DNA, 15 bp, Homo sapiens
caagcaattctcctg

SEQ ID NO: 13863 - DNA, 15 bp, Homo sapiens
tcaagcaattctcct

SEQ ID NO: 13864 - DNA, 15 bp, Homo sapiens
ttcaagcaattctcc

SEQ ID NO: 13865 - DNA, 15 bp, Homo sapiens
gttcaagcaattctc

SEQ ID NO: 13866 - DNA, 15 bp, Homo sapiens
ggttcaagcaattct

SEQ ID NO: 13867 - DNA, 15 bp, Homo sapiens
tgggttcaagcaatt

SEQ ID NO: 13868 - DNA, 15 bp, Homo sapiens
ctgggttcaagcaat

SEQ ID NO: 13869 - DNA, 15 bp, Homo sapiens
cctgggttcaagcaa

SEQ ID NO: 13870 - DNA, 15 bp, Homo sapiens
tcctgggttcaagca

SEQ ID NO: 13871 - DNA, 15 bp, Homo sapiens
acctcctgggttcaa

SEQ ID NO: 13872 - DNA, 15 bp, Homo sapiens
cacctcctgggttca

SEQ ID NO: 13873 - DNA, 15 bp, Homo sapiens
ccacctcctgggttc

SEQ ID NO: 13874 - DNA, 15 bp, Homo sapiens
tccacctcctgggtt

SEQ ID NO: 13875 - DNA, 15 bp, Homo sapiens
ctccacctcctgggt

SEQ ID NO: 13876 - DNA, 15 bp, Homo sapiens
cctccacctcctggg

SEQ ID NO: 13877 - DNA, 15 bp, Homo sapiens
acctccacctcctgg

SEQ ID NO: 13878 - DNA, 15 bp, Homo sapiens
aacctccacctcctg

SEQ ID NO: 13879 - DNA, 15 bp, Homo sapiens
caacctccacctcct

SEQ ID NO: 13880 - DNA, 15 bp, Homo sapiens
gcaacctccacctcc

SEQ ID NO: 13881 - DNA, 15 bp, Homo sapiens
tgcaacctccacctc

SEQ ID NO: 13882 - DNA, 15 bp, Homo sapiens
ctgcaacctccacct

SEQ ID NO: 13883 - DNA, 15 bp, Homo sapiens
actgcaacctccacc

SEQ ID NO: 13884 - DNA, 15 bp, Homo sapiens
cactgcaacctccac

SEQ ID NO: 13885 - DNA, 15 bp, Homo sapiens
tcactgcaacctcca

SEQ ID NO: 13886 - DNA, 15 bp, Homo sapiens
tgctcactgcaacct

SEQ ID NO: 13887 - DNA, 15 bp, Homo sapiens
ctgctcactgcaacc

SEQ ID NO: 13888 - DNA, 15 bp, Homo sapiens
tctgctcactgcaac

SEQ ID NO: 13889 - DNA, 15 bp, Homo sapiens
ctctgctcactgcaa

SEQ ID NO: 13890 - DNA, 15 bp, Homo sapiens
tctctgctcactgca

SEQ ID NO: 13891 - DNA, 15 bp, Homo sapiens
atctctgctcactgc

SEQ ID NO: 13892 - DNA, 15 bp, Homo sapiens
gatctctgctcactg

SEQ ID NO: 13893 - DNA, 15 bp, Homo sapiens
cgatctctgctcact

SEQ ID NO: 13894 - DNA, 15 bp, Homo sapiens
tcgatctctgctcac

SEQ ID NO: 13895 - DNA, 15 bp, Homo sapiens
ctcgatctctgctca

SEQ ID NO: 13896 - DNA, 15 bp, Homo sapiens
gctcgatctctgctc

SEQ ID NO: 13897 - DNA, 15 bp, Homo sapiens
ggctcgatctctgct

SEQ ID NO: 13898 - DNA, 15 bp, Homo sapiens
tggctcgatctctgc

SEQ ID NO: 13899 - DNA, 15 bp, Homo sapiens
gtggctcgatctctg

SEQ ID NO: 13900 - DNA, 15 bp, Homo sapiens
agtggctcgatctct

SEQ ID NO: 13901 - DNA, 15 bp, Homo sapiens
cagtggctcgatctc

SEQ ID NO: 13902 - DNA, 15 bp, Homo sapiens
gcagtggctcgatct

SEQ ID NO: 13903 - DNA, 15 bp, Homo sapiens
tgcagtggctcgatc

SEQ ID NO: 13904 - DNA, 15 bp, Homo sapiens
gtgcagtggctcgat

SEQ ID NO: 13905 - DNA, 15 bp, Homo sapiens
agtgcagtggctcga

SEQ ID NO: 13906 - DNA, 15 bp, Homo sapiens
gagtgcagtggctcg

SEQ ID NO: 13907 - DNA, 15 bp, Homo sapiens
agagtgcagtggctc

SEQ ID NO: 13908 - DNA, 15 bp, Homo sapiens
tagagtgcagtggct

SEQ ID NO: 13909 - DNA, 15 bp, Homo sapiens
ctagagtgcagtggc

SEQ ID NO: 13910 - DNA, 15 bp, Homo sapiens
gctagagtgcagtgg

SEQ ID NO: 13911 - DNA, 15 bp, Homo sapiens
ggctagagtgcagtg

SEQ ID NO: 13912 - DNA, 15 bp, Homo sapiens
aggctagagtgcagt

SEQ ID NO: 13913 - DNA, 15 bp, Homo sapiens
taggctagagtgcag

SEQ ID NO: 13914 - DNA, 15 bp, Homo sapiens
ctaggctagagtgca

SEQ ID NO: 13915 - DNA, 15 bp, Homo sapiens
cctaggctagagtgc

SEQ ID NO: 13916 - DNA, 15 bp, Homo sapiens
acctaggctagagtg

SEQ ID NO: 13917 - DNA, 15 bp, Homo sapiens
cacctaggctagagt

SEQ ID NO: 13918 - DNA, 15 bp, Homo sapiens
tcacctaggctagag

SEQ ID NO: 13919 - DNA, 15 bp, Homo sapiens
gtcacctaggctaga

SEQ ID NO: 13920 - DNA, 15 bp, Homo sapiens
tgtcacctaggctag

SEQ ID NO: 13921 - DNA, 15 bp, Homo sapiens
ctgtcacctaggcta

SEQ ID NO: 13922 - DNA, 15 bp, Homo sapiens
tctgtcacctaggct

SEQ ID NO: 13923 - DNA, 15 bp, Homo sapiens
ctctgtcacctaggc

SEQ ID NO: 13924 - DNA, 15 bp, Homo sapiens
gctctgtcacctagg

SEQ ID NO: 13925 - DNA, 15 bp, Homo sapiens
cgctctgtcacctag

SEQ ID NO: 13926 - DNA, 15 bp, Homo sapiens
tcgctctgtcaccta

SEQ ID NO: 13927 - DNA, 15 bp, Homo sapiens
ctcgctctgtcacct

SEQ ID NO: 13928 - DNA, 15 bp, Homo sapiens
tctcgctctgtcacc

SEQ ID NO: 13929 - DNA, 15 bp, Homo sapiens
gtctcgctctgtcac

SEQ ID NO: 13930 - DNA, 15 bp, Homo sapiens
agtctcgctctgtca

SEQ ID NO: 13931 - DNA, 15 bp, Homo sapiens
gagtctcgctctgtc

SEQ ID NO: 13932 - DNA, 15 bp, Homo sapiens
agagtctcgctctgt

SEQ ID NO: 13933 - DNA, 15 bp, Homo sapiens
cagagtctcgctctg

SEQ ID NO: 13934 - DNA, 15 bp, Homo sapiens
acagagtctcgctct

SEQ ID NO: 13935 - DNA, 15 bp, Homo sapiens
gacagagtctcgctc

SEQ ID NO: 13936 - DNA, 15 bp, Homo sapiens
agacagagtctcgct

SEQ ID NO: 13937 - DNA, 15 bp, Homo sapiens
gagacagagtctcgc

SEQ ID NO: 13938 - DNA, 15 bp, Homo sapiens
tgagacagagtctcg

SEQ ID NO: 13939 - DNA, 15 bp, Homo sapiens
ttttgagacagagtc

SEQ ID NO: 13940 - DNA, 15 bp, Homo sapiens
tttttgagacagagt

SEQ ID NO: 13941 - DNA, 15 bp, Homo sapiens
ttttttgagacagag

SEQ ID NO: 13942 - DNA, 15 bp, Homo sapiens
tttttttgagacaga

SEQ ID NO: 13943 - DNA, 15 bp, Homo sapiens
atttttttgagacag

SEQ ID NO: 13944 - DNA, 15 bp, Homo sapiens
tatttttttgagaca

SEQ ID NO: 13945 - DNA, 15 bp, Homo sapiens
ttatttttttgagac

SEQ ID NO: 13946 - DNA, 15 bp, Homo sapiens
tttatttttttgaga

SEQ ID NO: 13947 - DNA, 15 bp, Homo sapiens
ttttatttttttgag

SEQ ID NO: 13948 - DNA, 15 bp, Homo sapiens
tttttatttttttga

SEQ ID NO: 13949 - DNA, 15 bp, Homo sapiens
atttttatttttttg

SEQ ID NO: 13950 - DNA, 15 bp, Homo sapiens
tatttttattttttt

SEQ ID NO: 13951 - DNA, 15 bp, Homo sapiens
tttatttttattttt

SEQ ID NO: 13952 - DNA, 15 bp, Homo sapiens
ctttatttttatttt

SEQ ID NO: 13953 - DNA, 15 bp, Homo sapiens
gctttatttttattt

SEQ ID NO: 13954 - DNA, 15 bp, Homo sapiens
tgctttatttttatt

SEQ ID NO: 13955 - DNA, 15 bp, Homo sapiens
atgctttatttttat

SEQ ID NO: 13956 - DNA, 15 bp, Homo sapiens
aatgctttattttta

SEQ ID NO: 13957 - DNA, 15 bp, Homo sapiens
taatgctttattttt

SEQ ID NO: 13958 - DNA, 15 bp, Homo sapiens
ttaatgctttatttt

SEQ ID NO: 13959 - DNA, 15 bp, Homo sapiens
tttaatgctttattt

SEQ ID NO: 13960 - DNA, 15 bp, Homo sapiens
ctttaatgctttatt

SEQ ID NO: 13961 - DNA, 15 bp, Homo sapiens
gctttaatgctttat

SEQ ID NO: 13962 - DNA, 15 bp, Homo sapiens
tgctttaatgcttta

SEQ ID NO: 13963 - DNA, 15 bp, Homo sapiens
gtgctttaatgcttt

SEQ ID NO: 13964 - DNA, 15 bp, Homo sapiens
agtgctttaatgctt

SEQ ID NO: 13965 - DNA, 15 bp, Homo sapiens
aagtgctttaatgct

SEQ ID NO: 13966 - DNA, 15 bp, Homo sapiens
aaagtgctttaatgc

SEQ ID NO: 13967 - DNA, 15 bp, Homo sapiens
caaagtgctttaatg

SEQ ID NO: 13968 - DNA, 15 bp, Homo sapiens
acaaagtgctttaat

SEQ ID NO: 13969 - DNA, 15 bp, Homo sapiens
gacaaagtgctttaa

SEQ ID NO: 13970 - DNA, 15 bp, Homo sapiens
agacaaagtgcttta

SEQ ID NO: 13971 - DNA, 15 bp, Homo sapiens
cagacaaagtgcttt

SEQ ID NO: 13972 - DNA, 15 bp, Homo sapiens
ccagacaaagtgctt

SEQ ID NO: 13973 - DNA, 15 bp, Homo sapiens
accagacaaagtgct

SEQ ID NO: 13974 - DNA, 15 bp, Homo sapiens
caccagacaaagtgc

SEQ ID NO: 13975 - DNA, 15 bp, Homo sapiens
ccaccagacaaagtg

SEQ ID NO: 13976 - DNA, 15 bp, Homo sapiens
accaccagacaaagt

SEQ ID NO: 13977 - DNA, 15 bp, Homo sapiens
taccaccagacaaag

SEQ ID NO: 13978 - DNA, 15 bp, Homo sapiens
ataccaccagacaaa

SEQ ID NO: 13979 - DNA, 15 bp, Homo sapiens
cataccaccagacaa

SEQ ID NO: 13980 - DNA, 15 bp, Homo sapiens
acataccaccagaca

SEQ ID NO: 13981 - DNA, 15 bp, Homo sapiens
tacataccaccagac

SEQ ID NO: 13982 - DNA, 15 bp, Homo sapiens
ttacataccaccaga

SEQ ID NO: 13983 - DNA, 15 bp, Homo sapiens
cttacataccaccag

SEQ ID NO: 13984 - DNA, 15 bp, Homo sapiens
acttacataccacca

SEQ ID NO: 13985 - DNA, 15 bp, Homo sapiens
aacttacataccacc

SEQ ID NO: 13986 - DNA, 15 bp, Homo sapiens
aaacttacataccac

SEQ ID NO: 13987 - DNA, 15 bp, Homo sapiens
aaaacttacatacca

SEQ ID NO: 13988 - DNA, 15 bp, Homo sapiens
caaaacttacatacc

SEQ ID NO: 13989 - DNA, 15 bp, Homo sapiens
ccaaaacttacatac

SEQ ID NO: 13990 - DNA, 15 bp, Homo sapiens
gccaaaacttacata

SEQ ID NO: 13991 - DNA, 15 bp, Homo sapiens
tgccaaaacttacat

SEQ ID NO: 13992 - DNA, 15 bp, Homo sapiens
atgccaaaacttaca

SEQ ID NO: 13993 - DNA, 15 bp, Homo sapiens
aatgccaaaacttac

SEQ ID NO: 13994 - DNA, 15 bp, Homo sapiens
taatgccaaaactta

SEQ ID NO: 13995 - DNA, 15 bp, Homo sapiens
gtaatgccaaaactt

SEQ ID NO: 13996 - DNA, 15 bp, Homo sapiens
agtaatgccaaaact

SEQ ID NO: 13997 - DNA, 15 bp, Homo sapiens
aagtaatgccaaaac

SEQ ID NO: 13998 - DNA, 15 bp, Homo sapiens
taagtaatgccaaaa

SEQ ID NO: 13999 - DNA, 15 bp, Homo sapiens
ctaagtaatgccaaa

SEQ ID NO: 14000 - DNA, 15 bp, Homo sapiens
tctaagtaatgccaa

SEQ ID NO: 14001 - DNA, 15 bp, Homo sapiens
atctaagtaatgcca

SEQ ID NO: 14002 - DNA, 15 bp, Homo sapiens
tatctaagtaatgcc

SEQ ID NO: 14003 - DNA, 15 bp, Homo sapiens
ttatctaagtaatgc

SEQ ID NO: 14004 - DNA, 15 bp, Homo sapiens
cttatctaagtaatg

SEQ ID NO: 14005 - DNA, 15 bp, Homo sapiens
acttatctaagtaat

SEQ ID NO: 14006 - DNA, 15 bp, Homo sapiens
aacttatctaagtaa

SEQ ID NO: 14007 - DNA, 15 bp, Homo sapiens
caacttatctaagta

SEQ ID NO: 14008 - DNA, 15 bp, Homo sapiens
acaacttatctaagt

SEQ ID NO: 14009 - DNA, 15 bp, Homo sapiens
tacaacttatctaag

SEQ ID NO: 14010 - DNA, 15 bp, Homo sapiens
atacaacttatctaa

SEQ ID NO: 14011 - DNA, 15 bp, Homo sapiens
aatacaacttatcta

SEQ ID NO: 14012 - DNA, 15 bp, Homo sapiens
aaatacaacttatct

SEQ ID NO: 14013 - DNA, 15 bp, Homo sapiens
aaaatacaacttatc

SEQ ID NO: 14014 - DNA, 15 bp, Homo sapiens
taaaatacaacttat

SEQ ID NO: 14015 - DNA, 15 bp, Homo sapiens
ttaaaatacaactta

SEQ ID NO: 14016 - DNA, 15 bp, Homo sapiens
cttaaaatacaactt

SEQ ID NO: 14017 - DNA, 15 bp, Homo sapiens
acttaaaatacaact

SEQ ID NO: 14018 - DNA, 15 bp, Homo sapiens
gacttaaaatacaac

SEQ ID NO: 14019 - DNA, 15 bp, Homo sapiens
agacttaaaatacaa

SEQ ID NO: 14020 - DNA, 15 bp, Homo sapiens
aagacttaaaataca

SEQ ID NO: 14021 - DNA, 15 bp, Homo sapiens
aaagacttaaaatac

SEQ ID NO: 14022 - DNA, 15 bp, Homo sapiens
gaaagacttaaaata

SEQ ID NO: 14023 - DNA, 15 bp, Homo sapiens
agaaagacttaaaat

SEQ ID NO: 14024 - DNA, 15 bp, Homo sapiens
tagaaagacttaaaa

SEQ ID NO: 14025 - DNA, 15 bp, Homo sapiens
gtagaaagacttaaa

SEQ ID NO: 14026 - DNA, 15 bp, Homo sapiens
tgtagaaagacttaa

SEQ ID NO: 14027 - DNA, 15 bp, Homo sapiens
gtgtagaaagactta

SEQ ID NO: 14028 - DNA, 15 bp, Homo sapiens
tgtgtagaaagactt

SEQ ID NO: 14029 - DNA, 15 bp, Homo sapiens
gtgtgtagaaagact

SEQ ID NO: 14030 - DNA, 15 bp, Homo sapiens
tgtgtgtagaaagac

SEQ ID NO: 14031 - DNA, 15 bp, Homo sapiens
ttgtgtgtagaaaga

SEQ ID NO: 14032 - DNA, 15 bp, Homo sapiens
attgtgtgtagaaag

SEQ ID NO: 14033 - DNA, 15 bp, Homo sapiens
tattgtgtgtagaaa

SEQ ID NO: 14034 - DNA, 15 bp, Homo sapiens
ttattgtgtgtagaa

SEQ ID NO: 14035 - DNA, 15 bp, Homo sapiens
gttattgtgtgtaga

SEQ ID NO: 14036 - DNA, 15 bp, Homo sapiens
agttattgtgtgtag

SEQ ID NO: 14037 - DNA, 15 bp, Homo sapiens
aagttattgtgtgta

SEQ ID NO: 14038 - DNA, 15 bp, Homo sapiens
taagttattgtgtgt

SEQ ID NO: 14039 - DNA, 15 bp, Homo sapiens
ataagttattgtgtg

SEQ ID NO: 14040 - DNA, 15 bp, Homo sapiens
aataagttattgtgt

SEQ ID NO: 14041 - DNA, 15 bp, Homo sapiens
aaataagttattgtg

SEQ ID NO: 14042 - DNA, 15 bp, Homo sapiens
aaaataagttattgt

SEQ ID NO: 14043 - DNA, 15 bp, Homo sapiens
aaaaataagttattg

SEQ ID NO: 14044 - DNA, 15 bp, Homo sapiens
taaaaataagttatt

SEQ ID NO: 14045 - DNA, 15 bp, Homo sapiens
ttaaaaataagttat

SEQ ID NO: 14046 - DNA, 15 bp, Homo sapiens
tttaaaaataagtta

SEQ ID NO: 14047 - DNA, 15 bp, Homo sapiens
ttttaaaaataagtt

SEQ ID NO: 14048 - DNA, 15 bp, Homo sapiens
attttaaaaataagt

SEQ ID NO: 14049 - DNA, 15 bp, Homo sapiens
tattttaaaaataag

SEQ ID NO: 14050 - DNA, 15 bp, Homo sapiens
gtattttaaaaataa

SEQ ID NO: 14051 - DNA, 15 bp, Homo sapiens
tgtattttaaaaata

SEQ ID NO: 14052 - DNA, 15 bp, Homo sapiens
ttgtattttaaaaat

SEQ ID NO: 14053 - DNA, 15 bp, Homo sapiens
cttgtattttaaaaa

SEQ ID NO: 14054 - DNA, 15 bp, Homo sapiens
acttgtattttaaaa

SEQ ID NO: 14055 - DNA, 15 bp, Homo sapiens
aacttgtattttaaa

SEQ ID NO: 14056 - DNA, 15 bp, Homo sapiens
aaacttgtattttaa

SEQ ID NO: 14057 - DNA, 15 bp, Homo sapiens
gaaacttgtatttta

SEQ ID NO: 14058 - DNA, 15 bp, Homo sapiens
agaaacttgtatttt

SEQ ID NO: 14059 - DNA, 15 bp, Homo sapiens
cagaaacttgtattt

SEQ ID NO: 14060 - DNA, 15 bp, Homo sapiens
acagaaacttgtatt

SEQ ID NO: 14061 - DNA, 15 bp, Homo sapiens
cacagaaacttgtat

SEQ ID NO: 14062 - DNA, 15 bp, Homo sapiens
acacagaaacttgta

SEQ ID NO: 14063 - DNA, 15 bp, Homo sapiens
tacacagaaacttgt

SEQ ID NO: 14064 - DNA, 15 bp, Homo sapiens
gtacacagaaacttg

SEQ ID NO: 14065 - DNA, 15 bp, Homo sapiens
agtacacagaaactt

SEQ ID NO: 14066 - DNA, 15 bp, Homo sapiens
aagtacacagaaact

SEQ ID NO: 14067 - DNA, 15 bp, Homo sapiens
gaagtacacagaaac

SEQ ID NO: 14068 - DNA, 15 bp, Homo sapiens
ggaagtacacagaaa

SEQ ID NO: 14069 - DNA, 15 bp, Homo sapiens
cggaagtacacagaa

SEQ ID NO: 14070 - DNA, 15 bp, Homo sapiens
ccggaagtacacaga

SEQ ID NO: 14071 - DNA, 15 bp, Homo sapiens
cccggaagtacacag

SEQ ID NO: 14072 - DNA, 15 bp, Homo sapiens
acccggaagtacaca

SEQ ID NO: 14073 - DNA, 15 bp, Homo sapiens
aacccggaagtacac

SEQ ID NO: 14074 - DNA, 15 bp, Homo sapiens
aaacccggaagtaca

SEQ ID NO: 14075 - DNA, 15 bp, Homo sapiens
aaaacccggaagtac

SEQ ID NO: 14076 - DNA, 15 bp, Homo sapiens
caaaacccggaagta

SEQ ID NO: 14077 - DNA, 15 bp, Homo sapiens
acaaaacccggaagt

SEQ ID NO: 14078 - DNA, 15 bp, Homo sapiens
cacaaaacccggaag

SEQ ID NO: 14079 - DNA, 15 bp, Homo sapiens
acacaaaacccggaa

SEQ ID NO: 14080 - DNA, 15 bp, Homo sapiens
aacacaaaacccgga

SEQ ID NO: 14081 - DNA, 15 bp, Homo sapiens
aaacacaaaacccgg

SEQ ID NO: 14082 - DNA, 15 bp, Homo sapiens
aaaacacaaaacccg

SEQ ID NO: 14083 - DNA, 15 bp, Homo sapiens
aaaaacacaaaaccc

SEQ ID NO: 14084 - DNA, 15 bp, Homo sapiens
caaaaacacaaaacc

SEQ ID NO: 14085 - DNA, 15 bp, Homo sapiens
acaaaaacacaaaac

SEQ ID NO: 14086 - DNA, 15 bp, Homo sapiens
tacaaaaacacaaaa

SEQ ID NO: 14087 - DNA, 15 bp, Homo sapiens
ttacaaaaacacaaa

SEQ ID NO: 14088 - DNA, 15 bp, Homo sapiens
tttacaaaaacacaa

SEQ ID NO: 14089 - DNA, 15 bp, Homo sapiens
gtttacaaaaacaca

SEQ ID NO: 14090 - DNA, 15 bp, Homo sapiens
tgtttacaaaaacac

SEQ ID NO: 14091 - DNA, 15 bp, Homo sapiens
ctgtttacaaaaaca

SEQ ID NO: 14092 - DNA, 15 bp, Homo sapiens
gctgtttacaaaaac

SEQ ID NO: 14093 - DNA, 15 bp, Homo sapiens
tgctgtttacaaaaa

SEQ ID NO: 14094 - DNA, 15 bp, Homo sapiens
ctgctgtttacaaaa

SEQ ID NO: 14095 - DNA, 15 bp, Homo sapiens
tctgctgtttacaaa

SEQ ID NO: 14096 - DNA, 15 bp, Homo sapiens
ttctgctgtttacaa

SEQ ID NO: 14097 - DNA, 15 bp, Homo sapiens
cttctgctgtttaca

SEQ ID NO: 14098 - DNA, 15 bp, Homo sapiens
ccttctgctgtttac

SEQ ID NO: 14099 - DNA, 15 bp, Homo sapiens
accttctgctgttta

SEQ ID NO: 14100 - DNA, 15 bp, Homo sapiens
taccttctgctgttt

SEQ ID NO: 14101 - DNA, 15 bp, Homo sapiens
ataccttctgctgtt

SEQ ID NO: 14102 - DNA, 15 bp, Homo sapiens
aataccttctgctgt

SEQ ID NO: 14103 - DNA, 15 bp, Homo sapiens
taataccttctgctg

SEQ ID NO: 14104 - DNA, 15 bp, Homo sapiens
ctaataccttctgct

SEQ ID NO: 14105 - DNA, 15 bp, Homo sapiens
actaataccttctgc

SEQ ID NO: 14106 - DNA, 15 bp, Homo sapiens
gactaataccttctg

SEQ ID NO: 14107 - DNA, 15 bp, Homo sapiens
ggactaataccttct

SEQ ID NO: 14108 - DNA, 15 bp, Homo sapiens
tggactaataccttc

SEQ ID NO: 14109 - DNA, 15 bp, Homo sapiens
atggactaatacctt

SEQ ID NO: 14110 - DNA, 15 bp, Homo sapiens
tatggactaatacct

SEQ ID NO: 14111 - DNA, 15 bp, Homo sapiens
atatggactaatacc

SEQ ID NO: 14112 - DNA, 15 bp, Homo sapiens
aatatggactaatac

SEQ ID NO: 14113 - DNA, 15 bp, Homo sapiens
taatatggactaata

SEQ ID NO: 14114 - DNA, 15 bp, Homo sapiens
ttaatatggactaat

SEQ ID NO: 14115 - DNA, 15 bp, Homo sapiens
cttaatatggactaa

SEQ ID NO: 14116 - DNA, 15 bp, Homo sapiens
acttaatatggacta

SEQ ID NO: 14117 - DNA, 15 bp, Homo sapiens
tacttaatatggact

SEQ ID NO: 14118 - DNA, 15 bp, Homo sapiens
gtacttaatatggac

SEQ ID NO: 14119 - DNA, 15 bp, Homo sapiens
agtacttaatatgga

SEQ ID NO: 14120 - DNA, 15 bp, Homo sapiens
tagtacttaatatgg

SEQ ID NO: 14121 - DNA, 15 bp, Homo sapiens
ttagtacttaatatg

SEQ ID NO: 14122 - DNA, 15 bp, Homo sapiens
attagtacttaatat

SEQ ID NO: 14123 - DNA, 15 bp, Homo sapiens
aattagtacttaata

SEQ ID NO: 14124 - DNA, 15 bp, Homo sapiens
aaattagtacttaat

SEQ ID NO: 14125 - DNA, 15 bp, Homo sapiens
caaattagtacttaa

SEQ ID NO: 14126 - DNA, 15 bp, Homo sapiens
acaaattagtactta

SEQ ID NO: 14127 - DNA, 15 bp, Homo sapiens
aacaaattagtactt

SEQ ID NO: 14128 - DNA, 15 bp, Homo sapiens
gaacaaattagtact

SEQ ID NO: 14129 - DNA, 15 bp, Homo sapiens
agaacaaattagtac

SEQ ID NO: 14130 - DNA, 15 bp, Homo sapiens
tagaacaaattagta

SEQ ID NO: 14131 - DNA, 15 bp, Homo sapiens
ttagaacaaattagt

SEQ ID NO: 14132 - DNA, 15 bp, Homo sapiens
attagaacaaattag

SEQ ID NO: 14133 - DNA, 15 bp, Homo sapiens
tattagaacaaatta

SEQ ID NO: 14134 - DNA, 15 bp, Homo sapiens
atattagaacaaatt

SEQ ID NO: 14135 - DNA, 15 bp, Homo sapiens
aatattagaacaaat

SEQ ID NO: 14136 - DNA, 15 bp, Homo sapiens
aaatattagaacaaa

SEQ ID NO: 14137 - DNA, 15 bp, Homo sapiens
aaaatattagaacaa

SEQ ID NO: 14138 - DNA, 15 bp, Homo sapiens
gaaaatattagaaca

SEQ ID NO: 14139 - DNA, 15 bp, Homo sapiens
tgaaaatattagaac

SEQ ID NO: 14140 - DNA, 15 bp, Homo sapiens
ctgaaaatattagaa

SEQ ID NO: 14141 - DNA, 15 bp, Homo sapiens
gctgaaaatattaga

SEQ ID NO: 14142 - DNA, 15 bp, Homo sapiens
agctgaaaatattag

SEQ ID NO: 14143 - DNA, 15 bp, Homo sapiens
cagctgaaaatatta

SEQ ID NO: 14144 - DNA, 15 bp, Homo sapiens
acagctgaaaatatt

SEQ ID NO: 14145 - DNA, 15 bp, Homo sapiens
aacagctgaaaatat

SEQ ID NO: 14146 - DNA, 15 bp, Homo sapiens
aaacagctgaaaata

SEQ ID NO: 14147 - DNA, 15 bp, Homo sapiens
aaaacagctgaaaat

SEQ ID NO: 14148 - DNA, 15 bp, Homo sapiens
aaaaacagctgaaaa

SEQ ID NO: 14149 - DNA, 15 bp, Homo sapiens
caaaaacagctgaaa

SEQ ID NO: 14150 - DNA, 15 bp, Homo sapiens
ccaaaaacagctgaa

SEQ ID NO: 14151 - DNA, 15 bp, Homo sapiens
tccaaaaacagctga

SEQ ID NO: 14152 - DNA, 15 bp, Homo sapiens
ttccaaaaacagctg

SEQ ID NO: 14153 - DNA, 15 bp, Homo sapiens
attccaaaaacagct

SEQ ID NO: 14154 - DNA, 15 bp, Homo sapiens
aattccaaaaacagc

SEQ ID NO: 14155 - DNA, 15 bp, Homo sapiens
taattccaaaaacag

SEQ ID NO: 14156 - DNA, 15 bp, Homo sapiens
gtaattccaaaaaca

SEQ ID NO: 14157 - DNA, 15 bp, Homo sapiens
tgtaattccaaaaac

SEQ ID NO: 14158 - DNA, 15 bp, Homo sapiens
gtgtaattccaaaaa

SEQ ID NO: 14159 - DNA, 15 bp, Homo sapiens
agtgtaattccaaaa

SEQ ID NO: 14160 - DNA, 15 bp, Homo sapiens
aagtgtaattccaaa

SEQ ID NO: 14161 - DNA, 15 bp, Homo sapiens
caagtgtaattccaa

SEQ ID NO: 14162 - DNA, 15 bp, Homo sapiens
ccaagtgtaattcca

SEQ ID NO: 14163 - DNA, 15 bp, Homo sapiens
gccaagtgtaattcc

SEQ ID NO: 14164 - DNA, 15 bp, Homo sapiens
tgccaagtgtaattc

SEQ ID NO: 14165 - DNA, 15 bp, Homo sapiens
ttgccaagtgtaatt

SEQ ID NO: 14166 - DNA, 15 bp, Homo sapiens
tttgccaagtgtaat

SEQ ID NO: 14167 - DNA, 15 bp, Homo sapiens
ttttgccaagtgtaa

SEQ ID NO: 14168 - DNA, 15 bp, Homo sapiens
tttttgccaagtgta

SEQ ID NO: 14169 - DNA, 15 bp, Homo sapiens
ttttttgccaagtgt

SEQ ID NO: 14170 - DNA, 15 bp, Homo sapiens
tttttttgccaagtg

SEQ ID NO: 14171 - DNA, 15 bp, Homo sapiens
atttttttgccaagt

SEQ ID NO: 14172 - DNA, 15 bp, Homo sapiens
tatttttttgccaag

SEQ ID NO: 14173 - DNA, 15 bp, Homo sapiens
ctatttttttgccaa

SEQ ID NO: 14174 - DNA, 15 bp, Homo sapiens
tctatttttttgcca

SEQ ID NO: 14175 - DNA, 15 bp, Homo sapiens
gtctatttttttgcc

SEQ ID NO: 14176 - DNA, 15 bp, Homo sapiens
tgtctatttttttgc

SEQ ID NO: 14177 - DNA, 15 bp, Homo sapiens
ttgtctatttttttg

SEQ ID NO: 14178 - DNA, 15 bp, Homo sapiens
tttgtctattttttt

SEQ ID NO: 14179 - DNA, 15 bp, Homo sapiens
atttgtctatttttt

SEQ ID NO: 14180 - DNA, 15 bp, Homo sapiens
catttgtctattttt

SEQ ID NO: 14181 - DNA, 15 bp, Homo sapiens
acatttgtctatttt

SEQ ID NO: 14182 - DNA, 15 bp, Homo sapiens
gacatttgtctattt

SEQ ID NO: 14183 - DNA, 15 bp, Homo sapiens
agacatttgtctatt

SEQ ID NO: 14184 - DNA, 15 bp, Homo sapiens
cagacatttgtctat

SEQ ID NO: 14185 - DNA, 15 bp, Homo sapiens
gcagacatttgtcta

SEQ ID NO: 14186 - DNA, 15 bp, Homo sapiens
tgcagacatttgtct

SEQ ID NO: 14187 - DNA, 15 bp, Homo sapiens
ctgcagacatttgtc

SEQ ID NO: 14188 - DNA, 15 bp, Homo sapiens
actgcagacatttgt

SEQ ID NO: 14189 - DNA, 15 bp, Homo sapiens
aactgcagacatttg

SEQ ID NO: 14190 - DNA, 15 bp, Homo sapiens
caactgcagacattt

SEQ ID NO: 14191 - DNA, 15 bp, Homo sapiens
acaactgcagacatt

SEQ ID NO: 14192 - DNA, 15 bp, Homo sapiens
cacaactgcagacat

SEQ ID NO: 14193 - DNA, 15 bp, Homo sapiens
tcacaactgcagaca

SEQ ID NO: 14194 - DNA, 15 bp, Homo sapiens
gtcacaactgcagac

SEQ ID NO: 14195 - DNA, 15 bp, Homo sapiens
tgtcacaactgcaga

SEQ ID NO: 14196 - DNA, 15 bp, Homo sapiens
ctgtcacaactgcag

SEQ ID NO: 14197 - DNA, 15 bp, Homo sapiens
actgtcacaactgca

SEQ ID NO: 14198 - DNA, 15 bp, Homo sapiens
aactgtcacaactgc

SEQ ID NO: 14199 - DNA, 15 bp, Homo sapiens
aaactgtcacaactg

SEQ ID NO: 14200 - DNA, 15 bp, Homo sapiens
caaactgtcacaact

SEQ ID NO: 14201 - DNA, 15 bp, Homo sapiens
acaaactgtcacaac

SEQ ID NO: 14202 - DNA, 15 bp, Homo sapiens
aacaaactgtcacaa

SEQ ID NO: 14203 - DNA, 15 bp, Homo sapiens
aaacaaactgtcaca

SEQ ID NO: 14204 - DNA, 15 bp, Homo sapiens
aaaacaaactgtcac

SEQ ID NO: 14205 - DNA, 15 bp, Homo sapiens
aaaaacaaactgtca

SEQ ID NO: 14206 - DNA, 15 bp, Homo sapiens
aaaaaacaaactgtc

SEQ ID NO: 14207 - DNA, 15 bp, Homo sapiens
aaaaaaacaaactgt

SEQ ID NO: 14208 - DNA, 15 bp, Homo sapiens
caaaaaaacaaactg

SEQ ID NO: 14209 - DNA, 15 bp, Homo sapiens
acaaaaaaacaaact

SEQ ID NO: 14210 - DNA, 15 bp, Homo sapiens
aacaaaaaaacaaac

SEQ ID NO: 14211 - DNA, 15 bp, Homo sapiens
gaacaaaaaaacaaa

SEQ ID NO: 14212 - DNA, 15 bp, Homo sapiens
agaacaaaaaaacaa

SEQ ID NO: 14213 - DNA, 15 bp, Homo sapiens
aagaacaaaaaaaca

SEQ ID NO: 14214 - DNA, 15 bp, Homo sapiens
aaagaacaaaaaaac

SEQ ID NO: 14215 - DNA, 15 bp, Homo sapiens
aaaagaacaaaaaaa

SEQ ID NO: 14216 - DNA, 15 bp, Homo sapiens
aaaaagaacaaaaaa

SEQ ID NO: 14217 - DNA, 15 bp, Homo sapiens
taaaaagaacaaaaa

SEQ ID NO: 14218 - DNA, 15 bp, Homo sapiens
ttaaaaagaacaaaa

SEQ ID NO: 14219 - DNA, 15 bp, Homo sapiens
gttaaaaagaacaaa

SEQ ID NO: 14220 - DNA, 15 bp, Homo sapiens
agttaaaaagaacaa

SEQ ID NO: 14221 - DNA, 15 bp, Homo sapiens
gagttaaaaagaaca

SEQ ID NO: 14222 - DNA, 15 bp, Homo sapiens
ggagttaaaaagaac

SEQ ID NO: 14223 - DNA, 15 bp, Homo sapiens
tggagttaaaaagaa

SEQ ID NO: 14224 - DNA, 15 bp, Homo sapiens
ctggagttaaaaaga

SEQ ID NO: 14225 - DNA, 15 bp, Homo sapiens
tctggagttaaaaag

SEQ ID NO: 14226 - DNA, 15 bp, Homo sapiens
ttctggagttaaaaa

SEQ ID NO: 14227 - DNA, 15 bp, Homo sapiens
attctggagttaaaa

SEQ ID NO: 14228 - DNA, 15 bp, Homo sapiens
tattctggagttaaa

SEQ ID NO: 14229 - DNA, 15 bp, Homo sapiens
ttattctggagttaa

SEQ ID NO: 14230 - DNA, 15 bp, Homo sapiens
tttattctggagtta

SEQ ID NO: 14231 - DNA, 15 bp, Homo sapiens
atttattctggagtt

SEQ ID NO: 14232 - DNA, 15 bp, Homo sapiens
tatttattctggagt

SEQ ID NO: 14233 - DNA, 15 bp, Homo sapiens
ttatttattctggag

SEQ ID NO: 14234 - DNA, 15 bp, Homo sapiens
attatttattctgga

SEQ ID NO: 14235 - DNA, 15 bp, Homo sapiens
aattatttattctgg

SEQ ID NO: 14236 - DNA, 15 bp, Homo sapiens
gaattatttattctg

SEQ ID NO: 14237 - DNA, 15 bp, Homo sapiens
agaattatttattct

SEQ ID NO: 14238 - DNA, 15 bp, Homo sapiens
tagaattatttattc

SEQ ID NO: 14239 - DNA, 15 bp, Homo sapiens
ctagaattatttatt

SEQ ID NO: 14240 - DNA, 15 bp, Homo sapiens
actagaattatttat

SEQ ID NO: 14241 - DNA, 15 bp, Homo sapiens
cactagaattattta

SEQ ID NO: 14242 - DNA, 15 bp, Homo sapiens
tcactagaattattt

SEQ ID NO: 14243 - DNA, 15 bp, Homo sapiens
ctcactagaattatt

SEQ ID NO: 14244 - DNA, 15 bp, Homo sapiens
actcactagaattat

SEQ ID NO: 14245 - DNA, 15 bp, Homo sapiens
aactcactagaatta

SEQ ID NO: 14246 - DNA, 15 bp, Homo sapiens
aaactcactagaatt

SEQ ID NO: 14247 - DNA, 15 bp, Homo sapiens
aaaactcactagaat

SEQ ID NO: 14248 - DNA, 15 bp, Homo sapiens
aaaaactcactagaa

SEQ ID NO: 14249 - DNA, 15 bp, Homo sapiens
aaaaaactcactaga

SEQ ID NO: 14250 - DNA, 15 bp, Homo sapiens
aaaaaaactcactag

SEQ ID NO: 14251 - DNA, 15 bp, Homo sapiens
gaaaaaaactcacta

SEQ ID NO: 14252 - DNA, 15 bp, Homo sapiens
agaaaaaaactcact

SEQ ID NO: 14253 - DNA, 15 bp, Homo sapiens
aagaaaaaaactcac

SEQ ID NO: 14254 - DNA, 15 bp, Homo sapiens
caagaaaaaaactca

SEQ ID NO: 14255 - DNA, 15 bp, Homo sapiens
ccaagaaaaaaactc

SEQ ID NO: 14256 - DNA, 15 bp, Homo sapiens
gccaagaaaaaaact

SEQ ID NO: 14257 - DNA, 15 bp, Homo sapiens
agccaagaaaaaaac

SEQ ID NO: 14258 - DNA, 15 bp, Homo sapiens
aagccaagaaaaaaa

SEQ ID NO: 14259 - DNA, 15 bp, Homo sapiens
caagccaagaaaaaa

SEQ ID NO: 14260 - DNA, 15 bp, Homo sapiens
acaagccaagaaaaa

SEQ ID NO: 14261 - DNA, 15 bp, Homo sapiens
tacaagccaagaaaa

SEQ ID NO: 14262 - DNA, 15 bp, Homo sapiens
ttacaagccaagaaa

SEQ ID NO: 14263 - DNA, 15 bp, Homo sapiens
cttacaagccaagaa

SEQ ID NO: 14264 - DNA, 15 bp, Homo sapiens
tcttacaagccaaga

SEQ ID NO: 14265 - DNA, 15 bp, Homo sapiens
ttcttacaagccaag

SEQ ID NO: 14266 - DNA, 15 bp, Homo sapiens
gttcttacaagccaa

SEQ ID NO: 14267 - DNA, 15 bp, Homo sapiens
tgttcttacaagcca

SEQ ID NO: 14268 - DNA, 15 bp, Homo sapiens
atgttcttacaagcc

SEQ ID NO: 14269 - DNA, 15 bp, Homo sapiens
catgttcttacaagc

SEQ ID NO: 14270 - DNA, 15 bp, Homo sapiens
ccatgttcttacaag

SEQ ID NO: 14271 - DNA, 15 bp, Homo sapiens
cccatgttcttacaa

SEQ ID NO: 14272 - DNA, 15 bp, Homo sapiens
tcccatgttcttaca

SEQ ID NO: 14273 - DNA, 15 bp, Homo sapiens
ttcccatgttcttac

SEQ ID NO: 14274 - DNA, 15 bp, Homo sapiens
attcccatgttctta

SEQ ID NO: 14275 - DNA, 15 bp, Homo sapiens
cattcccatgttctt

SEQ ID NO: 14276 - DNA, 15 bp, Homo sapiens
tcattcccatgttct

SEQ ID NO: 14277 - DNA, 15 bp, Homo sapiens
atcattcccatgttc

SEQ ID NO: 14278 - DNA, 15 bp, Homo sapiens
aatcattcccatgtt

SEQ ID NO: 14279 - DNA, 15 bp, Homo sapiens
taatcattcccatgt

SEQ ID NO: 14280 - DNA, 15 bp, Homo sapiens
ctaatcattcccatg

SEQ ID NO: 14281 - DNA, 15 bp, Homo sapiens
tctaatcattcccat

SEQ ID NO: 14282 - DNA, 15 bp, Homo sapiens
ctctaatcattccca

SEQ ID NO: 14283 - DNA, 15 bp, Homo sapiens
actctaatcattccc

SEQ ID NO: 14284 - DNA, 15 bp, Homo sapiens
gactctaatcattcc

SEQ ID NO: 14285 - DNA, 15 bp, Homo sapiens
tgactctaatcattc

SEQ ID NO: 14286 - DNA, 15 bp, Homo sapiens
atgactctaatcatt

SEQ ID NO: 14287 - DNA, 15 bp, Homo sapiens
gatgactctaatcat

SEQ ID NO: 14288 - DNA, 15 bp, Homo sapiens
tgatgactctaatca

SEQ ID NO: 14289 - DNA, 15 bp, Homo sapiens
atgatgactctaatc

SEQ ID NO: 14290 - DNA, 15 bp, Homo sapiens
tatgatgactctaat

SEQ ID NO: 14291 - DNA, 15 bp, Homo sapiens
ttatgatgactctaa

SEQ ID NO: 14292 - DNA, 15 bp, Homo sapiens
gttatgatgactcta

SEQ ID NO: 14293 - DNA, 15 bp, Homo sapiens
tgttatgatgactct

SEQ ID NO: 14294 - DNA, 15 bp, Homo sapiens
gtgttatgatgactc

SEQ ID NO: 14295 - DNA, 15 bp, Homo sapiens
agtgttatgatgact

SEQ ID NO: 14296 - DNA, 15 bp, Homo sapiens
aagtgttatgatgac

SEQ ID NO: 14297 - DNA, 15 bp, Homo sapiens
taagtgttatgatga

SEQ ID NO: 14298 - DNA, 15 bp, Homo sapiens
ttaagtgttatgatg

SEQ ID NO: 14299 - DNA, 15 bp, Homo sapiens
cttaagtgttatgat

SEQ ID NO: 14300 - DNA, 15 bp, Homo sapiens
acttaagtgttatga

SEQ ID NO: 14301 - DNA, 15 bp, Homo sapiens
tacttaagtgttatg

SEQ ID NO: 14302 - DNA, 15 bp, Homo sapiens
ctacttaagtgttat

SEQ ID NO: 14303 - DNA, 15 bp, Homo sapiens
actacttaagtgtta

SEQ ID NO: 14304 - DNA, 15 bp, Homo sapiens
aactacttaagtgtt

SEQ ID NO: 14305 - DNA, 15 bp, Homo sapiens
taactacttaagtgt

SEQ ID NO: 14306 - DNA, 15 bp, Homo sapiens
ataactacttaagtg

SEQ ID NO: 14307 - DNA, 15 bp, Homo sapiens
tataactacttaagt

SEQ ID NO: 14308 - DNA, 15 bp, Homo sapiens
ctataactacttaag

SEQ ID NO: 14309 - DNA, 15 bp, Homo sapiens
tctataactacttaa

SEQ ID NO: 14310 - DNA, 15 bp, Homo sapiens
ttctataactactta

SEQ ID NO: 14311 - DNA, 15 bp, Homo sapiens
cttctataactactt

SEQ ID NO: 14312 - DNA, 15 bp, Homo sapiens
ccttctataactact

SEQ ID NO: 14313 - DNA, 15 bp, Homo sapiens
accttctataactac

SEQ ID NO: 14314 - DNA, 15 bp, Homo sapiens
aaccttctataacta

SEQ ID NO: 14315 - DNA, 15 bp, Homo sapiens
caaccttctataact

SEQ ID NO: 14316 - DNA, 15 bp, Homo sapiens
tcaaccttctataac

SEQ ID NO: 14317 - DNA, 15 bp, Homo sapiens
ttcaaccttctataa

SEQ ID NO: 14318 - DNA, 15 bp, Homo sapiens
gttcaaccttctata

SEQ ID NO: 14319 - DNA, 15 bp, Homo sapiens
tgttcaaccttctat

SEQ ID NO: 14320 - DNA, 15 bp, Homo sapiens
atgttcaaccttcta

SEQ ID NO: 14321 - DNA, 15 bp, Homo sapiens
gatgttcaaccttct

SEQ ID NO: 14322 - DNA, 15 bp, Homo sapiens
agatgttcaaccttc

SEQ ID NO: 14323 - DNA, 15 bp, Homo sapiens
cagatgttcaacctt

SEQ ID NO: 14324 - DNA, 15 bp, Homo sapiens
acagatgttcaacct

SEQ ID NO: 14325 - DNA, 15 bp, Homo sapiens
tacagatgttcaacc

SEQ ID NO: 14326 - DNA, 15 bp, Homo sapiens
ctacagatgttcaac

SEQ ID NO: 14327 - DNA, 15 bp, Homo sapiens
actacagatgttcaa

SEQ ID NO: 14328 - DNA, 15 bp, Homo sapiens
gactacagatgttca

SEQ ID NO: 14329 - DNA, 15 bp, Homo sapiens
tgactacagatgttc

SEQ ID NO: 14330 - DNA, 15 bp, Homo sapiens
ctgactacagatgtt

SEQ ID NO: 14331 - DNA, 15 bp, Homo sapiens
actgactacagatgt

SEQ ID NO: 14332 - DNA, 15 bp, Homo sapiens
aactgactacagatg

SEQ ID NO: 14333 - DNA, 15 bp, Homo sapiens
caactgactacagat

SEQ ID NO: 14334 - DNA, 15 bp, Homo sapiens
acaactgactacaga

SEQ ID NO: 14335 - DNA, 15 bp, Homo sapiens
tacaactgactacag

SEQ ID NO: 14336 - DNA, 15 bp, Homo sapiens
atacaactgactaca

SEQ ID NO: 14337 - DNA, 15 bp, Homo sapiens
tatacaactgactac

SEQ ID NO: 14338 - DNA, 15 bp, Homo sapiens
ttatacaactgacta

SEQ ID NO: 14339 - DNA, 15 bp, Homo sapiens
tttatacaactgact

SEQ ID NO: 14340 - DNA, 15 bp, Homo sapiens
ttttatacaactgac

SEQ ID NO: 14341 - DNA, 15 bp, Homo sapiens
attttatacaactga

SEQ ID NO: 14342 - DNA, 15 bp, Homo sapiens
aattttatacaactg

SEQ ID NO: 14343 - DNA, 15 bp, Homo sapiens
aaattttatacaact

SEQ ID NO: 14344 - DNA, 15 bp, Homo sapiens
gaaattttatacaac

SEQ ID NO: 14345 - DNA, 15 bp, Homo sapiens
ggaaattttatacaa

SEQ ID NO: 14346 - DNA, 15 bp, Homo sapiens
aggaaattttataca

SEQ ID NO: 14347 - DNA, 15 bp, Homo sapiens
taggaaattttatac

SEQ ID NO: 14348 - DNA, 15 bp, Homo sapiens
ctaggaaattttata

SEQ ID NO: 14349 - DNA, 15 bp, Homo sapiens
actaggaaattttat

SEQ ID NO: 14350 - DNA, 15 bp, Homo sapiens
gactaggaaatttta

SEQ ID NO: 14351 - DNA, 15 bp, Homo sapiens
tgactaggaaatttt

SEQ ID NO: 14352 - DNA, 15 bp, Homo sapiens
atgactaggaaattt

SEQ ID NO: 14353 - DNA, 15 bp, Homo sapiens
gatgactaggaaatt

SEQ ID NO: 14354 - DNA, 15 bp, Homo sapiens
ggatgactaggaaat

SEQ ID NO: 14355 - DNA, 15 bp, Homo sapiens
aggatgactaggaaa

SEQ ID NO: 14356 - DNA, 15 bp, Homo sapiens
aaggatgactaggaa

SEQ ID NO: 14357 - DNA, 15 bp, Homo sapiens
gaaggatgactagga

SEQ ID NO: 14358 - DNA, 15 bp, Homo sapiens
ggaaggatgactagg

SEQ ID NO: 14359 - DNA, 15 bp, Homo sapiens
tggaaggatgactag

SEQ ID NO: 14360 - DNA, 15 bp, Homo sapiens
ctggaaggatgacta

SEQ ID NO: 14361 - DNA, 15 bp, Homo sapiens
cctggaaggatgact

SEQ ID NO: 14362 - DNA, 15 bp, Homo sapiens
acctggaaggatgac

SEQ ID NO: 14363 - DNA, 15 bp, Homo sapiens
aacctggaaggatga

SEQ ID NO: 14364 - DNA, 15 bp, Homo sapiens
caacctggaaggatg

SEQ ID NO: 14365 - DNA, 15 bp, Homo sapiens
acaacctggaaggat

SEQ ID NO: 14366 - DNA, 15 bp, Homo sapiens
aacaacctggaagga

SEQ ID NO: 14367 - DNA, 15 bp, Homo sapiens
aaacaacctggaagg

SEQ ID NO: 14368 - DNA, 15 bp, Homo sapiens
taaacaacctggaag

SEQ ID NO: 14369 - DNA, 15 bp, Homo sapiens
ttaaacaacctggaa

SEQ ID NO: 14370 - DNA, 15 bp, Homo sapiens
cttaaacaacctgga

SEQ ID NO: 14371 - DNA, 15 bp, Homo sapiens
tcttaaacaacctgg

SEQ ID NO: 14372 - DNA, 15 bp, Homo sapiens
gtcttaaacaacctg

SEQ ID NO: 14373 - DNA, 15 bp, Homo sapiens
tgtcttaaacaacct

SEQ ID NO: 14374 - DNA, 15 bp, Homo sapiens
ttgtcttaaacaacc

SEQ ID NO: 14375 - DNA, 15 bp, Homo sapiens
tttgtcttaaacaac

SEQ ID NO: 14376 - DNA, 15 bp, Homo sapiens
gtttgtcttaaacaa

SEQ ID NO: 14377 - DNA, 15 bp, Homo sapiens
tgtttgtcttaaaca

SEQ ID NO: 14378 - DNA, 15 bp, Homo sapiens
ttgtttgtcttaaac

SEQ ID NO: 14379 - DNA, 15 bp, Homo sapiens
tttgtttgtcttaaa

SEQ ID NO: 14380 - DNA, 15 bp, Homo sapiens
atttgtttgtcttaa

SEQ ID NO: 14381 - DNA, 15 bp, Homo sapiens
tatttgtttgtctta

SEQ ID NO: 14382 - DNA, 15 bp, Homo sapiens
gtatttgtttgtctt

SEQ ID NO: 14383 - DNA, 15 bp, Homo sapiens
tgtatttgtttgtct

SEQ ID NO: 14384 - DNA, 15 bp, Homo sapiens
atgtatttgtttgtc

SEQ ID NO: 14385 - DNA, 15 bp, Homo sapiens
tatgtatttgtttgt

SEQ ID NO: 14386 - DNA, 15 bp, Homo sapiens
ctatgtatttgtttg

SEQ ID NO: 14387 - DNA, 15 bp, Homo sapiens
actatgtatttgttt

SEQ ID NO: 14388 - DNA, 15 bp, Homo sapiens
tactatgtatttgtt

SEQ ID NO: 14389 - DNA, 15 bp, Homo sapiens
atactatgtatttgt

SEQ ID NO: 14390 - DNA, 15 bp, Homo sapiens
aatactatgtatttg

SEQ ID NO: 14391 - DNA, 15 bp, Homo sapiens
aaatactatgtattt

SEQ ID NO: 14392 - DNA, 15 bp, Homo sapiens
taaatactatgtatt

SEQ ID NO: 14393 - DNA, 15 bp, Homo sapiens
ataaatactatgtat

SEQ ID NO: 14394 - DNA, 15 bp, Homo sapiens
aataaatactatgta

SEQ ID NO: 14395 - DNA, 15 bp, Homo sapiens
taataaatactatgt

SEQ ID NO: 14396 - DNA, 15 bp, Homo sapiens
ttaataaatactatg

SEQ ID NO: 14397 - DNA, 15 bp, Homo sapiens
cttaataaatactat

SEQ ID NO: 14398 - DNA, 15 bp, Homo sapiens
gcttaataaatacta

SEQ ID NO: 14399 - DNA, 15 bp, Homo sapiens
agcttaataaatact

SEQ ID NO: 14400 - DNA, 15 bp, Homo sapiens
gagcttaataaatac

SEQ ID NO: 14401 - DNA, 15 bp, Homo sapiens
agagcttaataaata

SEQ ID NO: 14402 - DNA, 15 bp, Homo sapiens
aagagcttaataaat

SEQ ID NO: 14403 - DNA, 15 bp, Homo sapiens
taagagcttaataaa

SEQ ID NO: 14404 - DNA, 15 bp, Homo sapiens
ataagagcttaataa

SEQ ID NO: 14405 - DNA, 15 bp, Homo sapiens
tataagagcttaata

SEQ ID NO: 14406 - DNA, 15 bp, Homo sapiens
ttataagagcttaat

SEQ ID NO: 14407 - DNA, 15 bp, Homo sapiens
tttataagagcttaa

SEQ ID NO: 14408 - DNA, 15 bp, Homo sapiens
atttataagagctta

SEQ ID NO: 14409 - DNA, 15 bp, Homo sapiens
aatttataagagctt

SEQ ID NO: 14410 - DNA, 15 bp, Homo sapiens
aaatttataagagct

SEQ ID NO: 14411 - DNA, 15 bp, Homo sapiens
aaaatttataagagc

SEQ ID NO: 14412 - DNA, 15 bp, Homo sapiens
taaaatttataagag

SEQ ID NO: 14413 - DNA, 15 bp, Homo sapiens
ttaaaatttataaga

SEQ ID NO: 14414 - DNA, 15 bp, Homo sapiens
attaaaatttataag

SEQ ID NO: 14415 - DNA, 15 bp, Homo sapiens
aattaaaatttataa

SEQ ID NO: 14416 - DNA, 15 bp, Homo sapiens
caattaaaatttata

SEQ ID NO: 14417 - DNA, 15 bp, Homo sapiens
acaattaaaatttat

SEQ ID NO: 14418 - DNA, 15 bp, Homo sapiens
tacaattaaaattta

SEQ ID NO: 14419 - DNA, 15 bp, Homo sapiens
ttacaattaaaattt

SEQ ID NO: 14420 - DNA, 15 bp, Homo sapiens
tttacaattaaaatt

SEQ ID NO: 14421 - DNA, 15 bp, Homo sapiens
ttttacaattaaaat

SEQ ID NO: 14422 - DNA, 15 bp, Homo sapiens
gttttacaattaaaa

SEQ ID NO: 14423 - DNA, 15 bp, Homo sapiens
tgttttacaattaaa

SEQ ID NO: 14424 - DNA, 15 bp, Homo sapiens
atgttttacaattaa

SEQ ID NO: 14425 - DNA, 15 bp, Homo sapiens
gatgttttacaatta

SEQ ID NO: 14426 - DNA, 15 bp, Homo sapiens
tgatgttttacaatt

SEQ ID NO: 14427 - DNA, 15 bp, Homo sapiens
atgatgttttacaat

SEQ ID NO: 14428 - DNA, 15 bp, Homo sapiens
aatgatgttttacaa

SEQ ID NO: 14429 - DNA, 15 bp, Homo sapiens
caatgatgttttaca

SEQ ID NO: 14430 - DNA, 15 bp, Homo sapiens
acaatgatgttttac

SEQ ID NO: 14431 - DNA, 15 bp, Homo sapiens
tacaatgatgtttta

SEQ ID NO: 14432 - DNA, 15 bp, Homo sapiens
gtacaatgatgtttt

SEQ ID NO: 14433 - DNA, 15 bp, Homo sapiens
tgtacaatgatgttt

SEQ ID NO: 14434 - DNA, 15 bp, Homo sapiens
ttgtacaatgatgtt

SEQ ID NO: 14435 - DNA, 15 bp, Homo sapiens
tttgtacaatgatgt

SEQ ID NO: 14436 - DNA, 15 bp, Homo sapiens
ttttgtacaatgatg

SEQ ID NO: 14437 - DNA, 15 bp, Homo sapiens
gttttgtacaatgat

SEQ ID NO: 14438 - DNA, 15 bp, Homo sapiens
agttttgtacaatga

SEQ ID NO: 14439 - DNA, 15 bp, Homo sapiens
aagttttgtacaatg

SEQ ID NO: 14440 - DNA, 15 bp, Homo sapiens
aaagttttgtacaat

SEQ ID NO: 14441 - DNA, 15 bp, Homo sapiens
caaagttttgtacaa

SEQ ID NO: 14442 - DNA, 15 bp, Homo sapiens
tcaaagttttgtaca

SEQ ID NO: 14443 - DNA, 15 bp, Homo sapiens
ttcaaagttttgtac

SEQ ID NO: 14444 - DNA, 15 bp, Homo sapiens
tttcaaagttttgta

SEQ ID NO: 14445 - DNA, 15 bp, Homo sapiens
ttttcaaagttttgt

SEQ ID NO: 14446 - DNA, 15 bp, Homo sapiens
attttcaaagttttg

SEQ ID NO: 14447 - DNA, 15 bp, Homo sapiens
cattttcaaagtttt

SEQ ID NO: 14448 - DNA, 15 bp, Homo sapiens
gcattttcaaagttt

SEQ ID NO: 14449 - DNA, 15 bp, Homo sapiens
cgcattttcaaagtt

SEQ ID NO: 14450 - DNA, 15 bp, Homo sapiens
acgcattttcaaagt

SEQ ID NO: 14451 - DNA, 15 bp, Homo sapiens
tacgcattttcaaag

SEQ ID NO: 14452 - DNA, 15 bp, Homo sapiens
atacgcattttcaaa

SEQ ID NO: 14453 - DNA, 15 bp, Homo sapiens
tatacgcattttcaa

SEQ ID NO: 14454 - DNA, 15 bp, Homo sapiens
ctatacgcattttca

SEQ ID NO: 14455 - DNA, 15 bp, Homo sapiens
cctatacgcattttc

SEQ ID NO: 14456 - DNA, 15 bp, Homo sapiens
acctatacgcatttt

SEQ ID NO: 14457 - DNA, 15 bp, Homo sapiens
tacctatacgcattt

SEQ ID NO: 14458 - DNA, 15 bp, Homo sapiens
gtacctatacgcatt

SEQ ID NO: 14459 - DNA, 15 bp, Homo sapiens
tgtacctatacgcat

SEQ ID NO: 14460 - DNA, 15 bp, Homo sapiens
ttgtacctatacgca

SEQ ID NO: 14461 - DNA, 15 bp, Homo sapiens
tttgtacctatacgc

SEQ ID NO: 14462 - DNA, 15 bp, Homo sapiens
ctttgtacctatacg

SEQ ID NO: 14463 - DNA, 15 bp, Homo sapiens
tctttgtacctatac

SEQ ID NO: 14464 - DNA, 15 bp, Homo sapiens
atctttgtacctata

SEQ ID NO: 14465 - DNA, 15 bp, Homo sapiens
tatctttgtacctat

SEQ ID NO: 14466 - DNA, 15 bp, Homo sapiens
ttatctttgtaccta

SEQ ID NO: 14467 - DNA, 15 bp, Homo sapiens
tttatctttgtacct

SEQ ID NO: 14468 - DNA, 15 bp, Homo sapiens
ttttatctttgtacc

SEQ ID NO: 14469 - DNA, 15 bp, Homo sapiens
tttttatctttgtac

SEQ ID NO: 14470 - DNA, 15 bp, Homo sapiens
ttttttatctttgta

SEQ ID NO: 14471 - DNA, 15 bp, Homo sapiens
attttttatctttgt

SEQ ID NO: 14472 - DNA, 15 bp, Homo sapiens
aattttttatctttg

SEQ ID NO: 14473 - DNA, 15 bp, Homo sapiens
taattttttatcttt

SEQ ID NO: 14474 - DNA, 15 bp, Homo sapiens
ctaattttttatctt

SEQ ID NO: 14475 - DNA, 15 bp, Homo sapiens
cctaattttttatct

SEQ ID NO: 14476 - DNA, 15 bp, Homo sapiens
gcctaattttttatc

SEQ ID NO: 14477 - DNA, 15 bp, Homo sapiens
ggcctaattttttat

SEQ ID NO: 14478 - DNA, 15 bp, Homo sapiens
tggcctaatttttta

SEQ ID NO: 14479 - DNA, 15 bp, Homo sapiens
ctggcctaatttttt

SEQ ID NO: 14480 - DNA, 15 bp, Homo sapiens
cctggcctaattttt

SEQ ID NO: 14481 - DNA, 15 bp, Homo sapiens
gcctggcctaatttt

SEQ ID NO: 14482 - DNA, 15 bp, Homo sapiens
tgcctggcctaattt

SEQ ID NO: 14483 - DNA, 15 bp, Homo sapiens
atgcctggcctaatt

SEQ ID NO: 14484 - DNA, 15 bp, Homo sapiens
catgcctggcctaat

SEQ ID NO: 14485 - DNA, 15 bp, Homo sapiens
gcatgcctggcctaa

SEQ ID NO: 14486 - DNA, 15 bp, Homo sapiens
ggcatgcctggccta

SEQ ID NO: 14487 - DNA, 15 bp, Homo sapiens
tggcatgcctggcct

SEQ ID NO: 14488 - DNA, 15 bp, Homo sapiens
atggcatgcctggcc

SEQ ID NO: 14489 - DNA, 15 bp, Homo sapiens
catggcatgcctggc

SEQ ID NO: 14490 - DNA, 15 bp, Homo sapiens
ccatggcatgcctgg

SEQ ID NO: 14491 - DNA, 15 bp, Homo sapiens
gccatggcatgcctg

SEQ ID NO: 14492 - DNA, 15 bp, Homo sapiens
agccatggcatgcct

SEQ ID NO: 14493 - DNA, 15 bp, Homo sapiens
gagccatggcatgcc

SEQ ID NO: 14494 - DNA, 15 bp, Homo sapiens
tgagccatggcatgc

SEQ ID NO: 14495 - DNA, 15 bp, Homo sapiens
gtgagccatggcatg

SEQ ID NO: 14496 - DNA, 15 bp, Homo sapiens
cgtgagccatggcat

SEQ ID NO: 14497 - DNA, 15 bp, Homo sapiens
gcgtgagccatggca

SEQ ID NO: 14498 - DNA, 15 bp, Homo sapiens
ggcgtgagccatggc

SEQ ID NO: 14499 - DNA, 15 bp, Homo sapiens
aggcgtgagccatgg

SEQ ID NO: 14500 - DNA, 15 bp, Homo sapiens
caggcgtgagccatg

SEQ ID NO: 14501 - DNA, 15 bp, Homo sapiens
acaggcgtgagccat

SEQ ID NO: 14502 - DNA, 15 bp, Homo sapiens
tggcctcccaaagtg

SEQ ID NO: 14503 - DNA, 15 bp, Homo sapiens
ttggcctcccaaagt

SEQ ID NO: 14504 - DNA, 15 bp, Homo sapiens
cttggcctcccaaag

SEQ ID NO: 14505 - DNA, 15 bp, Homo sapiens
ccttggcctcccaaa

SEQ ID NO: 14506 - DNA, 15 bp, Homo sapiens
accttggcctcccaa

SEQ ID NO: 14507 - DNA, 15 bp, Homo sapiens
caccttggcctccca

SEQ ID NO: 14508 - DNA, 15 bp, Homo sapiens
ccaccttggcctccc

SEQ ID NO: 14509 - DNA, 15 bp, Homo sapiens
cccaccttggcctcc

SEQ ID NO: 14510 - DNA, 15 bp, Homo sapiens
tcccaccttggcctc

SEQ ID NO: 14511 - DNA, 15 bp, Homo sapiens
ctcccaccttggcct

SEQ ID NO: 14512 - DNA, 15 bp, Homo sapiens
cctcccaccttggcc

SEQ ID NO: 14513 - DNA, 15 bp, Homo sapiens
tcctcccaccttggc

SEQ ID NO: 14514 - DNA, 15 bp, Homo sapiens
atcctcccaccttgg

SEQ ID NO: 14515 - DNA, 15 bp, Homo sapiens
gatcctcccaccttg

SEQ ID NO: 14516 - DNA, 15 bp, Homo sapiens
agatcctcccacctt

SEQ ID NO: 14517 - DNA, 15 bp, Homo sapiens
aagatcctcccacct

SEQ ID NO: 14518 - DNA, 15 bp, Homo sapiens
aaagatcctcccacc

SEQ ID NO: 14519 - DNA, 15 bp, Homo sapiens
aaaagatcctcccac

SEQ ID NO: 14520 - DNA, 15 bp, Homo sapiens
caaaagatcctccca

SEQ ID NO: 14521 - DNA, 15 bp, Homo sapiens
tcaaaagatcctccc

SEQ ID NO: 14522 - DNA, 15 bp, Homo sapiens
ctcaaaagatcctcc

SEQ ID NO: 14523 - DNA, 15 bp, Homo sapiens
gctcaaaagatcctc

SEQ ID NO: 14524 - DNA, 15 bp, Homo sapiens
ggctcaaaagatcct

SEQ ID NO: 14525 - DNA, 15 bp, Homo sapiens
gggctcaaaagatcc

SEQ ID NO: 14526 - DNA, 15 bp, Homo sapiens
tgggctcaaaagatc

SEQ ID NO: 14527 - DNA, 15 bp, Homo sapiens
ctgggctcaaaagat

SEQ ID NO: 14528 - DNA, 15 bp, Homo sapiens
cctgggctcaaaaga

SEQ ID NO: 14529 - DNA, 15 bp, Homo sapiens
tcctgggctcaaaag

SEQ ID NO: 14530 - DNA, 15 bp, Homo sapiens
ctcctgggctcaaaa

SEQ ID NO: 14531 - DNA, 15 bp, Homo sapiens
actcctgggctcaaa

SEQ ID NO: 14532 - DNA, 15 bp, Homo sapiens
aactcctgggctcaa

SEQ ID NO: 14533 - DNA, 15 bp, Homo sapiens
gaactcctgggctca

SEQ ID NO: 14534 - DNA, 15 bp, Homo sapiens
tgaactcctgggctc

SEQ ID NO: 14535 - DNA, 15 bp, Homo sapiens
ttgaactcctgggct

SEQ ID NO: 14536 - DNA, 15 bp, Homo sapiens
cttgaactcctgggc

SEQ ID NO: 14537 - DNA, 15 bp, Homo sapiens
tcttgaactcctggg

SEQ ID NO: 14538 - DNA, 15 bp, Homo sapiens
gtcttgaactcctgg

SEQ ID NO: 14539 - DNA, 15 bp, Homo sapiens
tcaggctggtcttga

SEQ ID NO: 14540 - DNA, 15 bp, Homo sapiens
ctcaggctggtcttg

SEQ ID NO: 14541 - DNA, 15 bp, Homo sapiens
gctcaggctggtctt

SEQ ID NO: 14542 - DNA, 15 bp, Homo sapiens
tgctcaggctggtct

SEQ ID NO: 14543 - DNA, 15 bp, Homo sapiens
ttgctcaggctggtc

SEQ ID NO: 14544 - DNA, 15 bp, Homo sapiens
gttgctcaggctggt

SEQ ID NO: 14545 - DNA, 15 bp, Homo sapiens
tgttgctcaggctgg

SEQ ID NO: 14546 - DNA, 15 bp, Homo sapiens
atgttgctcaggctg

SEQ ID NO: 14547 - DNA, 15 bp, Homo sapiens
tatgttgctcaggct

SEQ ID NO: 14548 - DNA, 15 bp, Homo sapiens
atatgttgctcaggc

SEQ ID NO: 14549 - DNA, 15 bp, Homo sapiens
aatatgttgctcagg

SEQ ID NO: 14550 - DNA, 15 bp, Homo sapiens
caatatgttgctcag

SEQ ID NO: 14551 - DNA, 15 bp, Homo sapiens
tcaatatgttgctca

SEQ ID NO: 14552 - DNA, 15 bp, Homo sapiens
ctcaatatgttgctc

SEQ ID NO: 14553 - DNA, 15 bp, Homo sapiens
tctcaatatgttgct

SEQ ID NO: 14554 - DNA, 15 bp, Homo sapiens
gtctcaatatgttgc

SEQ ID NO: 14555 - DNA, 15 bp, Homo sapiens
ggtctcaatatgttg

SEQ ID NO: 14556 - DNA, 15 bp, Homo sapiens
gggtctcaatatgtt

SEQ ID NO: 14557 - DNA, 15 bp, Homo sapiens
agggtctcaatatgt

SEQ ID NO: 14558 - DNA, 15 bp, Homo sapiens
tagggtctcaatatg

SEQ ID NO: 14559 - DNA, 15 bp, Homo sapiens
atagggtctcaatat

SEQ ID NO: 14560 - DNA, 15 bp, Homo sapiens
gatagggtctcaata

SEQ ID NO: 14561 - DNA, 15 bp, Homo sapiens
agatagggtctcaat

SEQ ID NO: 14562 - DNA, 15 bp, Homo sapiens
gagatagggtctcaa

SEQ ID NO: 14563 - DNA, 15 bp, Homo sapiens
agagatagggtctca

SEQ ID NO: 14564 - DNA, 15 bp, Homo sapiens
tagagatagggtctc

SEQ ID NO: 14565 - DNA, 15 bp, Homo sapiens
gtagagatagggtct

SEQ ID NO: 14566 - DNA, 15 bp, Homo sapiens
tgtagagatagggtc

SEQ ID NO: 14567 - DNA, 15 bp, Homo sapiens
ttgtagagatagggt

SEQ ID NO: 14568 - DNA, 15 bp, Homo sapiens
tttgtagagataggg

SEQ ID NO: 14569 - DNA, 15 bp, Homo sapiens
ttttgtagagatagg

SEQ ID NO: 14570 - DNA, 15 bp, Homo sapiens
tttttgtagagatag

SEQ ID NO: 14571 - DNA, 15 bp, Homo sapiens
atttttgtagagata

SEQ ID NO: 14572 - DNA, 15 bp, Homo sapiens
tatttttgtagagat

SEQ ID NO: 14573 - DNA, 15 bp, Homo sapiens
atatttttgtagaga

SEQ ID NO: 14574 - DNA, 15 bp, Homo sapiens
gatatttttgtagag

SEQ ID NO: 14575 - DNA, 15 bp, Homo sapiens
tgatatttttgtaga

SEQ ID NO: 14576 - DNA, 15 bp, Homo sapiens
atgatatttttgtag

SEQ ID NO: 14577 - DNA, 15 bp, Homo sapiens
tatgatatttttgta

SEQ ID NO: 14578 - DNA, 15 bp, Homo sapiens
ttatgatatttttgt

SEQ ID NO: 14579 - DNA, 15 bp, Homo sapiens
tttatgatatttttg

SEQ ID NO: 14580 - DNA, 15 bp, Homo sapiens
ttttatgatattttt

SEQ ID NO: 14581 - DNA, 15 bp, Homo sapiens
gttttatgatatttt

SEQ ID NO: 14582 - DNA, 15 bp, Homo sapiens
tgttttatgatattt

SEQ ID NO: 14583 - DNA, 15 bp, Homo sapiens
ttgttttatgatatt

SEQ ID NO: 14584 - DNA, 15 bp, Homo sapiens
tttgttttatgatat

SEQ ID NO: 14585 - DNA, 15 bp, Homo sapiens
ttttgttttatgata

SEQ ID NO: 14586 - DNA, 15 bp, Homo sapiens
attttgttttatgat

SEQ ID NO: 14587 - DNA, 15 bp, Homo sapiens
tattttgttttatga

SEQ ID NO: 14588 - DNA, 15 bp, Homo sapiens
ctattttgttttatg

SEQ ID NO: 14589 - DNA, 15 bp, Homo sapiens
tctattttgttttat

SEQ ID NO: 14590 - DNA, 15 bp, Homo sapiens
ttctattttgtttta

SEQ ID NO: 14591 - DNA, 15 bp, Homo sapiens
attctattttgtttt

SEQ ID NO: 14592 - DNA, 15 bp, Homo sapiens
gattctattttgttt

SEQ ID NO: 14593 - DNA, 15 bp, Homo sapiens
tgattctattttgtt

SEQ ID NO: 14594 - DNA, 15 bp, Homo sapiens
gtgattctattttgt

SEQ ID NO: 14595 - DNA, 15 bp, Homo sapiens
agtgattctattttg

SEQ ID NO: 14596 - DNA, 15 bp, Homo sapiens
gagtgattctatttt

SEQ ID NO: 14597 - DNA, 15 bp, Homo sapiens
agagtgattctattt

SEQ ID NO: 14598 - DNA, 15 bp, Homo sapiens
cagagtgattctatt

SEQ ID NO: 14599 - DNA, 15 bp, Homo sapiens
ccagagtgattctat

SEQ ID NO: 14600 - DNA, 15 bp, Homo sapiens
gccagagtgattcta

SEQ ID NO: 14601 - DNA, 15 bp, Homo sapiens
cgccagagtgattct

SEQ ID NO: 14602 - DNA, 15 bp, Homo sapiens
tcgccagagtgattc

SEQ ID NO: 14603 - DNA, 15 bp, Homo sapiens
atcgccagagtgatt

SEQ ID NO: 14604 - DNA, 15 bp, Homo sapiens
aatcgccagagtgat

SEQ ID NO: 14605 - DNA, 15 bp, Homo sapiens
gaatcgccagagtga

SEQ ID NO: 14606 - DNA, 15 bp, Homo sapiens
ggaatcgccagagtg

SEQ ID NO: 14607 - DNA, 15 bp, Homo sapiens
tggaatcgccagagt

SEQ ID NO: 14608 - DNA, 15 bp, Homo sapiens
gtggaatcgccagag

SEQ ID NO: 14609 - DNA, 15 bp, Homo sapiens
agtggaatcgccaga

SEQ ID NO: 14610 - DNA, 15 bp, Homo sapiens
tagtggaatcgccag

SEQ ID NO: 14611 - DNA, 15 bp, Homo sapiens
atagtggaatcgcca

SEQ ID NO: 14612 - DNA, 15 bp, Homo sapiens
gatagtggaatcgcc

SEQ ID NO: 14613 - DNA, 15 bp, Homo sapiens
ggatagtggaatcgc

SEQ ID NO: 14614 - DNA, 15 bp, Homo sapiens
tggatagtggaatcg

SEQ ID NO: 14615 - DNA, 15 bp, Homo sapiens
ttggatagtggaatc

SEQ ID NO: 14616 - DNA, 15 bp, Homo sapiens
tttggatagtggaat

SEQ ID NO: 14617 - DNA, 15 bp, Homo sapiens
ttttggatagtggaa

SEQ ID NO: 14618 - DNA, 15 bp, Homo sapiens
tttttggatagtgga

SEQ ID NO: 14619 - DNA, 15 bp, Homo sapiens
ttttttggatagtgg

SEQ ID NO: 14620 - DNA, 15 bp, Homo sapiens
tttttttggatagtg

SEQ ID NO: 14621 - DNA, 15 bp, Homo sapiens
ttttttttggatagt

SEQ ID NO: 14622 - DNA, 15 bp, Homo sapiens
tttttttttggatag

SEQ ID NO: 14623 - DNA, 15 bp, Homo sapiens
ttttttttttggata

SEQ ID NO: 14624 - DNA, 15 bp, Homo sapiens
tttttttttttggat

SEQ ID NO: 14625 - DNA, 15 bp, Homo sapiens
ttttttttttttgga

SEQ ID NO: 14626 - DNA, 15 bp, Homo sapiens
tttttttttttttgg

SEQ ID NO: 14627 - DNA, 15 bp, Homo sapiens
agttttttttttttt

SEQ ID NO: 14628 - DNA, 15 bp, Homo sapiens
cagtttttttttttt

SEQ ID NO: 14629 - DNA, 15 bp, Homo sapiens
gcagttttttttttt

SEQ ID NO: 14630 - DNA, 15 bp, Homo sapiens
agcagtttttttttt

SEQ ID NO: 14631 - DNA, 15 bp, Homo sapiens
cagcagttttttttt

SEQ ID NO: 14632 - DNA, 15 bp, Homo sapiens
acagcagtttttttt

SEQ ID NO: 14633 - DNA, 15 bp, Homo sapiens
aacagcagttttttt

SEQ ID NO: 14634 - DNA, 15 bp, Homo sapiens
taacagcagtttttt

SEQ ID NO: 14635 - DNA, 15 bp, Homo sapiens
ttaacagcagttttt

SEQ ID NO: 14636 - DNA, 15 bp, Homo sapiens
attaacagcagtttt

SEQ ID NO: 14637 - DNA, 15 bp, Homo sapiens
tattaacagcagttt

SEQ ID NO: 14638 - DNA, 15 bp, Homo sapiens
atattaacagcagtt

SEQ ID NO: 14639 - DNA, 15 bp, Homo sapiens
aatattaacagcagt

SEQ ID NO: 14640 - DNA, 15 bp, Homo sapiens
aaatattaacagcag

SEQ ID NO: 14641 - DNA, 15 bp, Homo sapiens
caaatattaacagca

SEQ ID NO: 14642 - DNA, 15 bp, Homo sapiens
ccaaatattaacagc

SEQ ID NO: 14643 - DNA, 15 bp, Homo sapiens
accaaatattaacag

SEQ ID NO: 14644 - DNA, 15 bp, Homo sapiens
taccaaatattaaca

SEQ ID NO: 14645 - DNA, 15 bp, Homo sapiens
ataccaaatattaac

SEQ ID NO: 14646 - DNA, 15 bp, Homo sapiens
cataccaaatattaa

SEQ ID NO: 14647 - DNA, 15 bp, Homo sapiens
acataccaaatatta

SEQ ID NO: 14648 - DNA, 15 bp, Homo sapiens
tacataccaaatatt

SEQ ID NO: 14649 - DNA, 15 bp, Homo sapiens
atacataccaaatat

SEQ ID NO: 14650 - DNA, 15 bp, Homo sapiens
gatacataccaaata

SEQ ID NO: 14651 - DNA, 15 bp, Homo sapiens
agatacataccaaat

SEQ ID NO: 14652 - DNA, 15 bp, Homo sapiens
aagatacataccaaa

SEQ ID NO: 14653 - DNA, 15 bp, Homo sapiens
aaagatacataccaa

SEQ ID NO: 14654 - DNA, 15 bp, Homo sapiens
gaaagatacatacca

SEQ ID NO: 14655 - DNA, 15 bp, Homo sapiens
agaaagatacatacc

SEQ ID NO: 14656 - DNA, 15 bp, Homo sapiens
tagaaagatacatac

SEQ ID NO: 14657 - DNA, 15 bp, Homo sapiens
ctagaaagatacata

SEQ ID NO: 14658 - DNA, 15 bp, Homo sapiens
tctagaaagatacat

SEQ ID NO: 14659 - DNA, 15 bp, Homo sapiens
gtctagaaagataca

SEQ ID NO: 14660 - DNA, 15 bp, Homo sapiens
ggtctagaaagatac

SEQ ID NO: 14661 - DNA, 15 bp, Homo sapiens
tggtctagaaagata

SEQ ID NO: 14662 - DNA, 15 bp, Homo sapiens
ttggtctagaaagat

SEQ ID NO: 14663 - DNA, 15 bp, Homo sapiens
cttggtctagaaaga

SEQ ID NO: 14664 - DNA, 15 bp, Homo sapiens
ccttggtctagaaag

SEQ ID NO: 14665 - DNA, 15 bp, Homo sapiens
gccttggtctagaaa

SEQ ID NO: 14666 - DNA, 15 bp, Homo sapiens
ggccttggtctagaa

SEQ ID NO: 14667 - DNA, 15 bp, Homo sapiens
aggccttggtctaga

SEQ ID NO: 14668 - DNA, 15 bp, Homo sapiens
gaggccttggtctag

SEQ ID NO: 14669 - DNA, 15 bp, Homo sapiens
ggaggccttggtcta

SEQ ID NO: 14670 - DNA, 15 bp, Homo sapiens
tggaggccttggtct

SEQ ID NO: 14671 - DNA, 15 bp, Homo sapiens
ttggaggccttggtc

SEQ ID NO: 14672 - DNA, 15 bp, Homo sapiens
gttggaggccttggt

SEQ ID NO: 14673 - DNA, 15 bp, Homo sapiens
agttggaggccttgg

SEQ ID NO: 14674 - DNA, 15 bp, Homo sapiens
aagttggaggccttg

SEQ ID NO: 14675 - DNA, 15 bp, Homo sapiens
aaagttggaggcctt

SEQ ID NO: 14676 - DNA, 15 bp, Homo sapiens
caaagttggaggcct

SEQ ID NO: 14677 - DNA, 15 bp, Homo sapiens
ccaaagttggaggcc

SEQ ID NO: 14678 - DNA, 15 bp, Homo sapiens
accaaagttggaggc

SEQ ID NO: 14679 - DNA, 15 bp, Homo sapiens
aaccaaagttggagg

SEQ ID NO: 14680 - DNA, 15 bp, Homo sapiens
caaccaaagttggag

SEQ ID NO: 14681 - DNA, 15 bp, Homo sapiens
tcaaccaaagttgga

SEQ ID NO: 14682 - DNA, 15 bp, Homo sapiens
ctcaaccaaagttgg

SEQ ID NO: 14683 - DNA, 15 bp, Homo sapiens
tctcaaccaaagttg

SEQ ID NO: 14684 - DNA, 15 bp, Homo sapiens
ttctcaaccaaagtt

SEQ ID NO: 14685 - DNA, 15 bp, Homo sapiens
attctcaaccaaagt

SEQ ID NO: 14686 - DNA, 15 bp, Homo sapiens
aattctcaaccaaag

SEQ ID NO: 14687 - DNA, 15 bp, Homo sapiens
gaattctcaaccaaa

SEQ ID NO: 14688 - DNA, 15 bp, Homo sapiens
tgaattctcaaccaa

SEQ ID NO: 14689 - DNA, 15 bp, Homo sapiens
ctgaattctcaacca

SEQ ID NO: 14690 - DNA, 15 bp, Homo sapiens
gctgaattctcaacc

SEQ ID NO: 14691 - DNA, 15 bp, Homo sapiens
ggctgaattctcaac

SEQ ID NO: 14692 - DNA, 15 bp, Homo sapiens
cggctgaattctcaa

SEQ ID NO: 14693 - DNA, 15 bp, Homo sapiens
ccggctgaattctca

SEQ ID NO: 14694 - DNA, 15 bp, Homo sapiens
cccggctgaattctc

SEQ ID NO: 14695 - DNA, 15 bp, Homo sapiens
acccggctgaattct

SEQ ID NO: 14696 - DNA, 15 bp, Homo sapiens
gacccggctgaattc

SEQ ID NO: 14697 - DNA, 15 bp, Homo sapiens
agacccggctgaatt

SEQ ID NO: 14698 - DNA, 15 bp, Homo sapiens
cagacccggctgaat

SEQ ID NO: 14699 - DNA, 15 bp, Homo sapiens
acagacccggctgaa

SEQ ID NO: 14700 - DNA, 15 bp, Homo sapiens
cacagacccggctga

SEQ ID NO: 14701 - DNA, 15 bp, Homo sapiens
tcacagacccggctg

SEQ ID NO: 14702 - DNA, 15 bp, Homo sapiens
gtcacagacccggct

SEQ ID NO: 14703 - DNA, 15 bp, Homo sapiens
ggtcacagacccggc

SEQ ID NO: 14704 - DNA, 15 bp, Homo sapiens
aggtcacagacccgg

SEQ ID NO: 14705 - DNA, 15 bp, Homo sapiens
aaggtcacagacccg

SEQ ID NO: 14706 - DNA, 15 bp, Homo sapiens
caaggtcacagaccc

SEQ ID NO: 14707 - DNA, 15 bp, Homo sapiens
ccaaggtcacagacc

SEQ ID NO: 14708 - DNA, 15 bp, Homo sapiens
tccaaggtcacagac

SEQ ID NO: 14709 - DNA, 15 bp, Homo sapiens
atccaaggtcacaga

SEQ ID NO: 14710 - DNA, 15 bp, Homo sapiens
catccaaggtcacag

SEQ ID NO: 14711 - DNA, 15 bp, Homo sapiens
ccatccaaggtcaca

SEQ ID NO: 14712 - DNA, 15 bp, Homo sapiens
cccatccaaggtcac

SEQ ID NO: 14713 - DNA, 15 bp, Homo sapiens
tcccatccaaggtca

SEQ ID NO: 14714 - DNA, 15 bp, Homo sapiens
ttcccatccaaggtc

SEQ ID NO: 14715 - DNA, 15 bp, Homo sapiens
tttcccatccaaggt

SEQ ID NO: 14716 - DNA, 15 bp, Homo sapiens
ttttcccatccaagg

SEQ ID NO: 14717 - DNA, 15 bp, Homo sapiens
tttttcccatccaag

SEQ ID NO: 14718 - DNA, 15 bp, Homo sapiens
gtttttcccatccaa

SEQ ID NO: 14719 - DNA, 15 bp, Homo sapiens
tgtttttcccatcca

SEQ ID NO: 14720 - DNA, 15 bp, Homo sapiens
atgtttttcccatcc

SEQ ID NO: 14721 - DNA, 15 bp, Homo sapiens
aatgtttttcccatc

SEQ ID NO: 14722 - DNA, 15 bp, Homo sapiens
gaatgtttttcccat

SEQ ID NO: 14723 - DNA, 15 bp, Homo sapiens
tgaatgtttttccca

SEQ ID NO: 14724 - DNA, 15 bp, Homo sapiens
gtgaatgtttttccc

SEQ ID NO: 14725 - DNA, 15 bp, Homo sapiens
agtgaatgtttttcc

SEQ ID NO: 14726 - DNA, 15 bp, Homo sapiens
gagtgaatgtttttc

SEQ ID NO: 14727 - DNA, 15 bp, Homo sapiens
agagtgaatgttttt

SEQ ID NO: 14728 - DNA, 15 bp, Homo sapiens
aagagtgaatgtttt

SEQ ID NO: 14729 - DNA, 15 bp, Homo sapiens
aaagagtgaatgttt

SEQ ID NO: 14730 - DNA, 15 bp, Homo sapiens
taaagagtgaatgtt

SEQ ID NO: 14731 - DNA, 15 bp, Homo sapiens
ataaagagtgaatgt

SEQ ID NO: 14732 - DNA, 15 bp, Homo sapiens
aataaagagtgaatg

SEQ ID NO: 14733 - DNA, 15 bp, Homo sapiens
aaataaagagtgaat

SEQ ID NO: 14734 - DNA, 15 bp, Homo sapiens
aaaataaagagtgaa

SEQ ID NO: 14735 - DNA, 15 bp, Homo sapiens
gaaaataaagagtga

SEQ ID NO: 14736 - DNA, 15 bp, Homo sapiens
tgaaaataaagagtg

SEQ ID NO: 14737 - DNA, 15 bp, Homo sapiens
gtgaaaataaagagt

SEQ ID NO: 14738 - DNA, 15 bp, Homo sapiens
agtgaaaataaagag

SEQ ID NO: 14739 - DNA, 15 bp, Homo sapiens
tagtgaaaataaaga

SEQ ID NO: 14740 - DNA, 15 bp, Homo sapiens
ttagtgaaaataaag

SEQ ID NO: 14741 - DNA, 15 bp, Homo sapiens
attagtgaaaataaa

SEQ ID NO: 14742 - DNA, 15 bp, Homo sapiens
cattagtgaaaataa

SEQ ID NO: 14743 - DNA, 15 bp, Homo sapiens
acattagtgaaaata

SEQ ID NO: 14744 - DNA, 15 bp, Homo sapiens
gacattagtgaaaat

SEQ ID NO: 14745 - DNA, 15 bp, Homo sapiens
agacattagtgaaaa

SEQ ID NO: 14746 - DNA, 15 bp, Homo sapiens
gagacattagtgaaa

SEQ ID NO: 14747 - DNA, 15 bp, Homo sapiens
agagacattagtgaa

SEQ ID NO: 14748 - DNA, 15 bp, Homo sapiens
cagagacattagtga

SEQ ID NO: 14749 - DNA, 15 bp, Homo sapiens
tcagagacattagtg

SEQ ID NO: 14750 - DNA, 15 bp, Homo sapiens
ttcagagacattagt

SEQ ID NO: 14751 - DNA, 15 bp, Homo sapiens
tttcagagacattag

SEQ ID NO: 14752 - DNA, 15 bp, Homo sapiens
ttttcagagacatta

SEQ ID NO: 14753 - DNA, 15 bp, Homo sapiens
gttttcagagacatt

SEQ ID NO: 14754 - DNA, 15 bp, Homo sapiens
ggttttcagagacat

SEQ ID NO: 14755 - DNA, 15 bp, Homo sapiens
gggttttcagagaca

SEQ ID NO: 14756 - DNA, 15 bp, Homo sapiens
tgggttttcagagac

SEQ ID NO: 14757 - DNA, 15 bp, Homo sapiens
ctgggttttcagaga

SEQ ID NO: 14758 - DNA, 15 bp, Homo sapiens
tctgggttttcagag

SEQ ID NO: 14759 - DNA, 15 bp, Homo sapiens
atctgggttttcaga

SEQ ID NO: 14760 - DNA, 15 bp, Homo sapiens
aatctgggttttcag

SEQ ID NO: 14761 - DNA, 15 bp, Homo sapiens
aaatctgggttttca

SEQ ID NO: 14762 - DNA, 15 bp, Homo sapiens
aaaatctgggttttc

SEQ ID NO: 14763 - DNA, 15 bp, Homo sapiens
aaaaatctgggtttt

SEQ ID NO: 14764 - DNA, 15 bp, Homo sapiens
taaaaatctgggttt

SEQ ID NO: 14765 - DNA, 15 bp, Homo sapiens
ctaaaaatctgggtt

SEQ ID NO: 14766 - DNA, 15 bp, Homo sapiens
gctaaaaatctgggt

SEQ ID NO: 14767 - DNA, 15 bp, Homo sapiens
agctaaaaatctggg

SEQ ID NO: 14768 - DNA, 15 bp, Homo sapiens
cagctaaaaatctgg

SEQ ID NO: 14769 - DNA, 15 bp, Homo sapiens
ccagctaaaaatctg

SEQ ID NO: 14770 - DNA, 15 bp, Homo sapiens
cccagctaaaaatct

SEQ ID NO: 14771 - DNA, 15 bp, Homo sapiens
gcccagctaaaaatc

SEQ ID NO: 14772 - DNA, 15 bp, Homo sapiens
tgcccagctaaaaat

SEQ ID NO: 14773 - DNA, 15 bp, Homo sapiens
atgcccagctaaaaa

SEQ ID NO: 14774 - DNA, 15 bp, Homo sapiens
catgcccagctaaaa

SEQ ID NO: 14775 - DNA, 15 bp, Homo sapiens
ccatgcccagctaaa

SEQ ID NO: 14776 - DNA, 15 bp, Homo sapiens
accatgcccagctaa

SEQ ID NO: 14777 - DNA, 15 bp, Homo sapiens
caccatgcccagcta

SEQ ID NO: 14778 - DNA, 15 bp, Homo sapiens
ccaccatgcccagct

SEQ ID NO: 14779 - DNA, 15 bp, Homo sapiens
cgagccaccatgccc

SEQ ID NO: 14780 - DNA, 15 bp, Homo sapiens
acgagccaccatgcc

SEQ ID NO: 14781 - DNA, 15 bp, Homo sapiens
cacgagccaccatgc

SEQ ID NO: 14782 - DNA, 15 bp, Homo sapiens
gcacgagccaccatg

SEQ ID NO: 14783 - DNA, 15 bp, Homo sapiens
ggcacgagccaccat

SEQ ID NO: 14784 - DNA, 15 bp, Homo sapiens
aggcacgagccacca

SEQ ID NO: 14785 - DNA, 15 bp, Homo sapiens
caggcacgagccacc

SEQ ID NO: 14786 - DNA, 15 bp, Homo sapiens
acaggcacgagccac

SEQ ID NO: 14787 - DNA, 15 bp, Homo sapiens
tacaggcacgagcca

SEQ ID NO: 14788 - DNA, 15 bp, Homo sapiens
ttacaggcacgagcc

SEQ ID NO: 14789 - DNA, 15 bp, Homo sapiens
attacaggcacgagc

SEQ ID NO: 14790 - DNA, 15 bp, Homo sapiens
gattacaggcacgag

SEQ ID NO: 14791 - DNA, 15 bp, Homo sapiens
ggattacaggcacga

SEQ ID NO: 14792 - DNA, 15 bp, Homo sapiens
gggattacaggcacg

SEQ ID NO: 14793 - DNA, 15 bp, Homo sapiens
tgggattacaggcac

SEQ ID NO: 14794 - DNA, 15 bp, Homo sapiens
actgggattacaggc

SEQ ID NO: 14795 - DNA, 15 bp, Homo sapiens
cactgggattacagg

SEQ ID NO: 14796 - DNA, 15 bp, Homo sapiens
gcactgggattacag

SEQ ID NO: 14797 - DNA, 15 bp, Homo sapiens
agcactgggattaca

SEQ ID NO: 14798 - DNA, 15 bp, Homo sapiens
aagcactgggattac

SEQ ID NO: 14799 - DNA, 15 bp, Homo sapiens
aaagcactgggatta

SEQ ID NO: 14800 - DNA, 15 bp, Homo sapiens
caaagcactgggatt

SEQ ID NO: 14801 - DNA, 15 bp, Homo sapiens
ccaaagcactgggat

SEQ ID NO: 14802 - DNA, 15 bp, Homo sapiens
tccaaagcactggga

SEQ ID NO: 14803 - DNA, 15 bp, Homo sapiens
ttccaaagcactggg

SEQ ID NO: 14804 - DNA, 15 bp, Homo sapiens
cttccaaagcactgg

SEQ ID NO: 14805 - DNA, 15 bp, Homo sapiens
gcttccaaagcactg

SEQ ID NO: 14806 - DNA, 15 bp, Homo sapiens
ggcttccaaagcact

SEQ ID NO: 14807 - DNA, 15 bp, Homo sapiens
gggcttccaaagcac

SEQ ID NO: 14808 - DNA, 15 bp, Homo sapiens
cgggcttccaaagca

SEQ ID NO: 14809 - DNA, 15 bp, Homo sapiens
acgggcttccaaagc

SEQ ID NO: 14810 - DNA, 15 bp, Homo sapiens
cacgggcttccaaag

SEQ ID NO: 14811 - DNA, 15 bp, Homo sapiens
ccacgggcttccaaa

SEQ ID NO: 14812 - DNA, 15 bp, Homo sapiens
tccacgggcttccaa

SEQ ID NO: 14813 - DNA, 15 bp, Homo sapiens
ctccacgggcttcca

SEQ ID NO: 14814 - DNA, 15 bp, Homo sapiens
cctccacgggcttcc

SEQ ID NO: 14815 - DNA, 15 bp, Homo sapiens
ccctccacgggcttc

SEQ ID NO: 14816 - DNA, 15 bp, Homo sapiens
gccctccacgggctt

SEQ ID NO: 14817 - DNA, 15 bp, Homo sapiens
tgccctccacgggct

SEQ ID NO: 14818 - DNA, 15 bp, Homo sapiens
ctgccctccacgggc

SEQ ID NO: 14819 - DNA, 15 bp, Homo sapiens
tctgccctccacggg

SEQ ID NO: 14820 - DNA, 15 bp, Homo sapiens
atctgccctccacgg

SEQ ID NO: 14821 - DNA, 15 bp, Homo sapiens
gatctgccctccacg

SEQ ID NO: 14822 - DNA, 15 bp, Homo sapiens
tgatctgccctccac

SEQ ID NO: 14823 - DNA, 15 bp, Homo sapiens
gtgatctgccctcca

SEQ ID NO: 14824 - DNA, 15 bp, Homo sapiens
agtgatctgccctcc

SEQ ID NO: 14825 - DNA, 15 bp, Homo sapiens
aagtgatctgccctc

SEQ ID NO: 14826 - DNA, 15 bp, Homo sapiens
caagtgatctgccct

SEQ ID NO: 14827 - DNA, 15 bp, Homo sapiens
tcaagtgatctgccc

SEQ ID NO: 14828 - DNA, 15 bp, Homo sapiens
ctcaagtgatctgcc

SEQ ID NO: 14829 - DNA, 15 bp, Homo sapiens
gctcaagtgatctgc

SEQ ID NO: 14830 - DNA, 15 bp, Homo sapiens
ggctcaagtgatctg

SEQ ID NO: 14831 - DNA, 15 bp, Homo sapiens
gggctcaagtgatct

SEQ ID NO: 14832 - DNA, 15 bp, Homo sapiens
tgggctcaagtgatc

SEQ ID NO: 14833 - DNA, 15 bp, Homo sapiens
ctgggctcaagtgat

SEQ ID NO: 14834 - DNA, 15 bp, Homo sapiens
cctgggctcaagtga

SEQ ID NO: 14835 - DNA, 15 bp, Homo sapiens
tcctgggctcaagtg

SEQ ID NO: 14836 - DNA, 15 bp, Homo sapiens
ctcctgggctcaagt

SEQ ID NO: 14837 - DNA, 15 bp, Homo sapiens
actcctgggctcaag

SEQ ID NO: 14838 - DNA, 15 bp, Homo sapiens
caaactcctgggctc

SEQ ID NO: 14839 - DNA, 15 bp, Homo sapiens
tcaaactcctgggct

SEQ ID NO: 14840 - DNA, 15 bp, Homo sapiens
ctcaaactcctgggc

SEQ ID NO: 14841 - DNA, 15 bp, Homo sapiens
tctcaaactcctggg

SEQ ID NO: 14842 - DNA, 15 bp, Homo sapiens
gtctcaaactcctgg

SEQ ID NO: 14843 - DNA, 15 bp, Homo sapiens
tatgttgcccaggct

SEQ ID NO: 14844 - DNA, 15 bp, Homo sapiens
ctatgttgcccaggc

SEQ ID NO: 14845 - DNA, 15 bp, Homo sapiens
gctatgttgcccagg

SEQ ID NO: 14846 - DNA, 15 bp, Homo sapiens
tgctatgttgcccag

SEQ ID NO: 14847 - DNA, 15 bp, Homo sapiens
ttgctatgttgccca

SEQ ID NO: 14848 - DNA, 15 bp, Homo sapiens
cttgctatgttgccc

SEQ ID NO: 14849 - DNA, 15 bp, Homo sapiens
tcttgctatgttgcc

SEQ ID NO: 14850 - DNA, 15 bp, Homo sapiens
gtcttgctatgttgc

SEQ ID NO: 14851 - DNA, 15 bp, Homo sapiens
ggtcttgctatgttg

SEQ ID NO: 14852 - DNA, 15 bp, Homo sapiens
gggtcttgctatgtt

SEQ ID NO: 14853 - DNA, 15 bp, Homo sapiens
agggtcttgctatgt

SEQ ID NO: 14854 - DNA, 15 bp, Homo sapiens
cagggtcttgctatg

SEQ ID NO: 14855 - DNA, 15 bp, Homo sapiens
acagggtcttgctat

SEQ ID NO: 14856 - DNA, 15 bp, Homo sapiens
gacagggtcttgcta

SEQ ID NO: 14857 - DNA, 15 bp, Homo sapiens
agacagggtcttgct

SEQ ID NO: 14858 - DNA, 15 bp, Homo sapiens
aagacagggtcttgc

SEQ ID NO: 14859 - DNA, 15 bp, Homo sapiens
aaagacagggtcttg

SEQ ID NO: 14860 - DNA, 15 bp, Homo sapiens
aaaagacagggtctt

SEQ ID NO: 14861 - DNA, 15 bp, Homo sapiens
taaaagacagggtct

SEQ ID NO: 14862 - DNA, 15 bp, Homo sapiens
ttaaaagacagggtc

SEQ ID NO: 14863 - DNA, 15 bp, Homo sapiens
tttaaaagacagggt

SEQ ID NO: 14864 - DNA, 15 bp, Homo sapiens
ttttaaaagacaggg

SEQ ID NO: 14865 - DNA, 15 bp, Homo sapiens
tttttaaaagacagg

SEQ ID NO: 14866 - DNA, 15 bp, Homo sapiens
ttttttaaaagacag

SEQ ID NO: 14867 - DNA, 15 bp, Homo sapiens
tttttttaaaagaca

SEQ ID NO: 14868 - DNA, 15 bp, Homo sapiens
ttttttttaaaagac

SEQ ID NO: 14869 - DNA, 15 bp, Homo sapiens
tttttttttaaaaga

SEQ ID NO: 14870 - DNA, 15 bp, Homo sapiens
ttttttttttaaaag

SEQ ID NO: 14871 - DNA, 15 bp, Homo sapiens
gattttttttttttt

SEQ ID NO: 14872 - DNA, 15 bp, Homo sapiens
ggatttttttttttt

SEQ ID NO: 14873 - DNA, 15 bp, Homo sapiens
tggattttttttttt

SEQ ID NO: 14874 - DNA, 15 bp, Homo sapiens
ctggatttttttttt

SEQ ID NO: 14875 - DNA, 15 bp, Homo sapiens
gctggattttttttt

SEQ ID NO: 14876 - DNA, 15 bp, Homo sapiens
ggctggatttttttt

SEQ ID NO: 14877 - DNA, 15 bp, Homo sapiens
cggctggattttttt

SEQ ID NO: 14878 - DNA, 15 bp, Homo sapiens
ccggctggatttttt

SEQ ID NO: 14879 - DNA, 15 bp, Homo sapiens
cccggctggattttt

SEQ ID NO: 14880 - DNA, 15 bp, Homo sapiens
acccggctggatttt

SEQ ID NO: 14881 - DNA, 15 bp, Homo sapiens
cacccggctggattt

SEQ ID NO: 14882 - DNA, 15 bp, Homo sapiens
acacccggctggatt

SEQ ID NO: 14883 - DNA, 15 bp, Homo sapiens
cacacccggctggat

SEQ ID NO: 14884 - DNA, 15 bp, Homo sapiens
ccacacccggctgga

SEQ ID NO: 14885 - DNA, 15 bp, Homo sapiens
accacacccggctgg

SEQ ID NO: 14886 - DNA, 15 bp, Homo sapiens
caccacacccggctg

SEQ ID NO: 14887 - DNA, 15 bp, Homo sapiens
ccaccacacccggct

SEQ ID NO: 14888 - DNA, 15 bp, Homo sapiens
atgagccaccacacc

SEQ ID NO: 14889 - DNA, 15 bp, Homo sapiens
catgagccaccacac

SEQ ID NO: 14890 - DNA, 15 bp, Homo sapiens
gcatgagccaccaca

SEQ ID NO: 14891 - DNA, 15 bp, Homo sapiens
ggcatgagccaccac

SEQ ID NO: 14892 - DNA, 15 bp, Homo sapiens
tcaaagtgctgggat

SEQ ID NO: 14893 - DNA, 15 bp, Homo sapiens
ctcaaagtgctggga

SEQ ID NO: 14894 - DNA, 15 bp, Homo sapiens
tctcaaagtgctggg

SEQ ID NO: 14895 - DNA, 15 bp, Homo sapiens
ctctcaaagtgctgg

SEQ ID NO: 14896 - DNA, 15 bp, Homo sapiens
cctctcaaagtgctg

SEQ ID NO: 14897 - DNA, 15 bp, Homo sapiens
gcctctcaaagtgct

SEQ ID NO: 14898 - DNA, 15 bp, Homo sapiens
agcctctcaaagtgc

SEQ ID NO: 14899 - DNA, 15 bp, Homo sapiens
cagcctctcaaagtg

SEQ ID NO: 14900 - DNA, 15 bp, Homo sapiens
tcagcctctcaaagt

SEQ ID NO: 14901 - DNA, 15 bp, Homo sapiens
ctcagcctctcaaag

SEQ ID NO: 14902 - DNA, 15 bp, Homo sapiens
cctcagcctctcaaa

SEQ ID NO: 14903 - DNA, 15 bp, Homo sapiens
gcctcagcctctcaa

SEQ ID NO: 14904 - DNA, 15 bp, Homo sapiens
tgcctcagcctctca

SEQ ID NO: 14905 - DNA, 15 bp, Homo sapiens
ctgcctcagcctctc

SEQ ID NO: 14906 - DNA, 15 bp, Homo sapiens
cctgcctcagcctct

SEQ ID NO: 14907 - DNA, 15 bp, Homo sapiens
gcctgcctcagcctc

SEQ ID NO: 14908 - DNA, 15 bp, Homo sapiens
tgcctgcctcagcct

SEQ ID NO: 14909 - DNA, 15 bp, Homo sapiens
ctgcctgcctcagcc

SEQ ID NO: 14910 - DNA, 15 bp, Homo sapiens
tctgcctgcctcagc

SEQ ID NO: 14911 - DNA, 15 bp, Homo sapiens
atctgcctgcctcag

SEQ ID NO: 14912 - DNA, 15 bp, Homo sapiens
gatctgcctgcctca

SEQ ID NO: 14913 - DNA, 15 bp, Homo sapiens
tgatctgcctgcctc

SEQ ID NO: 14914 - DNA, 15 bp, Homo sapiens
gtgatctgcctgcct

SEQ ID NO: 14915 - DNA, 15 bp, Homo sapiens
ggtgatctgcctgcc

SEQ ID NO: 14916 - DNA, 15 bp, Homo sapiens
aggtgatctgcctgc

SEQ ID NO: 14917 - DNA, 15 bp, Homo sapiens
caggtgatctgcctg

SEQ ID NO: 14918 - DNA, 15 bp, Homo sapiens
tcaggtgatctgcct

SEQ ID NO: 14919 - DNA, 15 bp, Homo sapiens
ctcaggtgatctgcc

SEQ ID NO: 14920 - DNA, 15 bp, Homo sapiens
cctcaggtgatctgc

SEQ ID NO: 14921 - DNA, 15 bp, Homo sapiens
acctcaggtgatctg

SEQ ID NO: 14922 - DNA, 15 bp, Homo sapiens
gacctcaggtgatct

SEQ ID NO: 14923 - DNA, 15 bp, Homo sapiens
aaactcctgacctca

SEQ ID NO: 14924 - DNA, 15 bp, Homo sapiens
caaactcctgacctc

SEQ ID NO: 14925 - DNA, 15 bp, Homo sapiens
tctcaaactcctgac

SEQ ID NO: 14926 - DNA, 15 bp, Homo sapiens
agtatctttgatctc

SEQ ID NO: 14927 - DNA, 15 bp, Homo sapiens
aagtatctttgatct

SEQ ID NO: 14928 - DNA, 15 bp, Homo sapiens
aaagtatctttgatc

SEQ ID NO: 14929 - DNA, 15 bp, Homo sapiens
gaaagtatctttgat

SEQ ID NO: 14930 - DNA, 15 bp, Homo sapiens
tgaaagtatctttga

SEQ ID NO: 14931 - DNA, 15 bp, Homo sapiens
atgaaagtatctttg

SEQ ID NO: 14932 - DNA, 15 bp, Homo sapiens
tatgaaagtatcttt

SEQ ID NO: 14933 - DNA, 15 bp, Homo sapiens
atatgaaagtatctt

SEQ ID NO: 14934 - DNA, 15 bp, Homo sapiens
gatatgaaagtatct

SEQ ID NO: 14935 - DNA, 15 bp, Homo sapiens
tgatatgaaagtatc

SEQ ID NO: 14936 - DNA, 15 bp, Homo sapiens
atgatatgaaagtat

SEQ ID NO: 14937 - DNA, 15 bp, Homo sapiens
tatgatatgaaagta

SEQ ID NO: 14938 - DNA, 15 bp, Homo sapiens
atatgatatgaaagt

SEQ ID NO: 14939 - DNA, 15 bp, Homo sapiens
aatatgatatgaaag

SEQ ID NO: 14940 - DNA, 15 bp, Homo sapiens
taatatgatatgaaa

SEQ ID NO: 14941 - DNA, 15 bp, Homo sapiens
ataatatgatatgaa

SEQ ID NO: 14942 - DNA, 15 bp, Homo sapiens
tataatatgatatga

SEQ ID NO: 14943 - DNA, 15 bp, Homo sapiens
ctataatatgatatg

SEQ ID NO: 14944 - DNA, 15 bp, Homo sapiens
actataatatgatat

SEQ ID NO: 14945 - DNA, 15 bp, Homo sapiens
aactataatatgata

SEQ ID NO: 14946 - DNA, 15 bp, Homo sapiens
caactataatatgat

SEQ ID NO: 14947 - DNA, 15 bp, Homo sapiens
acaactataatatga

SEQ ID NO: 14948 - DNA, 15 bp, Homo sapiens
aacaactataatatg

SEQ ID NO: 14949 - DNA, 15 bp, Homo sapiens
taacaactataatat

SEQ ID NO: 14950 - DNA, 15 bp, Homo sapiens
gtaacaactataata

SEQ ID NO: 14951 - DNA, 15 bp, Homo sapiens
tgtaacaactataat

SEQ ID NO: 14952 - DNA, 15 bp, Homo sapiens
ctgtaacaactataa

SEQ ID NO: 14953 - DNA, 15 bp, Homo sapiens
tctgtaacaactata

SEQ ID NO: 14954 - DNA, 15 bp, Homo sapiens
atctgtaacaactat

SEQ ID NO: 14955 - DNA, 15 bp, Homo sapiens
tatctgtaacaacta

SEQ ID NO: 14956 - DNA, 15 bp, Homo sapiens
atatctgtaacaact

SEQ ID NO: 14957 - DNA, 15 bp, Homo sapiens
aatatctgtaacaac

SEQ ID NO: 14958 - DNA, 15 bp, Homo sapiens
aaatatctgtaacaa

SEQ ID NO: 14959 - DNA, 15 bp, Homo sapiens
aaaatatctgtaaca

SEQ ID NO: 14960 - DNA, 15 bp, Homo sapiens
caaaatatctgtaac

SEQ ID NO: 14961 - DNA, 15 bp, Homo sapiens
tcaaaatatctgtaa

SEQ ID NO: 14962 - DNA, 15 bp, Homo sapiens
ttcaaaatatctgta

SEQ ID NO: 14963 - DNA, 15 bp, Homo sapiens
tttcaaaatatctgt

SEQ ID NO: 14964 - DNA, 15 bp, Homo sapiens
atttcaaaatatctg

SEQ ID NO: 14965 - DNA, 15 bp, Homo sapiens
tatttcaaaatatct

SEQ ID NO: 14966 - DNA, 15 bp, Homo sapiens
atatttcaaaatatc

SEQ ID NO: 14967 - DNA, 15 bp, Homo sapiens
tatatttcaaaatat

SEQ ID NO: 14968 - DNA, 15 bp, Homo sapiens
atatatttcaaaata

SEQ ID NO: 14969 - DNA, 15 bp, Homo sapiens
tatatatttcaaaat

SEQ ID NO: 14970 - DNA, 15 bp, Homo sapiens
atatatatttcaaaa

SEQ ID NO: 14971 - DNA, 15 bp, Homo sapiens
catatatatttcaaa

SEQ ID NO: 14972 - DNA, 15 bp, Homo sapiens
acatatatatttcaa

SEQ ID NO: 14973 - DNA, 15 bp, Homo sapiens
gacatatatatttca

SEQ ID NO: 14974 - DNA, 15 bp, Homo sapiens
ggacatatatatttc

SEQ ID NO: 14975 - DNA, 15 bp, Homo sapiens
tggacatatatattt

SEQ ID NO: 14976 - DNA, 15 bp, Homo sapiens
atggacatatatatt

SEQ ID NO: 14977 - DNA, 15 bp, Homo sapiens
gatggacatatatat

SEQ ID NO: 14978 - DNA, 15 bp, Homo sapiens
tgatggacatatata

SEQ ID NO: 14979 - DNA, 15 bp, Homo sapiens
gtgatggacatatat

SEQ ID NO: 14980 - DNA, 15 bp, Homo sapiens
agtgatggacatata

SEQ ID NO: 14981 - DNA, 15 bp, Homo sapiens
cagtgatggacatat

SEQ ID NO: 14982 - DNA, 15 bp, Homo sapiens
gcagtgatggacata

SEQ ID NO: 14983 - DNA, 15 bp, Homo sapiens
agcagtgatggacat

SEQ ID NO: 14984 - DNA, 15 bp, Homo sapiens
aagcagtgatggaca

SEQ ID NO: 14985 - DNA, 15 bp, Homo sapiens
gaagcagtgatggac

SEQ ID NO: 14986 - DNA, 15 bp, Homo sapiens
tgaagcagtgatgga

SEQ ID NO: 14987 - DNA, 15 bp, Homo sapiens
ttgaagcagtgatgg

SEQ ID NO: 14988 - DNA, 15 bp, Homo sapiens
tttgaagcagtgatg

SEQ ID NO: 14989 - DNA, 15 bp, Homo sapiens
gtttgaagcagtgat

SEQ ID NO: 14990 - DNA, 15 bp, Homo sapiens
agtttgaagcagtga

SEQ ID NO: 14991 - DNA, 15 bp, Homo sapiens
aagtttgaagcagtg

SEQ ID NO: 14992 - DNA, 15 bp, Homo sapiens
taagtttgaagcagt

SEQ ID NO: 14993 - DNA, 15 bp, Homo sapiens
ttaagtttgaagcag

SEQ ID NO: 14994 - DNA, 15 bp, Homo sapiens
cttaagtttgaagca

SEQ ID NO: 14995 - DNA, 15 bp, Homo sapiens
ccttaagtttgaagc

SEQ ID NO: 14996 - DNA, 15 bp, Homo sapiens
accttaagtttgaag

SEQ ID NO: 14997 - DNA, 15 bp, Homo sapiens
taccttaagtttgaa

SEQ ID NO: 14998 - DNA, 15 bp, Homo sapiens
ttaccttaagtttga

SEQ ID NO: 14999 - DNA, 15 bp, Homo sapiens
attaccttaagtttg

SEQ ID NO: 15000 - DNA, 15 bp, Homo sapiens
aattaccttaagttt

SEQ ID NO: 15001 - DNA, 15 bp, Homo sapiens
taattaccttaagtt

SEQ ID NO: 15002 - DNA, 15 bp, Homo sapiens
ataattaccttaagt

SEQ ID NO: 15003 - DNA, 15 bp, Homo sapiens
aataattaccttaag

SEQ ID NO: 15004 - DNA, 15 bp, Homo sapiens
taataattaccttaa

SEQ ID NO: 15005 - DNA, 15 bp, Homo sapiens
ctaataattacctta

SEQ ID NO: 15006 - DNA, 15 bp, Homo sapiens
tctaataattacctt

SEQ ID NO: 15007 - DNA, 15 bp, Homo sapiens
gtctaataattacct

SEQ ID NO: 15008 - DNA, 15 bp, Homo sapiens
ggtctaataattacc

SEQ ID NO: 15009 - DNA, 15 bp, Homo sapiens
gggtctaataattac

SEQ ID NO: 15010 - DNA, 15 bp, Homo sapiens
tgggtctaataatta

SEQ ID NO: 15011 - DNA, 15 bp, Homo sapiens
atgggtctaataatt

SEQ ID NO: 15012 - DNA, 15 bp, Homo sapiens
gatgggtctaataat

SEQ ID NO: 15013 - DNA, 15 bp, Homo sapiens
agatgggtctaataa

SEQ ID NO: 15014 - DNA, 15 bp, Homo sapiens
gagatgggtctaata

SEQ ID NO: 15015 - DNA, 15 bp, Homo sapiens
agagatgggtctaat

SEQ ID NO: 15016 - DNA, 15 bp, Homo sapiens
tagagatgggtctaa

SEQ ID NO: 15017 - DNA, 15 bp, Homo sapiens
ctagagatgggtcta

SEQ ID NO: 15018 - DNA, 15 bp, Homo sapiens
tctagagatgggtct

SEQ ID NO: 15019 - DNA, 15 bp, Homo sapiens
atctagagatgggtc

SEQ ID NO: 15020 - DNA, 15 bp, Homo sapiens
gatctagagatgggt

SEQ ID NO: 15021 - DNA, 15 bp, Homo sapiens
agatctagagatggg

SEQ ID NO: 15022 - DNA, 15 bp, Homo sapiens
cagatctagagatgg

SEQ ID NO: 15023 - DNA, 15 bp, Homo sapiens
ccagatctagagatg

SEQ ID NO: 15024 - DNA, 15 bp, Homo sapiens
accagatctagagat

SEQ ID NO: 15025 - DNA, 15 bp, Homo sapiens
aaccagatctagaga

SEQ ID NO: 15026 - DNA, 15 bp, Homo sapiens
taaccagatctagag

SEQ ID NO: 15027 - DNA, 15 bp, Homo sapiens
ataaccagatctaga

SEQ ID NO: 15028 - DNA, 15 bp, Homo sapiens
aataaccagatctag

SEQ ID NO: 15029 - DNA, 15 bp, Homo sapiens
aaataaccagatcta

SEQ ID NO: 15030 - DNA, 15 bp, Homo sapiens
taaataaccagatct

SEQ ID NO: 15031 - DNA, 15 bp, Homo sapiens
ttaaataaccagatc

SEQ ID NO: 15032 - DNA, 15 bp, Homo sapiens
attaaataaccagat

SEQ ID NO: 15033 - DNA, 15 bp, Homo sapiens
cattaaataaccaga

SEQ ID NO: 15034 - DNA, 15 bp, Homo sapiens
tcattaaataaccag

SEQ ID NO: 15035 - DNA, 15 bp, Homo sapiens
atcattaaataacca

SEQ ID NO: 15036 - DNA, 15 bp, Homo sapiens
aatcattaaataacc

SEQ ID NO: 15037 - DNA, 15 bp, Homo sapiens
aaatcattaaataac

SEQ ID NO: 15038 - DNA, 15 bp, Homo sapiens
taaatcattaaataa

SEQ ID NO: 15039 - DNA, 15 bp, Homo sapiens
gtaaatcattaaata

SEQ ID NO: 15040 - DNA, 15 bp, Homo sapiens
agtaaatcattaaat

SEQ ID NO: 15041 - DNA, 15 bp, Homo sapiens
cagtaaatcattaaa

SEQ ID NO: 15042 - DNA, 15 bp, Homo sapiens
tcagtaaatcattaa

SEQ ID NO: 15043 - DNA, 15 bp, Homo sapiens
ttcagtaaatcatta

SEQ ID NO: 15044 - DNA, 15 bp, Homo sapiens
cttcagtaaatcatt

SEQ ID NO: 15045 - DNA, 15 bp, Homo sapiens
tcttcagtaaatcat

SEQ ID NO: 15046 - DNA, 15 bp, Homo sapiens
ttcttcagtaaatca

SEQ ID NO: 15047 - DNA, 15 bp, Homo sapiens
cttcttcagtaaatc

SEQ ID NO: 15048 - DNA, 15 bp, Homo sapiens
gcttcttcagtaaat

SEQ ID NO: 15049 - DNA, 15 bp, Homo sapiens
tgcttcttcagtaaa

SEQ ID NO: 15050 - DNA, 15 bp, Homo sapiens
gtgcttcttcagtaa

SEQ ID NO: 15051 - DNA, 15 bp, Homo sapiens
tgtgcttcttcagta

SEQ ID NO: 15052 - DNA, 15 bp, Homo sapiens
atgtgcttcttcagt

SEQ ID NO: 15053 - DNA, 15 bp, Homo sapiens
tatgtgcttcttcag

SEQ ID NO: 15054 - DNA, 15 bp, Homo sapiens
atatgtgcttcttca

SEQ ID NO: 15055 - DNA, 15 bp, Homo sapiens
aatatgtgcttcttc

SEQ ID NO: 15056 - DNA, 15 bp, Homo sapiens
taatatgtgcttctt

SEQ ID NO: 15057 - DNA, 15 bp, Homo sapiens
ataatatgtgcttct

SEQ ID NO: 15058 - DNA, 15 bp, Homo sapiens
aataatatgtgcttc

SEQ ID NO: 15059 - DNA, 15 bp, Homo sapiens
aaataatatgtgctt

SEQ ID NO: 15060 - DNA, 15 bp, Homo sapiens
caaataatatgtgct

SEQ ID NO: 15061 - DNA, 15 bp, Homo sapiens
tcaaataatatgtgc

SEQ ID NO: 15062 - DNA, 15 bp, Homo sapiens
ctcaaataatatgtg

SEQ ID NO: 15063 - DNA, 15 bp, Homo sapiens
tctcaaataatatgt

SEQ ID NO: 15064 - DNA, 15 bp, Homo sapiens
ttctcaaataatatg

SEQ ID NO: 15065 - DNA, 15 bp, Homo sapiens
gttctcaaataatat

SEQ ID NO: 15066 - DNA, 15 bp, Homo sapiens
cgttctcaaataata

SEQ ID NO: 15067 - DNA, 15 bp, Homo sapiens
tcgttctcaaataat

SEQ ID NO: 15068 - DNA, 15 bp, Homo sapiens
ttcgttctcaaataa

SEQ ID NO: 15069 - DNA, 15 bp, Homo sapiens
gttcgttctcaaata

SEQ ID NO: 15070 - DNA, 15 bp, Homo sapiens
agttcgttctcaaat

SEQ ID NO: 15071 - DNA, 15 bp, Homo sapiens
gagttcgttctcaaa

SEQ ID NO: 15072 - DNA, 15 bp, Homo sapiens
agagttcgttctcaa

SEQ ID NO: 15073 - DNA, 15 bp, Homo sapiens
aagagttcgttctca

SEQ ID NO: 15074 - DNA, 15 bp, Homo sapiens
caagagttcgttctc

SEQ ID NO: 15075 - DNA, 15 bp, Homo sapiens
tcaagagttcgttct

SEQ ID NO: 15076 - DNA, 15 bp, Homo sapiens
ttcaagagttcgttc

SEQ ID NO: 15077 - DNA, 15 bp, Homo sapiens
tttcaagagttcgtt

SEQ ID NO: 15078 - DNA, 15 bp, Homo sapiens
atttcaagagttcgt

SEQ ID NO: 15079 - DNA, 15 bp, Homo sapiens
tatttcaagagttcg

SEQ ID NO: 15080 - DNA, 15 bp, Homo sapiens
atatttcaagagttc

SEQ ID NO: 15081 - DNA, 15 bp, Homo sapiens
catatttcaagagtt

SEQ ID NO: 15082 - DNA, 15 bp, Homo sapiens
acatatttcaagagt

SEQ ID NO: 15083 - DNA, 15 bp, Homo sapiens
aacatatttcaagag

SEQ ID NO: 15084 - DNA, 15 bp, Homo sapiens
caacatatttcaaga

SEQ ID NO: 15085 - DNA, 15 bp, Homo sapiens
acaacatatttcaag

SEQ ID NO: 15086 - DNA, 15 bp, Homo sapiens
aacaacatatttcaa

SEQ ID NO: 15087 - DNA, 15 bp, Homo sapiens
taacaacatatttca

SEQ ID NO: 15088 - DNA, 15 bp, Homo sapiens
ttaacaacatatttc

SEQ ID NO: 15089 - DNA, 15 bp, Homo sapiens
attaacaacatattt

SEQ ID NO: 15090 - DNA, 15 bp, Homo sapiens
aattaacaacatatt

SEQ ID NO: 15091 - DNA, 15 bp, Homo sapiens
aaattaacaacatat

SEQ ID NO: 15092 - DNA, 15 bp, Homo sapiens
gaaattaacaacata

SEQ ID NO: 15093 - DNA, 15 bp, Homo sapiens
agaaattaacaacat

SEQ ID NO: 15094 - DNA, 15 bp, Homo sapiens
cagaaattaacaaca

SEQ ID NO: 15095 - DNA, 15 bp, Homo sapiens
acagaaattaacaac

SEQ ID NO: 15096 - DNA, 15 bp, Homo sapiens
cacagaaattaacaa

SEQ ID NO: 15097 - DNA, 15 bp, Homo sapiens
gcacagaaattaaca

SEQ ID NO: 15098 - DNA, 15 bp, Homo sapiens
tgcacagaaattaac

SEQ ID NO: 15099 - DNA, 15 bp, Homo sapiens
atgcacagaaattaa

SEQ ID NO: 15100 - DNA, 15 bp, Homo sapiens
aatgcacagaaatta

SEQ ID NO: 15101 - DNA, 15 bp, Homo sapiens
aaatgcacagaaatt

SEQ ID NO: 15102 - DNA, 15 bp, Homo sapiens
aaaatgcacagaaat

SEQ ID NO: 15103 - DNA, 15 bp, Homo sapiens
taaaatgcacagaaa

SEQ ID NO: 15104 - DNA, 15 bp, Homo sapiens
gtaaaatgcacagaa

SEQ ID NO: 15105 - DNA, 15 bp, Homo sapiens
tgtaaaatgcacaga

SEQ ID NO: 15106 - DNA, 15 bp, Homo sapiens
gtgtaaaatgcacag

SEQ ID NO: 15107 - DNA, 15 bp, Homo sapiens
tgtgtaaaatgcaca

SEQ ID NO: 15108 - DNA, 15 bp, Homo sapiens
atgtgtaaaatgcac

SEQ ID NO: 15109 - DNA, 15 bp, Homo sapiens
aatgtgtaaaatgca

SEQ ID NO: 15110 - DNA, 15 bp, Homo sapiens
aaatgtgtaaaatgc

SEQ ID NO: 15111 - DNA, 15 bp, Homo sapiens
gaaatgtgtaaaatg

SEQ ID NO: 15112 - DNA, 15 bp, Homo sapiens
tgaaatgtgtaaaat

SEQ ID NO: 15113 - DNA, 15 bp, Homo sapiens
ttgaaatgtgtaaaa

SEQ ID NO: 15114 - DNA, 15 bp, Homo sapiens
tttgaaatgtgtaaa

SEQ ID NO: 15115 - DNA, 15 bp, Homo sapiens
ttttgaaatgtgtaa

SEQ ID NO: 15116 - DNA, 15 bp, Homo sapiens
gttttgaaatgtgta

SEQ ID NO: 15117 - DNA, 15 bp, Homo sapiens
tgttttgaaatgtgt

SEQ ID NO: 15118 - DNA, 15 bp, Homo sapiens
atgttttgaaatgtg

SEQ ID NO: 15119 - DNA, 15 bp, Homo sapiens
aatgttttgaaatgt

SEQ ID NO: 15120 - DNA, 15 bp, Homo sapiens
gaatgttttgaaatg

SEQ ID NO: 15121 - DNA, 15 bp, Homo sapiens
agaatgttttgaaat

SEQ ID NO: 15122 - DNA, 15 bp, Homo sapiens
aagaatgttttgaaa

SEQ ID NO: 15123 - DNA, 15 bp, Homo sapiens
gaagaatgttttgaa

SEQ ID NO: 15124 - DNA, 15 bp, Homo sapiens
agaagaatgttttga

SEQ ID NO: 15125 - DNA, 15 bp, Homo sapiens
cagaagaatgttttg

SEQ ID NO: 15126 - DNA, 15 bp, Homo sapiens
tcagaagaatgtttt

SEQ ID NO: 15127 - DNA, 15 bp, Homo sapiens
ctcagaagaatgttt

SEQ ID NO: 15128 - DNA, 15 bp, Homo sapiens
cctcagaagaatgtt

SEQ ID NO: 15129 - DNA, 15 bp, Homo sapiens
tcctcagaagaatgt

SEQ ID NO: 15130 - DNA, 15 bp, Homo sapiens
ctcctcagaagaatg

SEQ ID NO: 15131 - DNA, 15 bp, Homo sapiens
cctcctcagaagaat

SEQ ID NO: 15132 - DNA, 15 bp, Homo sapiens
ccctcctcagaagaa

SEQ ID NO: 15133 - DNA, 15 bp, Homo sapiens
cccctcctcagaaga

SEQ ID NO: 15134 - DNA, 15 bp, Homo sapiens
acccctcctcagaag

SEQ ID NO: 15135 - DNA, 15 bp, Homo sapiens
gacccctcctcagaa

SEQ ID NO: 15136 - DNA, 15 bp, Homo sapiens
ggacccctcctcaga

SEQ ID NO: 15137 - DNA, 15 bp, Homo sapiens
tggacccctcctcag

SEQ ID NO: 15138 - DNA, 15 bp, Homo sapiens
ctggacccctcctca

SEQ ID NO: 15139 - DNA, 15 bp, Homo sapiens
tctggacccctcctc

SEQ ID NO: 15140 - DNA, 15 bp, Homo sapiens
ttctggacccctcct

SEQ ID NO: 15141 - DNA, 15 bp, Homo sapiens
cttctggacccctcc

SEQ ID NO: 15142 - DNA, 15 bp, Homo sapiens
ccttctggacccctc

SEQ ID NO: 15143 - DNA, 15 bp, Homo sapiens
gccttctggacccct

SEQ ID NO: 15144 - DNA, 15 bp, Homo sapiens
ggccttctggacccc

SEQ ID NO: 15145 - DNA, 15 bp, Homo sapiens
tggccttctggaccc

SEQ ID NO: 15146 - DNA, 15 bp, Homo sapiens
ttggccttctggacc

SEQ ID NO: 15147 - DNA, 15 bp, Homo sapiens
tttggccttctggac

SEQ ID NO: 15148 - DNA, 15 bp, Homo sapiens
ttttggccttctgga

SEQ ID NO: 15149 - DNA, 15 bp, Homo sapiens
cttttggccttctgg

SEQ ID NO: 15150 - DNA, 15 bp, Homo sapiens
ccttttggccttctg

SEQ ID NO: 15151 - DNA, 15 bp, Homo sapiens
cccttttggccttct

SEQ ID NO: 15152 - DNA, 15 bp, Homo sapiens
acccttttggccttc

SEQ ID NO: 15153 - DNA, 15 bp, Homo sapiens
gacccttttggcctt

SEQ ID NO: 15154 - DNA, 15 bp, Homo sapiens
ggacccttttggcct

SEQ ID NO: 15155 - DNA, 15 bp, Homo sapiens
tggacccttttggcc

SEQ ID NO: 15156 - DNA, 15 bp, Homo sapiens
atggacccttttggc

SEQ ID NO: 15157 - DNA, 15 bp, Homo sapiens
catggacccttttgg

SEQ ID NO: 15158 - DNA, 15 bp, Homo sapiens
ccatggacccttttg

SEQ ID NO: 15159 - DNA, 15 bp, Homo sapiens
gccatggaccctttt

SEQ ID NO: 15160 - DNA, 15 bp, Homo sapiens
tgccatggacccttt

SEQ ID NO: 15161 - DNA, 15 bp, Homo sapiens
ctgccatggaccctt

SEQ ID NO: 15162 - DNA, 15 bp, Homo sapiens
tctgccatggaccct

SEQ ID NO: 15163 - DNA, 15 bp, Homo sapiens
ttctgccatggaccc

SEQ ID NO: 15164 - DNA, 15 bp, Homo sapiens
tttctgccatggacc

SEQ ID NO: 15165 - DNA, 15 bp, Homo sapiens
ttttctgccatggac

SEQ ID NO: 15166 - DNA, 15 bp, Homo sapiens
tttttctgccatgga

SEQ ID NO: 15167 - DNA, 15 bp, Homo sapiens
ctttttctgccatgg

SEQ ID NO: 15168 - DNA, 15 bp, Homo sapiens
cctttttctgccatg

SEQ ID NO: 15169 - DNA, 15 bp, Homo sapiens
acctttttctgccat

SEQ ID NO: 15170 - DNA, 15 bp, Homo sapiens
aacctttttctgcca

SEQ ID NO: 15171 - DNA, 15 bp, Homo sapiens
taacctttttctgcc

SEQ ID NO: 15172 - DNA, 15 bp, Homo sapiens
ttaacctttttctgc

SEQ ID NO: 15173 - DNA, 15 bp, Homo sapiens
cttaacctttttctg

SEQ ID NO: 15174 - DNA, 15 bp, Homo sapiens
tcttaacctttttct

SEQ ID NO: 15175 - DNA, 15 bp, Homo sapiens
ttcttaacctttttc

SEQ ID NO: 15176 - DNA, 15 bp, Homo sapiens
gttcttaaccttttt

SEQ ID NO: 15177 - DNA, 15 bp, Homo sapiens
tgttcttaacctttt

SEQ ID NO: 15178 - DNA, 15 bp, Homo sapiens
gtgttcttaaccttt

SEQ ID NO: 15179 - DNA, 15 bp, Homo sapiens
ggtgttcttaacctt

SEQ ID NO: 15180 - DNA, 15 bp, Homo sapiens
aggtgttcttaacct

SEQ ID NO: 15181 - DNA, 15 bp, Homo sapiens
caggtgttcttaacc

SEQ ID NO: 15182 - DNA, 15 bp, Homo sapiens
acaggtgttcttaac

SEQ ID NO: 15183 - DNA, 15 bp, Homo sapiens
aacaggtgttcttaa

SEQ ID NO: 15184 - DNA, 15 bp, Homo sapiens
gaacaggtgttctta

SEQ ID NO: 15185 - DNA, 15 bp, Homo sapiens
agaacaggtgttctt

SEQ ID NO: 15186 - DNA, 15 bp, Homo sapiens
cagaacaggtgttct

SEQ ID NO: 15187 - DNA, 15 bp, Homo sapiens
acagaacaggtgttc

SEQ ID NO: 15188 - DNA, 15 bp, Homo sapiens
tacagaacaggtgtt

SEQ ID NO: 15189 - DNA, 15 bp, Homo sapiens
gtacagaacaggtgt

SEQ ID NO: 15190 - DNA, 15 bp, Homo sapiens
agtacagaacaggtg

SEQ ID NO: 15191 - DNA, 15 bp, Homo sapiens
aagtacagaacaggt

SEQ ID NO: 15192 - DNA, 15 bp, Homo sapiens
aaagtacagaacagg

SEQ ID NO: 15193 - DNA, 15 bp, Homo sapiens
caaagtacagaacag

SEQ ID NO: 15194 - DNA, 15 bp, Homo sapiens
acaaagtacagaaca

SEQ ID NO: 15195 - DNA, 15 bp, Homo sapiens
tacaaagtacagaac

SEQ ID NO: 15196 - DNA, 15 bp, Homo sapiens
gtacaaagtacagaa

SEQ ID NO: 15197 - DNA, 15 bp, Homo sapiens
ggtacaaagtacaga

SEQ ID NO: 15198 - DNA, 15 bp, Homo sapiens
tggtacaaagtacag

SEQ ID NO: 15199 - DNA, 15 bp, Homo sapiens
atggtacaaagtaca

SEQ ID NO: 15200 - DNA, 15 bp, Homo sapiens
catggtacaaagtac

SEQ ID NO: 15201 - DNA, 15 bp, Homo sapiens
acatggtacaaagta

SEQ ID NO: 15202 - DNA, 15 bp, Homo sapiens
cacatggtacaaagt

SEQ ID NO: 15203 - DNA, 15 bp, Homo sapiens
ccacatggtacaaag

SEQ ID NO: 15204 - DNA, 15 bp, Homo sapiens
gccacatggtacaaa

SEQ ID NO: 15205 - DNA, 15 bp, Homo sapiens
agccacatggtacaa

SEQ ID NO: 15206 - DNA, 15 bp, Homo sapiens
tagccacatggtaca

SEQ ID NO: 15207 - DNA, 15 bp, Homo sapiens
gtagccacatggtac

SEQ ID NO: 15208 - DNA, 15 bp, Homo sapiens
tgtagccacatggta

SEQ ID NO: 15209 - DNA, 15 bp, Homo sapiens
ttgtagccacatggt

SEQ ID NO: 15210 - DNA, 15 bp, Homo sapiens
tttgtagccacatgg

SEQ ID NO: 15211 - DNA, 15 bp, Homo sapiens
atttgtagccacatg

SEQ ID NO: 15212 - DNA, 15 bp, Homo sapiens
tatttgtagccacat

SEQ ID NO: 15213 - DNA, 15 bp, Homo sapiens
atatttgtagccaca

SEQ ID NO: 15214 - DNA, 15 bp, Homo sapiens
tatatttgtagccac

SEQ ID NO: 15215 - DNA, 15 bp, Homo sapiens
ttatatttgtagcca

SEQ ID NO: 15216 - DNA, 15 bp, Homo sapiens
tttatatttgtagcc

SEQ ID NO: 15217 - DNA, 15 bp, Homo sapiens
ttttatatttgtagc

SEQ ID NO: 15218 - DNA, 15 bp, Homo sapiens
tttttatatttgtag

SEQ ID NO: 15219 - DNA, 15 bp, Homo sapiens
gtttttatatttgta

SEQ ID NO: 15220 - DNA, 15 bp, Homo sapiens
tgtttttatatttgt

SEQ ID NO: 15221 - DNA, 15 bp, Homo sapiens
ctgtttttatatttg

SEQ ID NO: 15222 - DNA, 15 bp, Homo sapiens
tctgtttttatattt

SEQ ID NO: 15223 - DNA, 15 bp, Homo sapiens
gtctgtttttatatt

SEQ ID NO: 15224 - DNA, 15 bp, Homo sapiens
cgtctgtttttatat

SEQ ID NO: 15225 - DNA, 15 bp, Homo sapiens
acgtctgtttttata

SEQ ID NO: 15226 - DNA, 15 bp, Homo sapiens
aacgtctgtttttat

SEQ ID NO: 15227 - DNA, 15 bp, Homo sapiens
taacgtctgttttta

SEQ ID NO: 15228 - DNA, 15 bp, Homo sapiens
ttaacgtctgttttt

SEQ ID NO: 15229 - DNA, 15 bp, Homo sapiens
cttaacgtctgtttt

SEQ ID NO: 15230 - DNA, 15 bp, Homo sapiens
gcttaacgtctgttt

SEQ ID NO: 15231 - DNA, 15 bp, Homo sapiens
ggcttaacgtctgtt

SEQ ID NO: 15232 - DNA, 15 bp, Homo sapiens
cggcttaacgtctgt

SEQ ID NO: 15233 - DNA, 15 bp, Homo sapiens
ccggcttaacgtctg

SEQ ID NO: 15234 - DNA, 15 bp, Homo sapiens
cccggcttaacgtct

SEQ ID NO: 15235 - DNA, 15 bp, Homo sapiens
acccggcttaacgtc

SEQ ID NO: 15236 - DNA, 15 bp, Homo sapiens
tacccggcttaacgt

SEQ ID NO: 15237 - DNA, 15 bp, Homo sapiens
atacccggcttaacg

SEQ ID NO: 15238 - DNA, 15 bp, Homo sapiens
catacccggcttaac

SEQ ID NO: 15239 - DNA, 15 bp, Homo sapiens
ccatacccggcttaa

SEQ ID NO: 15240 - DNA, 15 bp, Homo sapiens
accatacccggctta

SEQ ID NO: 15241 - DNA, 15 bp, Homo sapiens
caccatacccggctt

SEQ ID NO: 15242 - DNA, 15 bp, Homo sapiens
tcaccatacccggct

SEQ ID NO: 15243 - DNA, 15 bp, Homo sapiens
atcaccatacccggc

SEQ ID NO: 15244 - DNA, 15 bp, Homo sapiens
catcaccatacccgg

SEQ ID NO: 15245 - DNA, 15 bp, Homo sapiens
gcatcaccatacccg

SEQ ID NO: 15246 - DNA, 15 bp, Homo sapiens
tgcatcaccataccc

SEQ ID NO: 15247 - DNA, 15 bp, Homo sapiens
gtgcatcaccatacc

SEQ ID NO: 15248 - DNA, 15 bp, Homo sapiens
tgtgcatcaccatac

SEQ ID NO: 15249 - DNA, 15 bp, Homo sapiens
gtgtgcatcaccata

SEQ ID NO: 15250 - DNA, 15 bp, Homo sapiens
ggtgtgcatcaccat

SEQ ID NO: 15251 - DNA, 15 bp, Homo sapiens
aggtgtgcatcacca

SEQ ID NO: 15252 - DNA, 15 bp, Homo sapiens
caggtgtgcatcacc

SEQ ID NO: 15253 - DNA, 15 bp, Homo sapiens
acaggtgtgcatcac

SEQ ID NO: 15254 - DNA, 15 bp, Homo sapiens
tacaggtgtgcatca

SEQ ID NO: 15255 - DNA, 15 bp, Homo sapiens
ctacaggtgtgcatc

SEQ ID NO: 15256 - DNA, 15 bp, Homo sapiens
actacaggtgtgcat

SEQ ID NO: 15257 - DNA, 15 bp, Homo sapiens
aactacaggtgtgca

SEQ ID NO: 15258 - DNA, 15 bp, Homo sapiens
gaactacaggtgtgc

SEQ ID NO: 15259 - DNA, 15 bp, Homo sapiens
ggaactacaggtgtg

SEQ ID NO: 15260 - DNA, 15 bp, Homo sapiens
tggaactacaggtgt

SEQ ID NO: 15261 - DNA, 15 bp, Homo sapiens
gtggaactacaggtg

SEQ ID NO: 15262 - DNA, 15 bp, Homo sapiens
ggtggaactacaggt

SEQ ID NO: 15263 - DNA, 15 bp, Homo sapiens
aggtggaactacagg

SEQ ID NO: 15264 - DNA, 15 bp, Homo sapiens
taggtggaactacag

SEQ ID NO: 15265 - DNA, 15 bp, Homo sapiens
gtaggtggaactaca

SEQ ID NO: 15266 - DNA, 15 bp, Homo sapiens
agtaggtggaactac

SEQ ID NO: 15267 - DNA, 15 bp, Homo sapiens
aagtaggtggaacta

SEQ ID NO: 15268 - DNA, 15 bp, Homo sapiens
caagtaggtggaact

SEQ ID NO: 15269 - DNA, 15 bp, Homo sapiens
ccaagtaggtggaac

SEQ ID NO: 15270 - DNA, 15 bp, Homo sapiens
cccaagtaggtggaa

SEQ ID NO: 15271 - DNA, 15 bp, Homo sapiens
tcccaagtaggtgga

SEQ ID NO: 15272 - DNA, 15 bp, Homo sapiens
ctcccaagtaggtgg

SEQ ID NO: 15273 - DNA, 15 bp, Homo sapiens
cctcccaagtaggtg

SEQ ID NO: 15274 - DNA, 15 bp, Homo sapiens
gcctcccaagtaggt

SEQ ID NO: 15275 - DNA, 15 bp, Homo sapiens
agcctcccaagtagg

SEQ ID NO: 15276 - DNA, 15 bp, Homo sapiens
cctcagcctcccaag

SEQ ID NO: 15277 - DNA, 15 bp, Homo sapiens
acctcagcctcccaa

SEQ ID NO: 15278 - DNA, 15 bp, Homo sapiens
cacctcagcctccca

SEQ ID NO: 15279 - DNA, 15 bp, Homo sapiens
ccacctcagcctccc

SEQ ID NO: 15280 - DNA, 15 bp, Homo sapiens
cccacctcagcctcc

SEQ ID NO: 15281 - DNA, 15 bp, Homo sapiens
tcccacctcagcctc

SEQ ID NO: 15282 - DNA, 15 bp, Homo sapiens
ttcccacctcagcct

SEQ ID NO: 15283 - DNA, 15 bp, Homo sapiens
tttcccacctcagcc

SEQ ID NO: 15284 - DNA, 15 bp, Homo sapiens
ttttcccacctcagc

SEQ ID NO: 15285 - DNA, 15 bp, Homo sapiens
attttcccacctcag

SEQ ID NO: 15286 - DNA, 15 bp, Homo sapiens
gattttcccacctca

SEQ ID NO: 15287 - DNA, 15 bp, Homo sapiens
tgattttcccacctc

SEQ ID NO: 15288 - DNA, 15 bp, Homo sapiens
gtgattttcccacct

SEQ ID NO: 15289 - DNA, 15 bp, Homo sapiens
agtgattttcccacc

SEQ ID NO: 15290 - DNA, 15 bp, Homo sapiens
aagtgattttcccac

SEQ ID NO: 15291 - DNA, 15 bp, Homo sapiens
caagtgattttccca

SEQ ID NO: 15292 - DNA, 15 bp, Homo sapiens
tcaagtgattttccc

SEQ ID NO: 15293 - DNA, 15 bp, Homo sapiens
ctcaagtgattttcc

SEQ ID NO: 15294 - DNA, 15 bp, Homo sapiens
gctcaagtgattttc

SEQ ID NO: 15295 - DNA, 15 bp, Homo sapiens
ggctcaagtgatttt

SEQ ID NO: 15296 - DNA, 15 bp, Homo sapiens
gggctcaagtgattt

SEQ ID NO: 15297 - DNA, 15 bp, Homo sapiens
tgggctcaagtgatt

SEQ ID NO: 15298 - DNA, 15 bp, Homo sapiens
cctcaaactcctggg

SEQ ID NO: 15299 - DNA, 15 bp, Homo sapiens
gcctcaaactcctgg

SEQ ID NO: 15300 - DNA, 15 bp, Homo sapiens
ctggcctcaaactcc

SEQ ID NO: 15301 - DNA, 15 bp, Homo sapiens
gctggcctcaaactc

SEQ ID NO: 15302 - DNA, 15 bp, Homo sapiens
ggctggcctcaaact

SEQ ID NO: 15303 - DNA, 15 bp, Homo sapiens
aggctggcctcaaac

SEQ ID NO: 15304 - DNA, 15 bp, Homo sapiens
caggctggcctcaaa

SEQ ID NO: 15305 - DNA, 15 bp, Homo sapiens
ccaggctggcctcaa

SEQ ID NO: 15306 - DNA, 15 bp, Homo sapiens
cccaggctggcctca

SEQ ID NO: 15307 - DNA, 15 bp, Homo sapiens
gcccaggctggcctc

SEQ ID NO: 15308 - DNA, 15 bp, Homo sapiens
tgcccaggctggcct

SEQ ID NO: 15309 - DNA, 15 bp, Homo sapiens
ttgcccaggctggcc

SEQ ID NO: 15310 - DNA, 15 bp, Homo sapiens
gttgcccaggctggc

SEQ ID NO: 15311 - DNA, 15 bp, Homo sapiens
gctctgttgcccagg

SEQ ID NO: 15312 - DNA, 15 bp, Homo sapiens
tgctctgttgcccag

SEQ ID NO: 15313 - DNA, 15 bp, Homo sapiens
ttgctctgttgccca

SEQ ID NO: 15314 - DNA, 15 bp, Homo sapiens
cttgctctgttgccc

SEQ ID NO: 15315 - DNA, 15 bp, Homo sapiens
tcttgctctgttgcc

SEQ ID NO: 15316 - DNA, 15 bp, Homo sapiens
gtcttgctctgttgc

SEQ ID NO: 15317 - DNA, 15 bp, Homo sapiens
ggtcttgctctgttg

SEQ ID NO: 15318 - DNA, 15 bp, Homo sapiens
gggtcttgctctgtt

SEQ ID NO: 15319 - DNA, 15 bp, Homo sapiens
ggggtcttgctctgt

SEQ ID NO: 15320 - DNA, 15 bp, Homo sapiens
tggggtcttgctctg

SEQ ID NO: 15321 - DNA, 15 bp, Homo sapiens
atggggtcttgctct

SEQ ID NO: 15322 - DNA, 15 bp, Homo sapiens
gatggggtcttgctc

SEQ ID NO: 15323 - DNA, 15 bp, Homo sapiens
agatggggtcttgct

SEQ ID NO: 15324 - DNA, 15 bp, Homo sapiens
gagatggggtcttgc

SEQ ID NO: 15325 - DNA, 15 bp, Homo sapiens
agagatggggtcttg

SEQ ID NO: 15326 - DNA, 15 bp, Homo sapiens
aagagatggggtctt

SEQ ID NO: 15327 - DNA, 15 bp, Homo sapiens
taagagatggggtct

SEQ ID NO: 15328 - DNA, 15 bp, Homo sapiens
ttaagagatggggtc

SEQ ID NO: 15329 - DNA, 15 bp, Homo sapiens
tttaagagatggggt

SEQ ID NO: 15330 - DNA, 15 bp, Homo sapiens
ttttaagagatgggg

SEQ ID NO: 15331 - DNA, 15 bp, Homo sapiens
tttttaagagatggg

SEQ ID NO: 15332 - DNA, 15 bp, Homo sapiens
gtttttaagagatgg

SEQ ID NO: 15333 - DNA, 15 bp, Homo sapiens
ggtttttaagagatg

SEQ ID NO: 15334 - DNA, 15 bp, Homo sapiens
tggtttttaagagat

SEQ ID NO: 15335 - DNA, 15 bp, Homo sapiens
ctggtttttaagaga

SEQ ID NO: 15336 - DNA, 15 bp, Homo sapiens
actggtttttaagag

SEQ ID NO: 15337 - DNA, 15 bp, Homo sapiens
gactggtttttaaga

SEQ ID NO: 15338 - DNA, 15 bp, Homo sapiens
tgactggtttttaag

SEQ ID NO: 15339 - DNA, 15 bp, Homo sapiens
ctgactggtttttaa

SEQ ID NO: 15340 - DNA, 15 bp, Homo sapiens
gctgactggttttta

SEQ ID NO: 15341 - DNA, 15 bp, Homo sapiens
tgctgactggttttt

SEQ ID NO: 15342 - DNA, 15 bp, Homo sapiens
gtgctgactggtttt

SEQ ID NO: 15343 - DNA, 15 bp, Homo sapiens
agtgctgactggttt

SEQ ID NO: 15344 - DNA, 15 bp, Homo sapiens
aagtgctgactggtt

SEQ ID NO: 15345 - DNA, 15 bp, Homo sapiens
caagtgctgactggt

SEQ ID NO: 15346 - DNA, 15 bp, Homo sapiens
tcaagtgctgactgg

SEQ ID NO: 15347 - DNA, 15 bp, Homo sapiens
gtcaagtgctgactg

SEQ ID NO: 15348 - DNA, 15 bp, Homo sapiens
agtcaagtgctgact

SEQ ID NO: 15349 - DNA, 15 bp, Homo sapiens
tagtcaagtgctgac

SEQ ID NO: 15350 - DNA, 15 bp, Homo sapiens
ctagtcaagtgctga

SEQ ID NO: 15351 - DNA, 15 bp, Homo sapiens
actagtcaagtgctg

SEQ ID NO: 15352 - DNA, 15 bp, Homo sapiens
gactagtcaagtgct

SEQ ID NO: 15353 - DNA, 15 bp, Homo sapiens
tgactagtcaagtgc

SEQ ID NO: 15354 - DNA, 15 bp, Homo sapiens
ctgactagtcaagtg

SEQ ID NO: 15355 - DNA, 15 bp, Homo sapiens
actgactagtcaagt

SEQ ID NO: 15356 - DNA, 15 bp, Homo sapiens
aactgactagtcaag

SEQ ID NO: 15357 - DNA, 15 bp, Homo sapiens
taactgactagtcaa

SEQ ID NO: 15358 - DNA, 15 bp, Homo sapiens
ctaactgactagtca

SEQ ID NO: 15359 - DNA, 15 bp, Homo sapiens
actaactgactagtc

SEQ ID NO: 15360 - DNA, 15 bp, Homo sapiens
cactaactgactagt

SEQ ID NO: 15361 - DNA, 15 bp, Homo sapiens
ccactaactgactag

SEQ ID NO: 15362 - DNA, 15 bp, Homo sapiens
cccactaactgacta

SEQ ID NO: 15363 - DNA, 15 bp, Homo sapiens
ccccactaactgact

SEQ ID NO: 15364 - DNA, 15 bp, Homo sapiens
cccccactaactgac

SEQ ID NO: 15365 - DNA, 15 bp, Homo sapiens
tcccccactaactga

SEQ ID NO: 15366 - DNA, 15 bp, Homo sapiens
ttcccccactaactg

SEQ ID NO: 15367 - DNA, 15 bp, Homo sapiens
tttcccccactaact

SEQ ID NO: 15368 - DNA, 15 bp, Homo sapiens
ttttcccccactaac

SEQ ID NO: 15369 - DNA, 15 bp, Homo sapiens
gttttcccccactaa

SEQ ID NO: 15370 - DNA, 15 bp, Homo sapiens
tgttttcccccacta

SEQ ID NO: 15371 - DNA, 15 bp, Homo sapiens
gtgttttcccccact

SEQ ID NO: 15372 - DNA, 15 bp, Homo sapiens
tgtgttttcccccac

SEQ ID NO: 15373 - DNA, 15 bp, Homo sapiens
ctgtgttttccccca

SEQ ID NO: 15374 - DNA, 15 bp, Homo sapiens
cctgtgttttccccc

SEQ ID NO: 15375 - DNA, 15 bp, Homo sapiens
acctgtgttttcccc

SEQ ID NO: 15376 - DNA, 15 bp, Homo sapiens
tacctgtgttttccc

SEQ ID NO: 15377 - DNA, 15 bp, Homo sapiens
gtacctgtgttttcc

SEQ ID NO: 15378 - DNA, 15 bp, Homo sapiens
tgtacctgtgttttc

SEQ ID NO: 15379 - DNA, 15 bp, Homo sapiens
ctgtacctgtgtttt

SEQ ID NO: 15380 - DNA, 15 bp, Homo sapiens
actgtacctgtgttt

SEQ ID NO: 15381 - DNA, 15 bp, Homo sapiens
tactgtacctgtgtt

SEQ ID NO: 15382 - DNA, 15 bp, Homo sapiens
ttactgtacctgtgt

SEQ ID NO: 15383 - DNA, 15 bp, Homo sapiens
tttactgtacctgtg

SEQ ID NO: 15384 - DNA, 15 bp, Homo sapiens
ttttactgtacctgt

SEQ ID NO: 15385 - DNA, 15 bp, Homo sapiens
cttttactgtacctg

SEQ ID NO: 15386 - DNA, 15 bp, Homo sapiens
ccttttactgtacct

SEQ ID NO: 15387 - DNA, 15 bp, Homo sapiens
tccttttactgtacc

SEQ ID NO: 15388 - DNA, 15 bp, Homo sapiens
ctccttttactgtac

SEQ ID NO: 15389 - DNA, 15 bp, Homo sapiens
actccttttactgta

SEQ ID NO: 15390 - DNA, 15 bp, Homo sapiens
gactccttttactgt

SEQ ID NO: 15391 - DNA, 15 bp, Homo sapiens
tgactccttttactg

SEQ ID NO: 15392 - DNA, 15 bp, Homo sapiens
ttgactccttttact

SEQ ID NO: 15393 - DNA, 15 bp, Homo sapiens
tttgactccttttac

SEQ ID NO: 15394 - DNA, 15 bp, Homo sapiens
ttttgactcctttta

SEQ ID NO: 15395 - DNA, 15 bp, Homo sapiens
attttgactcctttt

SEQ ID NO: 15396 - DNA, 15 bp, Homo sapiens
aattttgactccttt

SEQ ID NO: 15397 - DNA, 15 bp, Homo sapiens
taattttgactcctt

SEQ ID NO: 15398 - DNA, 15 bp, Homo sapiens
gtaattttgactcct

SEQ ID NO: 15399 - DNA, 15 bp, Homo sapiens
tgtaattttgactcc

SEQ ID NO: 15400 - DNA, 15 bp, Homo sapiens
gtgtaattttgactc

SEQ ID NO: 15401 - DNA, 15 bp, Homo sapiens
agtgtaattttgact

SEQ ID NO: 15402 - DNA, 15 bp, Homo sapiens
aagtgtaattttgac

SEQ ID NO: 15403 - DNA, 15 bp, Homo sapiens
taagtgtaattttga

SEQ ID NO: 15404 - DNA, 15 bp, Homo sapiens
ttaagtgtaattttg

SEQ ID NO: 15405 - DNA, 15 bp, Homo sapiens
tttaagtgtaatttt

SEQ ID NO: 15406 - DNA, 15 bp, Homo sapiens
gtttaagtgtaattt

SEQ ID NO: 15407 - DNA, 15 bp, Homo sapiens
agtttaagtgtaatt

SEQ ID NO: 15408 - DNA, 15 bp, Homo sapiens
aagtttaagtgtaat

SEQ ID NO: 15409 - DNA, 15 bp, Homo sapiens
taagtttaagtgtaa

SEQ ID NO: 15410 - DNA, 15 bp, Homo sapiens
ctaagtttaagtgta

SEQ ID NO: 15411 - DNA, 15 bp, Homo sapiens
cctaagtttaagtgt

SEQ ID NO: 15412 - DNA, 15 bp, Homo sapiens
acctaagtttaagtg

SEQ ID NO: 15413 - DNA, 15 bp, Homo sapiens
gacctaagtttaagt

SEQ ID NO: 15414 - DNA, 15 bp, Homo sapiens
tgacctaagtttaag

SEQ ID NO: 15415 - DNA, 15 bp, Homo sapiens
atgacctaagtttaa

SEQ ID NO: 15416 - DNA, 15 bp, Homo sapiens
gatgacctaagttta

SEQ ID NO: 15417 - DNA, 15 bp, Homo sapiens
agatgacctaagttt

SEQ ID NO: 15418 - DNA, 15 bp, Homo sapiens
aagatgacctaagtt

SEQ ID NO: 15419 - DNA, 15 bp, Homo sapiens
taagatgacctaagt

SEQ ID NO: 15420 - DNA, 15 bp, Homo sapiens
ataagatgacctaag

SEQ ID NO: 15421 - DNA, 15 bp, Homo sapiens
aataagatgacctaa

SEQ ID NO: 15422 - DNA, 15 bp, Homo sapiens
taataagatgaccta

SEQ ID NO: 15423 - DNA, 15 bp, Homo sapiens
ataataagatgacct

SEQ ID NO: 15424 - DNA, 15 bp, Homo sapiens
tataataagatgacc

SEQ ID NO: 15425 - DNA, 15 bp, Homo sapiens
atataataagatgac

SEQ ID NO: 15426 - DNA, 15 bp, Homo sapiens
gatataataagatga

SEQ ID NO: 15427 - DNA, 15 bp, Homo sapiens
tgatataataagatg

SEQ ID NO: 15428 - DNA, 15 bp, Homo sapiens
ttgatataataagat

SEQ ID NO: 15429 - DNA, 15 bp, Homo sapiens
tttgatataataaga

SEQ ID NO: 15430 - DNA, 15 bp, Homo sapiens
gtttgatataataag

SEQ ID NO: 15431 - DNA, 15 bp, Homo sapiens
tgtttgatataataa

SEQ ID NO: 15432 - DNA, 15 bp, Homo sapiens
atgtttgatataata

SEQ ID NO: 15433 - DNA, 15 bp, Homo sapiens
aatgtttgatataat

SEQ ID NO: 15434 - DNA, 15 bp, Homo sapiens
aaatgtttgatataa

SEQ ID NO: 15435 - DNA, 15 bp, Homo sapiens
taaatgtttgatata

SEQ ID NO: 15436 - DNA, 15 bp, Homo sapiens
ataaatgtttgatat

SEQ ID NO: 15437 - DNA, 15 bp, Homo sapiens
aataaatgtttgata

SEQ ID NO: 15438 - DNA, 15 bp, Homo sapiens
taataaatgtttgat

SEQ ID NO: 15439 - DNA, 15 bp, Homo sapiens
ttaataaatgtttga

SEQ ID NO: 15440 - DNA, 15 bp, Homo sapiens
gttaataaatgtttg

SEQ ID NO: 15441 - DNA, 15 bp, Homo sapiens
tgttaataaatgttt

SEQ ID NO: 15442 - DNA, 15 bp, Homo sapiens
atgttaataaatgtt

SEQ ID NO: 15443 - DNA, 15 bp, Homo sapiens
catgttaataaatgt

SEQ ID NO: 15444 - DNA, 15 bp, Homo sapiens
acatgttaataaatg

SEQ ID NO: 15445 - DNA, 15 bp, Homo sapiens
aacatgttaataaat

SEQ ID NO: 15446 - DNA, 15 bp, Homo sapiens
aaacatgttaataaa

SEQ ID NO: 15447 - DNA, 15 bp, Homo sapiens
taaacatgttaataa

SEQ ID NO: 15448 - DNA, 15 bp, Homo sapiens
ctaaacatgttaata

SEQ ID NO: 15449 - DNA, 15 bp, Homo sapiens
actaaacatgttaat

SEQ ID NO: 15450 - DNA, 15 bp, Homo sapiens
cactaaacatgttaa

SEQ ID NO: 15451 - DNA, 15 bp, Homo sapiens
acactaaacatgtta

SEQ ID NO: 15452 - DNA, 15 bp, Homo sapiens
aacactaaacatgtt

SEQ ID NO: 15453 - DNA, 15 bp, Homo sapiens
aaacactaaacatgt

SEQ ID NO: 15454 - DNA, 15 bp, Homo sapiens
aaaacactaaacatg

SEQ ID NO: 15455 - DNA, 15 bp, Homo sapiens
caaaacactaaacat

SEQ ID NO: 15456 - DNA, 15 bp, Homo sapiens
acaaaacactaaaca

SEQ ID NO: 15457 - DNA, 15 bp, Homo sapiens
cacaaaacactaaac

SEQ ID NO: 15458 - DNA, 15 bp, Homo sapiens
acacaaaacactaaa

SEQ ID NO: 15459 - DNA, 15 bp, Homo sapiens
tacacaaaacactaa

SEQ ID NO: 15460 - DNA, 15 bp, Homo sapiens
atacacaaaacacta

SEQ ID NO: 15461 - DNA, 15 bp, Homo sapiens
tatacacaaaacact

SEQ ID NO: 15462 - DNA, 15 bp, Homo sapiens
atatacacaaaacac

SEQ ID NO: 15463 - DNA, 15 bp, Homo sapiens
aatatacacaaaaca

SEQ ID NO: 15464 - DNA, 15 bp, Homo sapiens
taatatacacaaaac

SEQ ID NO: 15465 - DNA, 15 bp, Homo sapiens
ataatatacacaaaa

SEQ ID NO: 15466 - DNA, 15 bp, Homo sapiens
cataatatacacaaa

SEQ ID NO: 15467 - DNA, 15 bp, Homo sapiens
gcataatatacacaa

SEQ ID NO: 15468 - DNA, 15 bp, Homo sapiens
tgcataatatacaca

SEQ ID NO: 15469 - DNA, 15 bp, Homo sapiens
ttgcataatatacac

SEQ ID NO: 15470 - DNA, 15 bp, Homo sapiens
tttgcataatataca

SEQ ID NO: 15471 - DNA, 15 bp, Homo sapiens
ctttgcataatatac

SEQ ID NO: 15472 - DNA, 15 bp, Homo sapiens
actttgcataatata

SEQ ID NO: 15473 - DNA, 15 bp, Homo sapiens
cactttgcataatat

SEQ ID NO: 15474 - DNA, 15 bp, Homo sapiens
acactttgcataata

SEQ ID NO: 15475 - DNA, 15 bp, Homo sapiens
tacactttgcataat

SEQ ID NO: 15476 - DNA, 15 bp, Homo sapiens
ttacactttgcataa

SEQ ID NO: 15477 - DNA, 15 bp, Homo sapiens
attacactttgcata

SEQ ID NO: 15478 - DNA, 15 bp, Homo sapiens
cattacactttgcat

SEQ ID NO: 15479 - DNA, 15 bp, Homo sapiens
gcattacactttgca

SEQ ID NO: 15480 - DNA, 15 bp, Homo sapiens
tgcattacactttgc

SEQ ID NO: 15481 - DNA, 15 bp, Homo sapiens
ttgcattacactttg

SEQ ID NO: 15482 - DNA, 15 bp, Homo sapiens
gttgcattacacttt

SEQ ID NO: 15483 - DNA, 15 bp, Homo sapiens
agttgcattacactt

SEQ ID NO: 15484 - DNA, 15 bp, Homo sapiens
tagttgcattacact

SEQ ID NO: 15485 - DNA, 15 bp, Homo sapiens
ttagttgcattacac

SEQ ID NO: 15486 - DNA, 15 bp, Homo sapiens
tttagttgcattaca

SEQ ID NO: 15487 - DNA, 15 bp, Homo sapiens
ttttagttgcattac

SEQ ID NO: 15488 - DNA, 15 bp, Homo sapiens
gttttagttgcatta

SEQ ID NO: 15489 - DNA, 15 bp, Homo sapiens
agttttagttgcatt

SEQ ID NO: 15490 - DNA, 15 bp, Homo sapiens
cagttttagttgcat

SEQ ID NO: 15491 - DNA, 15 bp, Homo sapiens
acagttttagttgca

SEQ ID NO: 15492 - DNA, 15 bp, Homo sapiens
aacagttttagttgc

SEQ ID NO: 15493 - DNA, 15 bp, Homo sapiens
aaacagttttagttg

SEQ ID NO: 15494 - DNA, 15 bp, Homo sapiens
taaacagttttagtt

SEQ ID NO: 15495 - DNA, 15 bp, Homo sapiens
ttaaacagttttagt

SEQ ID NO: 15496 - DNA, 15 bp, Homo sapiens
gttaaacagttttag

SEQ ID NO: 15497 - DNA, 15 bp, Homo sapiens
tgttaaacagtttta

SEQ ID NO: 15498 - DNA, 15 bp, Homo sapiens
gtgttaaacagtttt

SEQ ID NO: 15499 - DNA, 15 bp, Homo sapiens
agtgttaaacagttt

SEQ ID NO: 15500 - DNA, 15 bp, Homo sapiens
aagtgttaaacagtt

SEQ ID NO: 15501 - DNA, 15 bp, Homo sapiens
gaagtgttaaacagt

SEQ ID NO: 15502 - DNA, 15 bp, Homo sapiens
agaagtgttaaacag

SEQ ID NO: 15503 - DNA, 15 bp, Homo sapiens
gagaagtgttaaaca

SEQ ID NO: 15504 - DNA, 15 bp, Homo sapiens
cgagaagtgttaaac

SEQ ID NO: 15505 - DNA, 15 bp, Homo sapiens
tcgagaagtgttaaa

SEQ ID NO: 15506 - DNA, 15 bp, Homo sapiens
atcgagaagtgttaa

SEQ ID NO: 15507 - DNA, 15 bp, Homo sapiens
tatcgagaagtgtta

SEQ ID NO: 15508 - DNA, 15 bp, Homo sapiens
atatcgagaagtgtt

SEQ ID NO: 15509 - DNA, 15 bp, Homo sapiens
gatatcgagaagtgt

SEQ ID NO: 15510 - DNA, 15 bp, Homo sapiens
tgatatcgagaagtg

SEQ ID NO: 15511 - DNA, 15 bp, Homo sapiens
gtgatatcgagaagt

SEQ ID NO: 15512 - DNA, 15 bp, Homo sapiens
tgtgatatcgagaag

SEQ ID NO: 15513 - DNA, 15 bp, Homo sapiens
atgtgatatcgagaa

SEQ ID NO: 15514 - DNA, 15 bp, Homo sapiens
tatgtgatatcgaga

SEQ ID NO: 15515 - DNA, 15 bp, Homo sapiens
ttatgtgatatcgag

SEQ ID NO: 15516 - DNA, 15 bp, Homo sapiens
tttatgtgatatcga

SEQ ID NO: 15517 - DNA, 15 bp, Homo sapiens
atttatgtgatatcg

SEQ ID NO: 15518 - DNA, 15 bp, Homo sapiens
aatttatgtgatatc

SEQ ID NO: 15519 - DNA, 15 bp, Homo sapiens
aaatttatgtgatat

SEQ ID NO: 15520 - DNA, 15 bp, Homo sapiens
caaatttatgtgata

SEQ ID NO: 15521 - DNA, 15 bp, Homo sapiens
acaaatttatgtgat

SEQ ID NO: 15522 - DNA, 15 bp, Homo sapiens
aacaaatttatgtga

SEQ ID NO: 15523 - DNA, 15 bp, Homo sapiens
caacaaatttatgtg

SEQ ID NO: 15524 - DNA, 15 bp, Homo sapiens
ccaacaaatttatgt

SEQ ID NO: 15525 - DNA, 15 bp, Homo sapiens
accaacaaatttatg

SEQ ID NO: 15526 - DNA, 15 bp, Homo sapiens
caccaacaaatttat

SEQ ID NO: 15527 - DNA, 15 bp, Homo sapiens
gcaccaacaaattta

SEQ ID NO: 15528 - DNA, 15 bp, Homo sapiens
tgcaccaacaaattt

SEQ ID NO: 15529 - DNA, 15 bp, Homo sapiens
atgcaccaacaaatt

SEQ ID NO: 15530 - DNA, 15 bp, Homo sapiens
tatgcaccaacaaat

SEQ ID NO: 15531 - DNA, 15 bp, Homo sapiens
ttatgcaccaacaaa

SEQ ID NO: 15532 - DNA, 15 bp, Homo sapiens
attatgcaccaacaa

SEQ ID NO: 15533 - DNA, 15 bp, Homo sapiens
tattatgcaccaaca

SEQ ID NO: 15534 - DNA, 15 bp, Homo sapiens
ctattatgcaccaac

SEQ ID NO: 15535 - DNA, 15 bp, Homo sapiens
gctattatgcaccaa

SEQ ID NO: 15536 - DNA, 15 bp, Homo sapiens
ggctattatgcacca

SEQ ID NO: 15537 - DNA, 15 bp, Homo sapiens
aggctattatgcacc

SEQ ID NO: 15538 - DNA, 15 bp, Homo sapiens
taggctattatgcac

SEQ ID NO: 15539 - DNA, 15 bp, Homo sapiens
ttaggctattatgca

SEQ ID NO: 15540 - DNA, 15 bp, Homo sapiens
tttaggctattatgc

SEQ ID NO: 15541 - DNA, 15 bp, Homo sapiens
ttttaggctattatg

SEQ ID NO: 15542 - DNA, 15 bp, Homo sapiens
cttttaggctattat

SEQ ID NO: 15543 - DNA, 15 bp, Homo sapiens
acttttaggctatta

SEQ ID NO: 15544 - DNA, 15 bp, Homo sapiens
aacttttaggctatt

SEQ ID NO: 15545 - DNA, 15 bp, Homo sapiens
taacttttaggctat

SEQ ID NO: 15546 - DNA, 15 bp, Homo sapiens
gtaacttttaggcta

SEQ ID NO: 15547 - DNA, 15 bp, Homo sapiens
agtaacttttaggct

SEQ ID NO: 15548 - DNA, 15 bp, Homo sapiens
aagtaacttttaggc

SEQ ID NO: 15549 - DNA, 15 bp, Homo sapiens
aaagtaacttttagg

SEQ ID NO: 15550 - DNA, 15 bp, Homo sapiens
aaaagtaacttttag

SEQ ID NO: 15551 - DNA, 15 bp, Homo sapiens
caaaagtaactttta

SEQ ID NO: 15552 - DNA, 15 bp, Homo sapiens
gcaaaagtaactttt

SEQ ID NO: 15553 - DNA, 15 bp, Homo sapiens
agcaaaagtaacttt

SEQ ID NO: 15554 - DNA, 15 bp, Homo sapiens
cagcaaaagtaactt

SEQ ID NO: 15555 - DNA, 15 bp, Homo sapiens
acagcaaaagtaact

SEQ ID NO: 15556 - DNA, 15 bp, Homo sapiens
aacagcaaaagtaac

SEQ ID NO: 15557 - DNA, 15 bp, Homo sapiens
caacagcaaaagtaa

SEQ ID NO: 15558 - DNA, 15 bp, Homo sapiens
ccaacagcaaaagta

SEQ ID NO: 15559 - DNA, 15 bp, Homo sapiens
gccaacagcaaaagt

SEQ ID NO: 15560 - DNA, 15 bp, Homo sapiens
tgccaacagcaaaag

SEQ ID NO: 15561 - DNA, 15 bp, Homo sapiens
atgccaacagcaaaa

SEQ ID NO: 15562 - DNA, 15 bp, Homo sapiens
aatgccaacagcaaa

SEQ ID NO: 15563 - DNA, 15 bp, Homo sapiens
aaatgccaacagcaa

SEQ ID NO: 15564 - DNA, 15 bp, Homo sapiens
aaaatgccaacagca

SEQ ID NO: 15565 - DNA, 15 bp, Homo sapiens
taaaatgccaacagc

SEQ ID NO: 15566 - DNA, 15 bp, Homo sapiens
ataaaatgccaacag

SEQ ID NO: 15567 - DNA, 15 bp, Homo sapiens
aataaaatgccaaca

SEQ ID NO: 15568 - DNA, 15 bp, Homo sapiens
aaataaaatgccaac

SEQ ID NO: 15569 - DNA, 15 bp, Homo sapiens
aaaataaaatgccaa

SEQ ID NO: 15570 - DNA, 15 bp, Homo sapiens
taaaataaaatgcca

SEQ ID NO: 15571 - DNA, 15 bp, Homo sapiens
ataaaataaaatgcc

SEQ ID NO: 15572 - DNA, 15 bp, Homo sapiens
aataaaataaaatgc

SEQ ID NO: 15573 - DNA, 15 bp, Homo sapiens
taataaaataaaatg

SEQ ID NO: 15574 - DNA, 15 bp, Homo sapiens
gtaataaaataaaat

SEQ ID NO: 15575 - DNA, 15 bp, Homo sapiens
agtaataaaataaaa

SEQ ID NO: 15576 - DNA, 15 bp, Homo sapiens
aagtaataaaataaa

SEQ ID NO: 15577 - DNA, 15 bp, Homo sapiens
taagtaataaaataa

SEQ ID NO: 15578 - DNA, 15 bp, Homo sapiens
gtaagtaataaaata

SEQ ID NO: 15579 - DNA, 15 bp, Homo sapiens
agtaagtaataaaat

SEQ ID NO: 15580 - DNA, 15 bp, Homo sapiens
aagtaagtaataaaa

SEQ ID NO: 15581 - DNA, 15 bp, Homo sapiens
taagtaagtaataaa

SEQ ID NO: 15582 - DNA, 15 bp, Homo sapiens
ataagtaagtaataa

SEQ ID NO: 15583 - DNA, 15 bp, Homo sapiens
aataagtaagtaata

SEQ ID NO: 15584 - DNA, 15 bp, Homo sapiens
aaataagtaagtaat

SEQ ID NO: 15585 - DNA, 15 bp, Homo sapiens
taaataagtaagtaa

SEQ ID NO: 15586 - DNA, 15 bp, Homo sapiens
ataaataagtaagta

SEQ ID NO: 15587 - DNA, 15 bp, Homo sapiens
aataaataagtaagt

SEQ ID NO: 15588 - DNA, 15 bp, Homo sapiens
aaataaataagtaag

SEQ ID NO: 15589 - DNA, 15 bp, Homo sapiens
taaataaataagtaa

SEQ ID NO: 15590 - DNA, 15 bp, Homo sapiens
ataaataaataagta

SEQ ID NO: 15591 - DNA, 15 bp, Homo sapiens
aataaataaataagt

SEQ ID NO: 15592 - DNA, 15 bp, Homo sapiens
aaataaataaataag

SEQ ID NO: 15593 - DNA, 15 bp, Homo sapiens
taaataaataaataa

SEQ ID NO: 15594 - DNA, 15 bp, Homo sapiens
ataaataaataaata

SEQ ID NO: 15595 - DNA, 15 bp, Homo sapiens
aataaataaataaat

SEQ ID NO: 15596 - DNA, 15 bp, Homo sapiens
aaataaataaataaa

SEQ ID NO: 15597 - DNA, 15 bp, Homo sapiens
aaaataaataaataa

SEQ ID NO: 15598 - DNA, 15 bp, Homo sapiens
caaaataaataaata

SEQ ID NO: 15599 - DNA, 15 bp, Homo sapiens
tcaaaataaataaat

SEQ ID NO: 15600 - DNA, 15 bp, Homo sapiens
ctcaaaataaataaa

SEQ ID NO: 15601 - DNA, 15 bp, Homo sapiens
tctcaaaataaataa

SEQ ID NO: 15602 - DNA, 15 bp, Homo sapiens
gtctcaaaataaata

SEQ ID NO: 15603 - DNA, 15 bp, Homo sapiens
tgtctcaaaataaat

SEQ ID NO: 15604 - DNA, 15 bp, Homo sapiens
ctgtctcaaaataaa

SEQ ID NO: 15605 - DNA, 15 bp, Homo sapiens
tctgtctcaaaataa

SEQ ID NO: 15606 - DNA, 15 bp, Homo sapiens
ctctgtctcaaaata

SEQ ID NO: 15607 - DNA, 15 bp, Homo sapiens
actctgtctcaaaat

SEQ ID NO: 15608 - DNA, 15 bp, Homo sapiens
tgactctgtctcaaa

SEQ ID NO: 15609 - DNA, 15 bp, Homo sapiens
gtgactctgtctcaa

SEQ ID NO: 15610 - DNA, 15 bp, Homo sapiens
tgtgactctgtctca

SEQ ID NO: 15611 - DNA, 15 bp, Homo sapiens
gtgtgactctgtctc

SEQ ID NO: 15612 - DNA, 15 bp, Homo sapiens
agtgtgactctgtct

SEQ ID NO: 15613 - DNA, 15 bp, Homo sapiens
cagtgtgactctgtc

SEQ ID NO: 15614 - DNA, 15 bp, Homo sapiens
acagtgtgactctgt

SEQ ID NO: 15615 - DNA, 15 bp, Homo sapiens
gacagtgtgactctg

SEQ ID NO: 15616 - DNA, 15 bp, Homo sapiens
cgacagtgtgactct

SEQ ID NO: 15617 - DNA, 15 bp, Homo sapiens
gcgacagtgtgactc

SEQ ID NO: 15618 - DNA, 15 bp, Homo sapiens
ggcgacagtgtgact

SEQ ID NO: 15619 - DNA, 15 bp, Homo sapiens
tggcgacagtgtgac

SEQ ID NO: 15620 - DNA, 15 bp, Homo sapiens
ctggcgacagtgtga

SEQ ID NO: 15621 - DNA, 15 bp, Homo sapiens
cctggcgacagtgtg

SEQ ID NO: 15622 - DNA, 15 bp, Homo sapiens
gcctggcgacagtgt

SEQ ID NO: 15623 - DNA, 15 bp, Homo sapiens
agcctggcgacagtg

SEQ ID NO: 15624 - DNA, 15 bp, Homo sapiens
cagcctggcgacagt

SEQ ID NO: 15625 - DNA, 15 bp, Homo sapiens
ccagcctggcgacag

SEQ ID NO: 15626 - DNA, 15 bp, Homo sapiens
tccagcctggcgaca

SEQ ID NO: 15627 - DNA, 15 bp, Homo sapiens
ctccagcctggcgac

SEQ ID NO: 15628 - DNA, 15 bp, Homo sapiens
actccagcctggcga

SEQ ID NO: 15629 - DNA, 15 bp, Homo sapiens
cactccagcctggcg

SEQ ID NO: 15630 - DNA, 15 bp, Homo sapiens
gcactccagcctggc

SEQ ID NO: 15631 - DNA, 15 bp, Homo sapiens
cgcaccactgcactc

SEQ ID NO: 15632 - DNA, 15 bp, Homo sapiens
tcgcaccactgcact

SEQ ID NO: 15633 - DNA, 15 bp, Homo sapiens
atcgcaccactgcac

SEQ ID NO: 15634 - DNA, 15 bp, Homo sapiens
gatcgcaccactgca

SEQ ID NO: 15635 - DNA, 15 bp, Homo sapiens
agatcgcaccactgc

SEQ ID NO: 15636 - DNA, 15 bp, Homo sapiens
gagatcgcaccactg

SEQ ID NO: 15637 - DNA, 15 bp, Homo sapiens
tgagatcgcaccact

SEQ ID NO: 15638 - DNA, 15 bp, Homo sapiens
ctgagatcgcaccac

SEQ ID NO: 15639 - DNA, 15 bp, Homo sapiens
gctgagatcgcacca

SEQ ID NO: 15640 - DNA, 15 bp, Homo sapiens
agctgagatcgcacc

SEQ ID NO: 15641 - DNA, 15 bp, Homo sapiens
gagctgagatcgcac

SEQ ID NO: 15642 - DNA, 15 bp, Homo sapiens
tgagctgagatcgca

SEQ ID NO: 15643 - DNA, 15 bp, Homo sapiens
gtgagctgagatcgc

SEQ ID NO: 15644 - DNA, 15 bp, Homo sapiens
agggaggcagaggtt

SEQ ID NO: 15645 - DNA, 15 bp, Homo sapiens
cagggaggcagaggt

SEQ ID NO: 15646 - DNA, 15 bp, Homo sapiens
ccagggaggcagagg

SEQ ID NO: 15647 - DNA, 15 bp, Homo sapiens
accagggaggcagag

SEQ ID NO: 15648 - DNA, 15 bp, Homo sapiens
aaccagggaggcaga

SEQ ID NO: 15649 - DNA, 15 bp, Homo sapiens
gaaccagggaggcag

SEQ ID NO: 15650 - DNA, 15 bp, Homo sapiens
tgaaccagggaggca

SEQ ID NO: 15651 - DNA, 15 bp, Homo sapiens
ttgaaccagggaggc

SEQ ID NO: 15652 - DNA, 15 bp, Homo sapiens
cttgaaccagggagg

SEQ ID NO: 15653 - DNA, 15 bp, Homo sapiens
gcttgaaccagggag

SEQ ID NO: 15654 - DNA, 15 bp, Homo sapiens
cgcttgaaccaggga

SEQ ID NO: 15655 - DNA, 15 bp, Homo sapiens
tcgcttgaaccaggg

SEQ ID NO: 15656 - DNA, 15 bp, Homo sapiens
atcgcttgaaccagg

SEQ ID NO: 15657 - DNA, 15 bp, Homo sapiens
aatcgcttgaaccag

SEQ ID NO: 15658 - DNA, 15 bp, Homo sapiens
gaatcgcttgaacca

SEQ ID NO: 15659 - DNA, 15 bp, Homo sapiens
gggagaatcgcttga

SEQ ID NO: 15660 - DNA, 15 bp, Homo sapiens
cgggagaatcgcttg

SEQ ID NO: 15661 - DNA, 15 bp, Homo sapiens
gcgggagaatcgctt

SEQ ID NO: 15662 - DNA, 15 bp, Homo sapiens
ggcgggagaatcgct

SEQ ID NO: 15663 - DNA, 15 bp, Homo sapiens
aggcgggagaatcgc

SEQ ID NO: 15664 - DNA, 15 bp, Homo sapiens
gaggcgggagaatcg

SEQ ID NO: 15665 - DNA, 15 bp, Homo sapiens
tgaggcgggagaatc

SEQ ID NO: 15666 - DNA, 15 bp, Homo sapiens
ctgaggcgggagaat

SEQ ID NO: 15667 - DNA, 15 bp, Homo sapiens
gctgaggcgggagaa

SEQ ID NO: 15668 - DNA, 15 bp, Homo sapiens
ggctgaggcgggaga

SEQ ID NO: 15669 - DNA, 15 bp, Homo sapiens
ggaggctgaggcggg

SEQ ID NO: 15670 - DNA, 15 bp, Homo sapiens
aggaggctgaggcgg

SEQ ID NO: 15671 - DNA, 15 bp, Homo sapiens
caggaggctgaggcg

SEQ ID NO: 15672 - DNA, 15 bp, Homo sapiens
gtcaggaggctgagg

SEQ ID NO: 15673 - DNA, 15 bp, Homo sapiens
agtcaggaggctgag

SEQ ID NO: 15674 - DNA, 15 bp, Homo sapiens
tagtcaggaggctga

SEQ ID NO: 15675 - DNA, 15 bp, Homo sapiens
ctagtcaggaggctg

SEQ ID NO: 15676 - DNA, 15 bp, Homo sapiens
gctagtcaggaggct

SEQ ID NO: 15677 - DNA, 15 bp, Homo sapiens
agctagtcaggaggc

SEQ ID NO: 15678 - DNA, 15 bp, Homo sapiens
cagctagtcaggagg

SEQ ID NO: 15679 - DNA, 15 bp, Homo sapiens
ccagctagtcaggag

SEQ ID NO: 15680 - DNA, 15 bp, Homo sapiens
cccagctagtcagga

SEQ ID NO: 15681 - DNA, 15 bp, Homo sapiens
tcccagctagtcagg

SEQ ID NO: 15682 - DNA, 15 bp, Homo sapiens
gtcccagctagtcag

SEQ ID NO: 15683 - DNA, 15 bp, Homo sapiens
agtcccagctagtca

SEQ ID NO: 15684 - DNA, 15 bp, Homo sapiens
tagtcccagctagtc

SEQ ID NO: 15685 - DNA, 15 bp, Homo sapiens
gtagtcccagctagt

SEQ ID NO: 15686 - DNA, 15 bp, Homo sapiens
tgtagtcccagctag

SEQ ID NO: 15687 - DNA, 15 bp, Homo sapiens
cgcgcacctgtagtc

SEQ ID NO: 15688 - DNA, 15 bp, Homo sapiens
gcgcgcacctgtagt

SEQ ID NO: 15689 - DNA, 15 bp, Homo sapiens
ggcgcgcacctgtag

SEQ ID NO: 15690 - DNA, 15 bp, Homo sapiens
tggcgcgcacctgta

SEQ ID NO: 15691 - DNA, 15 bp, Homo sapiens
gtggcgcgcacctgt

SEQ ID NO: 15692 - DNA, 15 bp, Homo sapiens
ggtggcgcgcacctg

SEQ ID NO: 15693 - DNA, 15 bp, Homo sapiens
tggtggcgcgcacct

SEQ ID NO: 15694 - DNA, 15 bp, Homo sapiens
atggtggcgcgcacc

SEQ ID NO: 15695 - DNA, 15 bp, Homo sapiens
catggtggcgcgcac

SEQ ID NO: 15696 - DNA, 15 bp, Homo sapiens
gcatggtggcgcgca

SEQ ID NO: 15697 - DNA, 15 bp, Homo sapiens
ggcatggtggcgcgc

SEQ ID NO: 15698 - DNA, 15 bp, Homo sapiens
gggcatggtggcgcg

SEQ ID NO: 15699 - DNA, 15 bp, Homo sapiens
tgggcatggtggcgc

SEQ ID NO: 15700 - DNA, 15 bp, Homo sapiens
ctgggcatggtggcg

SEQ ID NO: 15701 - DNA, 15 bp, Homo sapiens
tatctctactaaaaa

SEQ ID NO: 15702 - DNA, 15 bp, Homo sapiens
ctatctctactaaaa

SEQ ID NO: 15703 - DNA, 15 bp, Homo sapiens
cctatctctactaaa

SEQ ID NO: 15704 - DNA, 15 bp, Homo sapiens
ccctatctctactaa

SEQ ID NO: 15705 - DNA, 15 bp, Homo sapiens
accctatctctacta

SEQ ID NO: 15706 - DNA, 15 bp, Homo sapiens
aaccctatctctact

SEQ ID NO: 15707 - DNA, 15 bp, Homo sapiens
aaaccctatctctac

SEQ ID NO: 15708 - DNA, 15 bp, Homo sapiens
gaaaccctatctcta

SEQ ID NO: 15709 - DNA, 15 bp, Homo sapiens
cgaaaccctatctct

SEQ ID NO: 15710 - DNA, 15 bp, Homo sapiens
gcgaaaccctatctc

SEQ ID NO: 15711 - DNA, 15 bp, Homo sapiens
ggcgaaaccctatct

SEQ ID NO: 15712 - DNA, 15 bp, Homo sapiens
tggcgaaaccctatc

SEQ ID NO: 15713 - DNA, 15 bp, Homo sapiens
atggcgaaaccctat

SEQ ID NO: 15714 - DNA, 15 bp, Homo sapiens
catggcgaaacccta

SEQ ID NO: 15715 - DNA, 15 bp, Homo sapiens
acatggcgaaaccct

SEQ ID NO: 15716 - DNA, 15 bp, Homo sapiens
aacatggcgaaaccc

SEQ ID NO: 15717 - DNA, 15 bp, Homo sapiens
tcctggccaacatgg

SEQ ID NO: 15718 - DNA, 15 bp, Homo sapiens
atcctggccaacatg

SEQ ID NO: 15719 - DNA, 15 bp, Homo sapiens
catcctggccaacat

SEQ ID NO: 15720 - DNA, 15 bp, Homo sapiens
ccatcctggccaaca

SEQ ID NO: 15721 - DNA, 15 bp, Homo sapiens
accatcctggccaac

SEQ ID NO: 15722 - DNA, 15 bp, Homo sapiens
gaccatcctggccaa

SEQ ID NO: 15723 - DNA, 15 bp, Homo sapiens
agaccatcctggcca

SEQ ID NO: 15724 - DNA, 15 bp, Homo sapiens
aagaccatcctggcc

SEQ ID NO: 15725 - DNA, 15 bp, Homo sapiens
gaagaccatcctggc

SEQ ID NO: 15726 - DNA, 15 bp, Homo sapiens
tgaagaccatcctgg

SEQ ID NO: 15727 - DNA, 15 bp, Homo sapiens
atgaagaccatcctg

SEQ ID NO: 15728 - DNA, 15 bp, Homo sapiens
gatgaagaccatcct

SEQ ID NO: 15729 - DNA, 15 bp, Homo sapiens
agatgaagaccatcc

SEQ ID NO: 15730 - DNA, 15 bp, Homo sapiens
gagatgaagaccatc

SEQ ID NO: 15731 - DNA, 15 bp, Homo sapiens
agagatgaagaccat

SEQ ID NO: 15732 - DNA, 15 bp, Homo sapiens
aagagatgaagacca

SEQ ID NO: 15733 - DNA, 15 bp, Homo sapiens
caagagatgaagacc

SEQ ID NO: 15734 - DNA, 15 bp, Homo sapiens
tcaagagatgaagac

SEQ ID NO: 15735 - DNA, 15 bp, Homo sapiens
gtcaagagatgaaga

SEQ ID NO: 15736 - DNA, 15 bp, Homo sapiens
ggtcaagagatgaag

SEQ ID NO: 15737 - DNA, 15 bp, Homo sapiens
aggtcaagagatgaa

SEQ ID NO: 15738 - DNA, 15 bp, Homo sapiens
aaggtcaagagatga

SEQ ID NO: 15739 - DNA, 15 bp, Homo sapiens
caaggtcaagagatg

SEQ ID NO: 15740 - DNA, 15 bp, Homo sapiens
acaaggtcaagagat

SEQ ID NO: 15741 - DNA, 15 bp, Homo sapiens
cacaaggtcaagaga

SEQ ID NO: 15742 - DNA, 15 bp, Homo sapiens
tcacaaggtcaagag

SEQ ID NO: 15743 - DNA, 15 bp, Homo sapiens
atcacaaggtcaaga

SEQ ID NO: 15744 - DNA, 15 bp, Homo sapiens
gatcacaaggtcaag

SEQ ID NO: 15745 - DNA, 15 bp, Homo sapiens
agatcacaaggtcaa

SEQ ID NO: 15746 - DNA, 15 bp, Homo sapiens
cagatcacaaggtca

SEQ ID NO: 15747 - DNA, 15 bp, Homo sapiens
gcagatcacaaggtc

SEQ ID NO: 15748 - DNA, 15 bp, Homo sapiens
ggcagatcacaaggt

SEQ ID NO: 15749 - DNA, 15 bp, Homo sapiens
gggcagatcacaagg

SEQ ID NO: 15750 - DNA, 15 bp, Homo sapiens
tgggcagatcacaag

SEQ ID NO: 15751 - DNA, 15 bp, Homo sapiens
gtgggcagatcacaa

SEQ ID NO: 15752 - DNA, 15 bp, Homo sapiens
ggtgggcagatcaca

SEQ ID NO: 15753 - DNA, 15 bp, Homo sapiens
gccgaggtgggcaga

SEQ ID NO: 15754 - DNA, 15 bp, Homo sapiens
ggccgaggtgggcag

SEQ ID NO: 15755 - DNA, 15 bp, Homo sapiens
aggccgaggtgggca

SEQ ID NO: 15756 - DNA, 15 bp, Homo sapiens
gaggccgaggtgggc

SEQ ID NO: 15757 - DNA, 15 bp, Homo sapiens
ggaggccgaggtggg

SEQ ID NO: 15758 - DNA, 15 bp, Homo sapiens
gggaggccgaggtgg

SEQ ID NO: 15759 - DNA, 15 bp, Homo sapiens
tgggaggccgaggtg

SEQ ID NO: 15760 - DNA, 15 bp, Homo sapiens
ttgggaggccgaggt

SEQ ID NO: 15761 - DNA, 15 bp, Homo sapiens
tagcactttgggagg

SEQ ID NO: 15762 - DNA, 15 bp, Homo sapiens
ctagcactttgggag

SEQ ID NO: 15763 - DNA, 15 bp, Homo sapiens
cctagcactttggga

SEQ ID NO: 15764 - DNA, 15 bp, Homo sapiens
tcctagcactttggg

SEQ ID NO: 15765 - DNA, 15 bp, Homo sapiens
atcctagcactttgg

SEQ ID NO: 15766 - DNA, 15 bp, Homo sapiens
aatcctagcactttg

SEQ ID NO: 15767 - DNA, 15 bp, Homo sapiens
taatcctagcacttt

SEQ ID NO: 15768 - DNA, 15 bp, Homo sapiens
gtaatcctagcactt

SEQ ID NO: 15769 - DNA, 15 bp, Homo sapiens
tgtaatcctagcact

SEQ ID NO: 15770 - DNA, 15 bp, Homo sapiens
ctgtaatcctagcac

SEQ ID NO: 15771 - DNA, 15 bp, Homo sapiens
cctgtaatcctagca

SEQ ID NO: 15772 - DNA, 15 bp, Homo sapiens
atgcctgtaatccta

SEQ ID NO: 15773 - DNA, 15 bp, Homo sapiens
catgcctgtaatcct

SEQ ID NO: 15774 - DNA, 15 bp, Homo sapiens
cgtggtggctcatgc

SEQ ID NO: 15775 - DNA, 15 bp, Homo sapiens
gcgtggtggctcatg

SEQ ID NO: 15776 - DNA, 15 bp, Homo sapiens
agcgtggtggctcat

SEQ ID NO: 15777 - DNA, 15 bp, Homo sapiens
cagcgtggtggctca

SEQ ID NO: 15778 - DNA, 15 bp, Homo sapiens
ccagcgtggtggctc

SEQ ID NO: 15779 - DNA, 15 bp, Homo sapiens
cccagcgtggtggct

SEQ ID NO: 15780 - DNA, 15 bp, Homo sapiens
gcccagcgtggtggc

SEQ ID NO: 15781 - DNA, 15 bp, Homo sapiens
ggcccagcgtggtgg

SEQ ID NO: 15782 - DNA, 15 bp, Homo sapiens
aggcccagcgtggtg

SEQ ID NO: 15783 - DNA, 15 bp, Homo sapiens
caggcccagcgtggt

SEQ ID NO: 15784 - DNA, 15 bp, Homo sapiens
gcaggcccagcgtgg

SEQ ID NO: 15785 - DNA, 15 bp, Homo sapiens
agcaggcccagcgtg

SEQ ID NO: 15786 - DNA, 15 bp, Homo sapiens
cagcaggcccagcgt

SEQ ID NO: 15787 - DNA, 15 bp, Homo sapiens
acagcaggcccagcg

SEQ ID NO: 15788 - DNA, 15 bp, Homo sapiens
aacagcaggcccagc

SEQ ID NO: 15789 - DNA, 15 bp, Homo sapiens
caacagcaggcccag

SEQ ID NO: 15790 - DNA, 15 bp, Homo sapiens
ccaacagcaggccca

SEQ ID NO: 15791 - DNA, 15 bp, Homo sapiens
gccaacagcaggccc

SEQ ID NO: 15792 - DNA, 15 bp, Homo sapiens
tgccaacagcaggcc

SEQ ID NO: 15793 - DNA, 15 bp, Homo sapiens
atgccaacagcaggc

SEQ ID NO: 15794 - DNA, 15 bp, Homo sapiens
aatgccaacagcagg

SEQ ID NO: 15795 - DNA, 15 bp, Homo sapiens
aaatgccaacagcag

SEQ ID NO: 15796 - DNA, 15 bp, Homo sapiens
ttaaaatgccaacag

SEQ ID NO: 15797 - DNA, 15 bp, Homo sapiens
tttaaaatgccaaca

SEQ ID NO: 15798 - DNA, 15 bp, Homo sapiens
gtttaaaatgccaac

SEQ ID NO: 15799 - DNA, 15 bp, Homo sapiens
tgtttaaaatgccaa

SEQ ID NO: 15800 - DNA, 15 bp, Homo sapiens
atgtttaaaatgcca

SEQ ID NO: 15801 - DNA, 15 bp, Homo sapiens
gatgtttaaaatgcc

SEQ ID NO: 15802 - DNA, 15 bp, Homo sapiens
ggatgtttaaaatgc

SEQ ID NO: 15803 - DNA, 15 bp, Homo sapiens
aggatgtttaaaatg

SEQ ID NO: 15804 - DNA, 15 bp, Homo sapiens
aaggatgtttaaaat

SEQ ID NO: 15805 - DNA, 15 bp, Homo sapiens
gaaggatgtttaaaa

SEQ ID NO: 15806 - DNA, 15 bp, Homo sapiens
agaaggatgtttaaa

SEQ ID NO: 15807 - DNA, 15 bp, Homo sapiens
tagaaggatgtttaa

SEQ ID NO: 15808 - DNA, 15 bp, Homo sapiens
ctagaaggatgttta

SEQ ID NO: 15809 - DNA, 15 bp, Homo sapiens
tctagaaggatgttt

SEQ ID NO: 15810 - DNA, 15 bp, Homo sapiens
ctctagaaggatgtt

SEQ ID NO: 15811 - DNA, 15 bp, Homo sapiens
actctagaaggatgt

SEQ ID NO: 15812 - DNA, 15 bp, Homo sapiens
gactctagaaggatg

SEQ ID NO: 15813 - DNA, 15 bp, Homo sapiens
agactctagaaggat

SEQ ID NO: 15814 - DNA, 15 bp, Homo sapiens
aagactctagaagga

SEQ ID NO: 15815 - DNA, 15 bp, Homo sapiens
aaagactctagaagg

SEQ ID NO: 15816 - DNA, 15 bp, Homo sapiens
gaaagactctagaag

SEQ ID NO: 15817 - DNA, 15 bp, Homo sapiens
agaaagactctagaa

SEQ ID NO: 15818 - DNA, 15 bp, Homo sapiens
aagaaagactctaga

SEQ ID NO: 15819 - DNA, 15 bp, Homo sapiens
taagaaagactctag

SEQ ID NO: 15820 - DNA, 15 bp, Homo sapiens
ataagaaagactcta

SEQ ID NO: 15821 - DNA, 15 bp, Homo sapiens
aataagaaagactct

SEQ ID NO: 15822 - DNA, 15 bp, Homo sapiens
aaataagaaagactc

SEQ ID NO: 15823 - DNA, 15 bp, Homo sapiens
caaataagaaagact

SEQ ID NO: 15824 - DNA, 15 bp, Homo sapiens
gcaaataagaaagac

SEQ ID NO: 15825 - DNA, 15 bp, Homo sapiens
ggcaaataagaaaga

SEQ ID NO: 15826 - DNA, 15 bp, Homo sapiens
aggcaaataagaaag

SEQ ID NO: 15827 - DNA, 15 bp, Homo sapiens
caggcaaataagaaa

SEQ ID NO: 15828 - DNA, 15 bp, Homo sapiens
acaggcaaataagaa

SEQ ID NO: 15829 - DNA, 15 bp, Homo sapiens
tacaggcaaataaga

SEQ ID NO: 15830 - DNA, 15 bp, Homo sapiens
ttacaggcaaataag

SEQ ID NO: 15831 - DNA, 15 bp, Homo sapiens
cttacaggcaaataa

SEQ ID NO: 15832 - DNA, 15 bp, Homo sapiens
gcttacaggcaaata

SEQ ID NO: 15833 - DNA, 15 bp, Homo sapiens
tgcttacaggcaaat

SEQ ID NO: 15834 - DNA, 15 bp, Homo sapiens
gtgcttacaggcaaa

SEQ ID NO: 15835 - DNA, 15 bp, Homo sapiens
cgtgcttacaggcaa

SEQ ID NO: 15836 - DNA, 15 bp, Homo sapiens
acgtgcttacaggca

SEQ ID NO: 15837 - DNA, 15 bp, Homo sapiens
tacgtgcttacaggc

SEQ ID NO: 15838 - DNA, 15 bp, Homo sapiens
gtacgtgcttacagg

SEQ ID NO: 15839 - DNA, 15 bp, Homo sapiens
tgtacgtgcttacag

SEQ ID NO: 15840 - DNA, 15 bp, Homo sapiens
gtgtacgtgcttaca

SEQ ID NO: 15841 - DNA, 15 bp, Homo sapiens
tgtgtacgtgcttac

SEQ ID NO: 15842 - DNA, 15 bp, Homo sapiens
atgtgtacgtgctta

SEQ ID NO: 15843 - DNA, 15 bp, Homo sapiens
catgtgtacgtgctt

SEQ ID NO: 15844 - DNA, 15 bp, Homo sapiens
acatgtgtacgtgct

SEQ ID NO: 15845 - DNA, 15 bp, Homo sapiens
aacatgtgtacgtgc

SEQ ID NO: 15846 - DNA, 15 bp, Homo sapiens
caacatgtgtacgtg

SEQ ID NO: 15847 - DNA, 15 bp, Homo sapiens
acaacatgtgtacgt

SEQ ID NO: 15848 - DNA, 15 bp, Homo sapiens
aacaacatgtgtacg

SEQ ID NO: 15849 - DNA, 15 bp, Homo sapiens
caacaacatgtgtac

SEQ ID NO: 15850 - DNA, 15 bp, Homo sapiens
acaacaacatgtgta

SEQ ID NO: 15851 - DNA, 15 bp, Homo sapiens
aacaacaacatgtgt

SEQ ID NO: 15852 - DNA, 15 bp, Homo sapiens
caacaacaacatgtg

SEQ ID NO: 15853 - DNA, 15 bp, Homo sapiens
acaacaacaacatgt

SEQ ID NO: 15854 - DNA, 15 bp, Homo sapiens
aacaacaacaacatg

SEQ ID NO: 15855 - DNA, 15 bp, Homo sapiens
aaacaacaacaacat

SEQ ID NO: 15856 - DNA, 15 bp, Homo sapiens
tcaaaacaacaacaa

SEQ ID NO: 15857 - DNA, 15 bp, Homo sapiens
ctcaaaacaacaaca

SEQ ID NO: 15858 - DNA, 15 bp, Homo sapiens
tctcaaaacaacaac

SEQ ID NO: 15859 - DNA, 15 bp, Homo sapiens
gtctcaaaacaacaa

SEQ ID NO: 15860 - DNA, 15 bp, Homo sapiens
tgtctcaaaacaaca

SEQ ID NO: 15861 - DNA, 15 bp, Homo sapiens
ttgtctcaaaacaac

SEQ ID NO: 15862 - DNA, 15 bp, Homo sapiens
cttgtctcaaaacaa

SEQ ID NO: 15863 - DNA, 15 bp, Homo sapiens
ccttgtctcaaaaca

SEQ ID NO: 15864 - DNA, 15 bp, Homo sapiens
accttgtctcaaaac

SEQ ID NO: 15865 - DNA, 15 bp, Homo sapiens
gaccttgtctcaaaa

SEQ ID NO: 15866 - DNA, 15 bp, Homo sapiens
agaccttgtctcaaa

SEQ ID NO: 15867 - DNA, 15 bp, Homo sapiens
cagaccttgtctcaa

SEQ ID NO: 15868 - DNA, 15 bp, Homo sapiens
acagaccttgtctca

SEQ ID NO: 15869 - DNA, 15 bp, Homo sapiens
gacagaccttgtctc

SEQ ID NO: 15870 - DNA, 15 bp, Homo sapiens
cgacagaccttgtct

SEQ ID NO: 15871 - DNA, 15 bp, Homo sapiens
gcgacagaccttgtc

SEQ ID NO: 15872 - DNA, 15 bp, Homo sapiens
ggcgacagaccttgt

SEQ ID NO: 15873 - DNA, 15 bp, Homo sapiens
gggcgacagaccttg

SEQ ID NO: 15874 - DNA, 15 bp, Homo sapiens
tgggcgacagacctt

SEQ ID NO: 15875 - DNA, 15 bp, Homo sapiens
ttgggcgacagacct

SEQ ID NO: 15876 - DNA, 15 bp, Homo sapiens
cttgggcgacagacc

SEQ ID NO: 15877 - DNA, 15 bp, Homo sapiens
gcttgggcgacagac

SEQ ID NO: 15878 - DNA, 15 bp, Homo sapiens
agcttgggcgacaga

SEQ ID NO: 15879 - DNA, 15 bp, Homo sapiens
cagcttgggcgacag

SEQ ID NO: 15880 - DNA, 15 bp, Homo sapiens
ccagcttgggcgaca

SEQ ID NO: 15881 - DNA, 15 bp, Homo sapiens
tccagcttgggcgac

SEQ ID NO: 15882 - DNA, 15 bp, Homo sapiens
ctccagcttgggcga

SEQ ID NO: 15883 - DNA, 15 bp, Homo sapiens
gctccagcttgggcg

SEQ ID NO: 15884 - DNA, 15 bp, Homo sapiens
tgctccagcttgggc

SEQ ID NO: 15885 - DNA, 15 bp, Homo sapiens
gtgctccagcttggg

SEQ ID NO: 15886 - DNA, 15 bp, Homo sapiens
tgtgctccagcttgg

SEQ ID NO: 15887 - DNA, 15 bp, Homo sapiens
ctgtgctccagcttg

SEQ ID NO: 15888 - DNA, 15 bp, Homo sapiens
actgtgctccagctt

SEQ ID NO: 15889 - DNA, 15 bp, Homo sapiens
cactgtgctccagct

SEQ ID NO: 15890 - DNA, 15 bp, Homo sapiens
ccactgtgctccagc

SEQ ID NO: 15891 - DNA, 15 bp, Homo sapiens
accactgtgctccag

SEQ ID NO: 15892 - DNA, 15 bp, Homo sapiens
caccactgtgctcca

SEQ ID NO: 15893 - DNA, 15 bp, Homo sapiens
gcaccactgtgctcc

SEQ ID NO: 15894 - DNA, 15 bp, Homo sapiens
tgcaccactgtgctc

SEQ ID NO: 15895 - DNA, 15 bp, Homo sapiens
ttgcaccactgtgct

SEQ ID NO: 15896 - DNA, 15 bp, Homo sapiens
attgcaccactgtgc

SEQ ID NO: 15897 - DNA, 15 bp, Homo sapiens
gattgcaccactgtg

SEQ ID NO: 15898 - DNA, 15 bp, Homo sapiens
tgattgcaccactgt

SEQ ID NO: 15899 - DNA, 15 bp, Homo sapiens
gtgattgcaccactg

SEQ ID NO: 15900 - DNA, 15 bp, Homo sapiens
tgtgattgcaccact

SEQ ID NO: 15901 - DNA, 15 bp, Homo sapiens
ctgtgattgcaccac

SEQ ID NO: 15902 - DNA, 15 bp, Homo sapiens
gctgtgattgcacca

SEQ ID NO: 15903 - DNA, 15 bp, Homo sapiens
agctgtgattgcacc

SEQ ID NO: 15904 - DNA, 15 bp, Homo sapiens
gagctgtgattgcac

SEQ ID NO: 15905 - DNA, 15 bp, Homo sapiens
tgagctgtgattgca

SEQ ID NO: 15906 - DNA, 15 bp, Homo sapiens
gtgagctgtgattgc

SEQ ID NO: 15907 - DNA, 15 bp, Homo sapiens
agtgagctgtgattg

SEQ ID NO: 15908 - DNA, 15 bp, Homo sapiens
tagtgagctgtgatt

SEQ ID NO: 15909 - DNA, 15 bp, Homo sapiens
gtagtgagctgtgat

SEQ ID NO: 15910 - DNA, 15 bp, Homo sapiens
tgtagtgagctgtga

SEQ ID NO: 15911 - DNA, 15 bp, Homo sapiens
ctgtagtgagctgtg

SEQ ID NO: 15912 - DNA, 15 bp, Homo sapiens
gctgtagtgagctgt

SEQ ID NO: 15913 - DNA, 15 bp, Homo sapiens
agctgtagtgagctg

SEQ ID NO: 15914 - DNA, 15 bp, Homo sapiens
aagctgtagtgagct

SEQ ID NO: 15915 - DNA, 15 bp, Homo sapiens
gaagctgtagtgagc

SEQ ID NO: 15916 - DNA, 15 bp, Homo sapiens
cgaagctgtagtgag

SEQ ID NO: 15917 - DNA, 15 bp, Homo sapiens
tcgaagctgtagtga

SEQ ID NO: 15918 - DNA, 15 bp, Homo sapiens
gtcgaagctgtagtg

SEQ ID NO: 15919 - DNA, 15 bp, Homo sapiens
ggtcgaagctgtagt

SEQ ID NO: 15920 - DNA, 15 bp, Homo sapiens
aggtcgaagctgtag

SEQ ID NO: 15921 - DNA, 15 bp, Homo sapiens
gaggtcgaagctgta

SEQ ID NO: 15922 - DNA, 15 bp, Homo sapiens
agaggtcgaagctgt

SEQ ID NO: 15923 - DNA, 15 bp, Homo sapiens
aagaggtcgaagctg

SEQ ID NO: 15924 - DNA, 15 bp, Homo sapiens
caagaggtcgaagct

SEQ ID NO: 15925 - DNA, 15 bp, Homo sapiens
ccaagaggtcgaagc

SEQ ID NO: 15926 - DNA, 15 bp, Homo sapiens
cccaagaggtcgaag

SEQ ID NO: 15927 - DNA, 15 bp, Homo sapiens
acccaagaggtcgaa

SEQ ID NO: 15928 - DNA, 15 bp, Homo sapiens
cacccaagaggtcga

SEQ ID NO: 15929 - DNA, 15 bp, Homo sapiens
gcacccaagaggtcg

SEQ ID NO: 15930 - DNA, 15 bp, Homo sapiens
tgcacccaagaggtc

SEQ ID NO: 15931 - DNA, 15 bp, Homo sapiens
ttgcacccaagaggt

SEQ ID NO: 15932 - DNA, 15 bp, Homo sapiens
cttgcacccaagagg

SEQ ID NO: 15933 - DNA, 15 bp, Homo sapiens
acttgcacccaagag

SEQ ID NO: 15934 - DNA, 15 bp, Homo sapiens
cacttgcacccaaga

SEQ ID NO: 15935 - DNA, 15 bp, Homo sapiens
tcacttgcacccaag

SEQ ID NO: 15936 - DNA, 15 bp, Homo sapiens
atcacttgcacccaa

SEQ ID NO: 15937 - DNA, 15 bp, Homo sapiens
gatcacttgcaccca

SEQ ID NO: 15938 - DNA, 15 bp, Homo sapiens
ggatcacttgcaccc

SEQ ID NO: 15939 - DNA, 15 bp, Homo sapiens
aggatcacttgcacc

SEQ ID NO: 15940 - DNA, 15 bp, Homo sapiens
gaggatcacttgcac

SEQ ID NO: 15941 - DNA, 15 bp, Homo sapiens
ggaggatcacttgca

SEQ ID NO: 15942 - DNA, 15 bp, Homo sapiens
gggaggatcacttgc

SEQ ID NO: 15943 - DNA, 15 bp, Homo sapiens
ttgggaggatcactt

SEQ ID NO: 15944 - DNA, 15 bp, Homo sapiens
attgggaggatcact

SEQ ID NO: 15945 - DNA, 15 bp, Homo sapiens
gattgggaggatcac

SEQ ID NO: 15946 - DNA, 15 bp, Homo sapiens
tgattgggaggatca

SEQ ID NO: 15947 - DNA, 15 bp, Homo sapiens
ctgattgggaggatc

SEQ ID NO: 15948 - DNA, 15 bp, Homo sapiens
gctgattgggaggat

SEQ ID NO: 15949 - DNA, 15 bp, Homo sapiens
ggctgattgggagga

SEQ ID NO: 15950 - DNA, 15 bp, Homo sapiens
aggctgattgggagg

SEQ ID NO: 15951 - DNA, 15 bp, Homo sapiens
gaggctgattgggag

SEQ ID NO: 15952 - DNA, 15 bp, Homo sapiens
ggaggctgattggga

SEQ ID NO: 15953 - DNA, 15 bp, Homo sapiens
gggaggctgattggg

SEQ ID NO: 15954 - DNA, 15 bp, Homo sapiens
tgggaggctgattgg

SEQ ID NO: 15955 - DNA, 15 bp, Homo sapiens
ttgggaggctgattg

SEQ ID NO: 15956 - DNA, 15 bp, Homo sapiens
cttgggaggctgatt

SEQ ID NO: 15957 - DNA, 15 bp, Homo sapiens
acttgggaggctgat

SEQ ID NO: 15958 - DNA, 15 bp, Homo sapiens
cctacttgggaggct

SEQ ID NO: 15959 - DNA, 15 bp, Homo sapiens
acctacttgggaggc

SEQ ID NO: 15960 - DNA, 15 bp, Homo sapiens
cacctacttgggagg

SEQ ID NO: 15961 - DNA, 15 bp, Homo sapiens
ccacctacttgggag

SEQ ID NO: 15962 - DNA, 15 bp, Homo sapiens
cccacctacttggga

SEQ ID NO: 15963 - DNA, 15 bp, Homo sapiens
tcccacctacttggg

SEQ ID NO: 15964 - DNA, 15 bp, Homo sapiens
gtcccacctacttgg

SEQ ID NO: 15965 - DNA, 15 bp, Homo sapiens
agtcccacctacttg

SEQ ID NO: 15966 - DNA, 15 bp, Homo sapiens
tagtcccacctactt

SEQ ID NO: 15967 - DNA, 15 bp, Homo sapiens
gtagtcccacctact

SEQ ID NO: 15968 - DNA, 15 bp, Homo sapiens
tgtagtcccacctac

SEQ ID NO: 15969 - DNA, 15 bp, Homo sapiens
ctgtagtcccaccta

SEQ ID NO: 15970 - DNA, 15 bp, Homo sapiens
cctgtagtcccacct

SEQ ID NO: 15971 - DNA, 15 bp, Homo sapiens
acctgtagtcccacc

SEQ ID NO: 15972 - DNA, 15 bp, Homo sapiens
cacctgtagtcccac

SEQ ID NO: 15973 - DNA, 15 bp, Homo sapiens
gacacctgtagtccc

SEQ ID NO: 15974 - DNA, 15 bp, Homo sapiens
ggacacctgtagtcc

SEQ ID NO: 15975 - DNA, 15 bp, Homo sapiens
cggacacctgtagtc

SEQ ID NO: 15976 - DNA, 15 bp, Homo sapiens
gcggacacctgtagt

SEQ ID NO: 15977 - DNA, 15 bp, Homo sapiens
agcggacacctgtag

SEQ ID NO: 15978 - DNA, 15 bp, Homo sapiens
tagcggacacctgta

SEQ ID NO: 15979 - DNA, 15 bp, Homo sapiens
gtagcggacacctgt

SEQ ID NO: 15980 - DNA, 15 bp, Homo sapiens
ggtagcggacacctg

SEQ ID NO: 15981 - DNA, 15 bp, Homo sapiens
tggtagcggacacct

SEQ ID NO: 15982 - DNA, 15 bp, Homo sapiens
atggtagcggacacc

SEQ ID NO: 15983 - DNA, 15 bp, Homo sapiens
catggtagcggacac

SEQ ID NO: 15984 - DNA, 15 bp, Homo sapiens
gcatggtagcggaca

SEQ ID NO: 15985 - DNA, 15 bp, Homo sapiens
ggcatggtagcggac

SEQ ID NO: 15986 - DNA, 15 bp, Homo sapiens
gggcatggtagcgga

SEQ ID NO: 15987 - DNA, 15 bp, Homo sapiens
tgggcatggtagcgg

SEQ ID NO: 15988 - DNA, 15 bp, Homo sapiens
ctgggcatggtagcg

SEQ ID NO: 15989 - DNA, 15 bp, Homo sapiens
gctgggcatggtagc

SEQ ID NO: 15990 - DNA, 15 bp, Homo sapiens
agctgggcatggtag

SEQ ID NO: 15991 - DNA, 15 bp, Homo sapiens
tagctgggcatggta

SEQ ID NO: 15992 - DNA, 15 bp, Homo sapiens
caaaaaaaatacaaa

SEQ ID NO: 15993 - DNA, 15 bp, Homo sapiens
acaaaaaaaatacaa

SEQ ID NO: 15994 - DNA, 15 bp, Homo sapiens
tacaaaaaaaataca

SEQ ID NO: 15995 - DNA, 15 bp, Homo sapiens
ctacaaaaaaaatac

SEQ ID NO: 15996 - DNA, 15 bp, Homo sapiens
tctacaaaaaaaata

SEQ ID NO: 15997 - DNA, 15 bp, Homo sapiens
ctctacaaaaaaaat

SEQ ID NO: 15998 - DNA, 15 bp, Homo sapiens
tctctacaaaaaaaa

SEQ ID NO: 15999 - DNA, 15 bp, Homo sapiens
gtctctacaaaaaaa

SEQ ID NO: 16000 - DNA, 15 bp, Homo sapiens
cgtctctacaaaaaa

SEQ ID NO: 16001 - DNA, 15 bp, Homo sapiens
ccgtctctacaaaaa

SEQ ID NO: 16002 - DNA, 15 bp, Homo sapiens
tccgtctctacaaaa

SEQ ID NO: 16003 - DNA, 15 bp, Homo sapiens
ctccgtctctacaaa

SEQ ID NO: 16004 - DNA, 15 bp, Homo sapiens
actccgtctctacaa

SEQ ID NO: 16005 - DNA, 15 bp, Homo sapiens
aactccgtctctaca

SEQ ID NO: 16006 - DNA, 15 bp, Homo sapiens
gcaacatggtgaaac

SEQ ID NO: 16007 - DNA, 15 bp, Homo sapiens
ggcaacatggtgaaa

SEQ ID NO: 16008 - DNA, 15 bp, Homo sapiens
gggcaacatggtgaa

SEQ ID NO: 16009 - DNA, 15 bp, Homo sapiens
tgggcaacatggtga

SEQ ID NO: 16010 - DNA, 15 bp, Homo sapiens
ctgggcaacatggtg

SEQ ID NO: 16011 - DNA, 15 bp, Homo sapiens
tctgggcaacatggt

SEQ ID NO: 16012 - DNA, 15 bp, Homo sapiens
gtctgggcaacatgg

SEQ ID NO: 16013 - DNA, 15 bp, Homo sapiens
agtctgggcaacatg

SEQ ID NO: 16014 - DNA, 15 bp, Homo sapiens
cagtctgggcaacat

SEQ ID NO: 16015 - DNA, 15 bp, Homo sapiens
ccagtctgggcaaca

SEQ ID NO: 16016 - DNA, 15 bp, Homo sapiens
accagtctgggcaac

SEQ ID NO: 16017 - DNA, 15 bp, Homo sapiens
gaccagtctgggcaa

SEQ ID NO: 16018 - DNA, 15 bp, Homo sapiens
agaccagtctgggca

SEQ ID NO: 16019 - DNA, 15 bp, Homo sapiens
gagaccagtctgggc

SEQ ID NO: 16020 - DNA, 15 bp, Homo sapiens
tgagaccagtctggg

SEQ ID NO: 16021 - DNA, 15 bp, Homo sapiens
ttgagaccagtctgg

SEQ ID NO: 16022 - DNA, 15 bp, Homo sapiens
tttgagaccagtctg

SEQ ID NO: 16023 - DNA, 15 bp, Homo sapiens
gtttgagaccagtct

SEQ ID NO: 16024 - DNA, 15 bp, Homo sapiens
agtttgagaccagtc

SEQ ID NO: 16025 - DNA, 15 bp, Homo sapiens
gagtttgagaccagt

SEQ ID NO: 16026 - DNA, 15 bp, Homo sapiens
ggagtttgagaccag

SEQ ID NO: 16027 - DNA, 15 bp, Homo sapiens
aggagtttgagacca

SEQ ID NO: 16028 - DNA, 15 bp, Homo sapiens
aaggagtttgagacc

SEQ ID NO: 16029 - DNA, 15 bp, Homo sapiens
aaaggagtttgagac

SEQ ID NO: 16030 - DNA, 15 bp, Homo sapiens
caaaggagtttgaga

SEQ ID NO: 16031 - DNA, 15 bp, Homo sapiens
gcaaaggagtttgag

SEQ ID NO: 16032 - DNA, 15 bp, Homo sapiens
agcaaaggagtttga

SEQ ID NO: 16033 - DNA, 15 bp, Homo sapiens
gagcaaaggagtttg

SEQ ID NO: 16034 - DNA, 15 bp, Homo sapiens
tgagcaaaggagttt

SEQ ID NO: 16035 - DNA, 15 bp, Homo sapiens
ttgagcaaaggagtt

SEQ ID NO: 16036 - DNA, 15 bp, Homo sapiens
tttgagcaaaggagt

SEQ ID NO: 16037 - DNA, 15 bp, Homo sapiens
gtttgagcaaaggag

SEQ ID NO: 16038 - DNA, 15 bp, Homo sapiens
cgtttgagcaaagga

SEQ ID NO: 16039 - DNA, 15 bp, Homo sapiens
tcgtttgagcaaagg

SEQ ID NO: 16040 - DNA, 15 bp, Homo sapiens
atcgtttgagcaaag

SEQ ID NO: 16041 - DNA, 15 bp, Homo sapiens
gatcgtttgagcaaa

SEQ ID NO: 16042 - DNA, 15 bp, Homo sapiens
ggatcgtttgagcaa

SEQ ID NO: 16043 - DNA, 15 bp, Homo sapiens
aggatcgtttgagca

SEQ ID NO: 16044 - DNA, 15 bp, Homo sapiens
aaggatcgtttgagc

SEQ ID NO: 16045 - DNA, 15 bp, Homo sapiens
gaaggatcgtttgag

SEQ ID NO: 16046 - DNA, 15 bp, Homo sapiens
ggaaggatcgtttga

SEQ ID NO: 16047 - DNA, 15 bp, Homo sapiens
cggaaggatcgtttg

SEQ ID NO: 16048 - DNA, 15 bp, Homo sapiens
gcggaaggatcgttt

SEQ ID NO: 16049 - DNA, 15 bp, Homo sapiens
ggcggaaggatcgtt

SEQ ID NO: 16050 - DNA, 15 bp, Homo sapiens
aggcggaaggatcgt

SEQ ID NO: 16051 - DNA, 15 bp, Homo sapiens
gaggcggaaggatcg

SEQ ID NO: 16052 - DNA, 15 bp, Homo sapiens
cgaggcggaaggatc

SEQ ID NO: 16053 - DNA, 15 bp, Homo sapiens
ccgaggcggaaggat

SEQ ID NO: 16054 - DNA, 15 bp, Homo sapiens
gccgaggcggaagga

SEQ ID NO: 16055 - DNA, 15 bp, Homo sapiens
ggccgaggcggaagg

SEQ ID NO: 16056 - DNA, 15 bp, Homo sapiens
aggccgaggcggaag

SEQ ID NO: 16057 - DNA, 15 bp, Homo sapiens
gaggccgaggcggaa

SEQ ID NO: 16058 - DNA, 15 bp, Homo sapiens
ggaggccgaggcgga

SEQ ID NO: 16059 - DNA, 15 bp, Homo sapiens
gggaggccgaggcgg

SEQ ID NO: 16060 - DNA, 15 bp, Homo sapiens
tgggaggccgaggcg

SEQ ID NO: 16061 - DNA, 15 bp, Homo sapiens
ccggcactttgggag

SEQ ID NO: 16062 - DNA, 15 bp, Homo sapiens
ttgtaatcccggcac

SEQ ID NO: 16063 - DNA, 15 bp, Homo sapiens
cttgtaatcccggca

SEQ ID NO: 16064 - DNA, 15 bp, Homo sapiens
acttgtaatcccggc

SEQ ID NO: 16065 - DNA, 15 bp, Homo sapiens
cacttgtaatcccgg

SEQ ID NO: 16066 - DNA, 15 bp, Homo sapiens
acacttgtaatcccg

SEQ ID NO: 16067 - DNA, 15 bp, Homo sapiens
cacacttgtaatccc

SEQ ID NO: 16068 - DNA, 15 bp, Homo sapiens
gcacacttgtaatcc

SEQ ID NO: 16069 - DNA, 15 bp, Homo sapiens
tgcacacttgtaatc

SEQ ID NO: 16070 - DNA, 15 bp, Homo sapiens
gtgcacacttgtaat

SEQ ID NO: 16071 - DNA, 15 bp, Homo sapiens
ggtgcacacttgtaa

SEQ ID NO: 16072 - DNA, 15 bp, Homo sapiens
aggtgcacacttgta

SEQ ID NO: 16073 - DNA, 15 bp, Homo sapiens
gaggtgcacacttgt

SEQ ID NO: 16074 - DNA, 15 bp, Homo sapiens
agaggtgcacacttg

SEQ ID NO: 16075 - DNA, 15 bp, Homo sapiens
cagaggtgcacactt

SEQ ID NO: 16076 - DNA, 15 bp, Homo sapiens
acagaggtgcacact

SEQ ID NO: 16077 - DNA, 15 bp, Homo sapiens
cacagaggtgcacac

SEQ ID NO: 16078 - DNA, 15 bp, Homo sapiens
gcacagaggtgcaca

SEQ ID NO: 16079 - DNA, 15 bp, Homo sapiens
ggcacagaggtgcac

SEQ ID NO: 16080 - DNA, 15 bp, Homo sapiens
aggcacagaggtgca

SEQ ID NO: 16081 - DNA, 15 bp, Homo sapiens
caggcacagaggtgc

SEQ ID NO: 16082 - DNA, 15 bp, Homo sapiens
ccaggcacagaggtg

SEQ ID NO: 16083 - DNA, 15 bp, Homo sapiens
gccaggcacagaggt

SEQ ID NO: 16084 - DNA, 15 bp, Homo sapiens
ggccaggcacagagg

SEQ ID NO: 16085 - DNA, 15 bp, Homo sapiens
gggccaggcacagag

SEQ ID NO: 16086 - DNA, 15 bp, Homo sapiens
tgggccaggcacaga

SEQ ID NO: 16087 - DNA, 15 bp, Homo sapiens
gtgggccaggcacag

SEQ ID NO: 16088 - DNA, 15 bp, Homo sapiens
tgtgggccaggcaca

SEQ ID NO: 16089 - DNA, 15 bp, Homo sapiens
atgtgggccaggcac

SEQ ID NO: 16090 - DNA, 15 bp, Homo sapiens
tatgtgggccaggca

SEQ ID NO: 16091 - DNA, 15 bp, Homo sapiens
atatgtgggccaggc

SEQ ID NO: 16092 - DNA, 15 bp, Homo sapiens
aatatgtgggccagg

SEQ ID NO: 16093 - DNA, 15 bp, Homo sapiens
caatatgtgggccag

SEQ ID NO: 16094 - DNA, 15 bp, Homo sapiens
acaatatgtgggcca

SEQ ID NO: 16095 - DNA, 15 bp, Homo sapiens
aacaatatgtgggcc

SEQ ID NO: 16096 - DNA, 15 bp, Homo sapiens
aaacaatatgtgggc

SEQ ID NO: 16097 - DNA, 15 bp, Homo sapiens
aaaacaatatgtggg

SEQ ID NO: 16098 - DNA, 15 bp, Homo sapiens
taaaacaatatgtgg

SEQ ID NO: 16099 - DNA, 15 bp, Homo sapiens
ctaaaacaatatgtg

SEQ ID NO: 16100 - DNA, 15 bp, Homo sapiens
tctaaaacaatatgt

SEQ ID NO: 16101 - DNA, 15 bp, Homo sapiens
atctaaaacaatatg

SEQ ID NO: 16102 - DNA, 15 bp, Homo sapiens
catctaaaacaatat

SEQ ID NO: 16103 - DNA, 15 bp, Homo sapiens
tcatctaaaacaata

SEQ ID NO: 16104 - DNA, 15 bp, Homo sapiens
ttcatctaaaacaat

SEQ ID NO: 16105 - DNA, 15 bp, Homo sapiens
attcatctaaaacaa

SEQ ID NO: 16106 - DNA, 15 bp, Homo sapiens
cattcatctaaaaca

SEQ ID NO: 16107 - DNA, 15 bp, Homo sapiens
tcattcatctaaaac

SEQ ID NO: 16108 - DNA, 15 bp, Homo sapiens
ctcattcatctaaaa

SEQ ID NO: 16109 - DNA, 15 bp, Homo sapiens
tctcattcatctaaa

SEQ ID NO: 16110 - DNA, 15 bp, Homo sapiens
atctcattcatctaa

SEQ ID NO: 16111 - DNA, 15 bp, Homo sapiens
gatctcattcatcta

SEQ ID NO: 16112 - DNA, 15 bp, Homo sapiens
tgatctcattcatct

SEQ ID NO: 16113 - DNA, 15 bp, Homo sapiens
atgatctcattcatc

SEQ ID NO: 16114 - DNA, 15 bp, Homo sapiens
tatgatctcattcat

SEQ ID NO: 16115 - DNA, 15 bp, Homo sapiens
atatgatctcattca

SEQ ID NO: 16116 - DNA, 15 bp, Homo sapiens
tatatgatctcattc

SEQ ID NO: 16117 - DNA, 15 bp, Homo sapiens
atatatgatctcatt

SEQ ID NO: 16118 - DNA, 15 bp, Homo sapiens
catatatgatctcat

SEQ ID NO: 16119 - DNA, 15 bp, Homo sapiens
acatatatgatctca

SEQ ID NO: 16120 - DNA, 15 bp, Homo sapiens
tacatatatgatctc

SEQ ID NO: 16121 - DNA, 15 bp, Homo sapiens
gtacatatatgatct

SEQ ID NO: 16122 - DNA, 15 bp, Homo sapiens
agtacatatatgatc

SEQ ID NO: 16123 - DNA, 15 bp, Homo sapiens
aagtacatatatgat

SEQ ID NO: 16124 - DNA, 15 bp, Homo sapiens
aaagtacatatatga

SEQ ID NO: 16125 - DNA, 15 bp, Homo sapiens
aaaagtacatatatg

SEQ ID NO: 16126 - DNA, 15 bp, Homo sapiens
caaaagtacatatat

SEQ ID NO: 16127 - DNA, 15 bp, Homo sapiens
acaaaagtacatata

SEQ ID NO: 16128 - DNA, 15 bp, Homo sapiens
tacaaaagtacatat

SEQ ID NO: 16129 - DNA, 15 bp, Homo sapiens
ttacaaaagtacata

SEQ ID NO: 16130 - DNA, 15 bp, Homo sapiens
gttacaaaagtacat

SEQ ID NO: 16131 - DNA, 15 bp, Homo sapiens
agttacaaaagtaca

SEQ ID NO: 16132 - DNA, 15 bp, Homo sapiens
aagttacaaaagtac

SEQ ID NO: 16133 - DNA, 15 bp, Homo sapiens
caagttacaaaagta

SEQ ID NO: 16134 - DNA, 15 bp, Homo sapiens
gcaagttacaaaagt

SEQ ID NO: 16135 - DNA, 15 bp, Homo sapiens
agcaagttacaaaag

SEQ ID NO: 16136 - DNA, 15 bp, Homo sapiens
tagcaagttacaaaa

SEQ ID NO: 16137 - DNA, 15 bp, Homo sapiens
gtagcaagttacaaa

SEQ ID NO: 16138 - DNA, 15 bp, Homo sapiens
ggtagcaagttacaa

SEQ ID NO: 16139 - DNA, 15 bp, Homo sapiens
aggtagcaagttaca

SEQ ID NO: 16140 - DNA, 15 bp, Homo sapiens
aaggtagcaagttac

SEQ ID NO: 16141 - DNA, 15 bp, Homo sapiens
aaaggtagcaagtta

SEQ ID NO: 16142 - DNA, 15 bp, Homo sapiens
gaaaggtagcaagtt

SEQ ID NO: 16143 - DNA, 15 bp, Homo sapiens
ggaaaggtagcaagt

SEQ ID NO: 16144 - DNA, 15 bp, Homo sapiens
aggaaaggtagcaag

SEQ ID NO: 16145 - DNA, 15 bp, Homo sapiens
gaggaaaggtagcaa

SEQ ID NO: 16146 - DNA, 15 bp, Homo sapiens
tgaggaaaggtagca

SEQ ID NO: 16147 - DNA, 15 bp, Homo sapiens
ttgaggaaaggtagc

SEQ ID NO: 16148 - DNA, 15 bp, Homo sapiens
gttgaggaaaggtag

SEQ ID NO: 16149 - DNA, 15 bp, Homo sapiens
tgttgaggaaaggta

SEQ ID NO: 16150 - DNA, 15 bp, Homo sapiens
ttgttgaggaaaggt

SEQ ID NO: 16151 - DNA, 15 bp, Homo sapiens
tttgttgaggaaagg

SEQ ID NO: 16152 - DNA, 15 bp, Homo sapiens
ttttgttgaggaaag

SEQ ID NO: 16153 - DNA, 15 bp, Homo sapiens
attttgttgaggaaa

SEQ ID NO: 16154 - DNA, 15 bp, Homo sapiens
cattttgttgaggaa

SEQ ID NO: 16155 - DNA, 15 bp, Homo sapiens
acattttgttgagga

SEQ ID NO: 16156 - DNA, 15 bp, Homo sapiens
aacattttgttgagg

SEQ ID NO: 16157 - DNA, 15 bp, Homo sapiens
caacattttgttgag

SEQ ID NO: 16158 - DNA, 15 bp, Homo sapiens
acaacattttgttga

SEQ ID NO: 16159 - DNA, 15 bp, Homo sapiens
tacaacattttgttg

SEQ ID NO: 16160 - DNA, 15 bp, Homo sapiens
ttacaacattttgtt

SEQ ID NO: 16161 - DNA, 15 bp, Homo sapiens
tttacaacattttgt

SEQ ID NO: 16162 - DNA, 15 bp, Homo sapiens
atttacaacattttg

SEQ ID NO: 16163 - DNA, 15 bp, Homo sapiens
tatttacaacatttt

SEQ ID NO: 16164 - DNA, 15 bp, Homo sapiens
atatttacaacattt

SEQ ID NO: 16165 - DNA, 15 bp, Homo sapiens
gatatttacaacatt

SEQ ID NO: 16166 - DNA, 15 bp, Homo sapiens
ggatatttacaacat

SEQ ID NO: 16167 - DNA, 15 bp, Homo sapiens
tggatatttacaaca

SEQ ID NO: 16168 - DNA, 15 bp, Homo sapiens
atggatatttacaac

SEQ ID NO: 16169 - DNA, 15 bp, Homo sapiens
catggatatttacaa

SEQ ID NO: 16170 - DNA, 15 bp, Homo sapiens
acatggatatttaca

SEQ ID NO: 16171 - DNA, 15 bp, Homo sapiens
gacatggatatttac

SEQ ID NO: 16172 - DNA, 15 bp, Homo sapiens
ggacatggatattta

SEQ ID NO: 16173 - DNA, 15 bp, Homo sapiens
tggacatggatattt

SEQ ID NO: 16174 - DNA, 15 bp, Homo sapiens
atggacatggatatt

SEQ ID NO: 16175 - DNA, 15 bp, Homo sapiens
tatggacatggatat

SEQ ID NO: 16176 - DNA, 15 bp, Homo sapiens
ttatggacatggata

SEQ ID NO: 16177 - DNA, 15 bp, Homo sapiens
tttatggacatggat

SEQ ID NO: 16178 - DNA, 15 bp, Homo sapiens
ttttatggacatgga

SEQ ID NO: 16179 - DNA, 15 bp, Homo sapiens
tttttatggacatgg

SEQ ID NO: 16180 - DNA, 15 bp, Homo sapiens
atttttatggacatg

SEQ ID NO: 16181 - DNA, 15 bp, Homo sapiens
tatttttatggacat

SEQ ID NO: 16182 - DNA, 15 bp, Homo sapiens
ctatttttatggaca

SEQ ID NO: 16183 - DNA, 15 bp, Homo sapiens
tctatttttatggac

SEQ ID NO: 16184 - DNA, 15 bp, Homo sapiens
gtctatttttatgga

SEQ ID NO: 16185 - DNA, 15 bp, Homo sapiens
cgtctatttttatgg

SEQ ID NO: 16186 - DNA, 15 bp, Homo sapiens
acgtctatttttatg

SEQ ID NO: 16187 - DNA, 15 bp, Homo sapiens
tacgtctatttttat

SEQ ID NO: 16188 - DNA, 15 bp, Homo sapiens
atacgtctattttta

SEQ ID NO: 16189 - DNA, 15 bp, Homo sapiens
tatacgtctattttt

SEQ ID NO: 16190 - DNA, 15 bp, Homo sapiens
atatacgtctatttt

SEQ ID NO: 16191 - DNA, 15 bp, Homo sapiens
gatatacgtctattt

SEQ ID NO: 16192 - DNA, 15 bp, Homo sapiens
agatatacgtctatt

SEQ ID NO: 16193 - DNA, 15 bp, Homo sapiens
aagatatacgtctat

SEQ ID NO: 16194 - DNA, 15 bp, Homo sapiens
gaagatatacgtcta

SEQ ID NO: 16195 - DNA, 15 bp, Homo sapiens
tgaagatatacgtct

SEQ ID NO: 16196 - DNA, 15 bp, Homo sapiens
gtgaagatatacgtc

SEQ ID NO: 16197 - DNA, 15 bp, Homo sapiens
agtgaagatatacgt

SEQ ID NO: 16198 - DNA, 15 bp, Homo sapiens
aagtgaagatatacg

SEQ ID NO: 16199 - DNA, 15 bp, Homo sapiens
aaagtgaagatatac

SEQ ID NO: 16200 - DNA, 15 bp, Homo sapiens
aaaagtgaagatata

SEQ ID NO: 16201 - DNA, 15 bp, Homo sapiens
gaaaagtgaagatat

SEQ ID NO: 16202 - DNA, 15 bp, Homo sapiens
ggaaaagtgaagata

SEQ ID NO: 16203 - DNA, 15 bp, Homo sapiens
gggaaaagtgaagat

SEQ ID NO: 16204 - DNA, 15 bp, Homo sapiens
agggaaaagtgaaga

SEQ ID NO: 16205 - DNA, 15 bp, Homo sapiens
tagggaaaagtgaag

SEQ ID NO: 16206 - DNA, 15 bp, Homo sapiens
ttagggaaaagtgaa

SEQ ID NO: 16207 - DNA, 15 bp, Homo sapiens
tttagggaaaagtga

SEQ ID NO: 16208 - DNA, 15 bp, Homo sapiens
ttttagggaaaagtg

SEQ ID NO: 16209 - DNA, 15 bp, Homo sapiens
attttagggaaaagt

SEQ ID NO: 16210 - DNA, 15 bp, Homo sapiens
cattttagggaaaag

SEQ ID NO: 16211 - DNA, 15 bp, Homo sapiens
tcattttagggaaaa

SEQ ID NO: 16212 - DNA, 15 bp, Homo sapiens
ttcattttagggaaa

SEQ ID NO: 16213 - DNA, 15 bp, Homo sapiens
tttcattttagggaa

SEQ ID NO: 16214 - DNA, 15 bp, Homo sapiens
ttttcattttaggga

SEQ ID NO: 16215 - DNA, 15 bp, Homo sapiens
attttcattttaggg

SEQ ID NO: 16216 - DNA, 15 bp, Homo sapiens
tattttcattttagg

SEQ ID NO: 16217 - DNA, 15 bp, Homo sapiens
ttattttcattttag

SEQ ID NO: 16218 - DNA, 15 bp, Homo sapiens
gttattttcatttta

SEQ ID NO: 16219 - DNA, 15 bp, Homo sapiens
agttattttcatttt

SEQ ID NO: 16220 - DNA, 15 bp, Homo sapiens
aagttattttcattt

SEQ ID NO: 16221 - DNA, 15 bp, Homo sapiens
taagttattttcatt

SEQ ID NO: 16222 - DNA, 15 bp, Homo sapiens
ttaagttattttcat

SEQ ID NO: 16223 - DNA, 15 bp, Homo sapiens
gttaagttattttca

SEQ ID NO: 16224 - DNA, 15 bp, Homo sapiens
agttaagttattttc

SEQ ID NO: 16225 - DNA, 15 bp, Homo sapiens
aagttaagttatttt

SEQ ID NO: 16226 - DNA, 15 bp, Homo sapiens
caagttaagttattt

SEQ ID NO: 16227 - DNA, 15 bp, Homo sapiens
gcaagttaagttatt

SEQ ID NO: 16228 - DNA, 15 bp, Homo sapiens
tgcaagttaagttat

SEQ ID NO: 16229 - DNA, 15 bp, Homo sapiens
atgcaagttaagtta

SEQ ID NO: 16230 - DNA, 15 bp, Homo sapiens
aatgcaagttaagtt

SEQ ID NO: 16231 - DNA, 15 bp, Homo sapiens
aaatgcaagttaagt

SEQ ID NO: 16232 - DNA, 15 bp, Homo sapiens
aaaatgcaagttaag

SEQ ID NO: 16233 - DNA, 15 bp, Homo sapiens
gaaaatgcaagttaa

SEQ ID NO: 16234 - DNA, 15 bp, Homo sapiens
agaaaatgcaagtta

SEQ ID NO: 16235 - DNA, 15 bp, Homo sapiens
aagaaaatgcaagtt

SEQ ID NO: 16236 - DNA, 15 bp, Homo sapiens
aaagaaaatgcaagt

SEQ ID NO: 16237 - DNA, 15 bp, Homo sapiens
aaaagaaaatgcaag

SEQ ID NO: 16238 - DNA, 15 bp, Homo sapiens
aaaaagaaaatgcaa

SEQ ID NO: 16239 - DNA, 15 bp, Homo sapiens
aaaaaagaaaatgca

SEQ ID NO: 16240 - DNA, 15 bp, Homo sapiens
caaaaaagaaaatgc

SEQ ID NO: 16241 - DNA, 15 bp, Homo sapiens
acaaaaaagaaaatg

SEQ ID NO: 16242 - DNA, 15 bp, Homo sapiens
aacaaaaaagaaaat

SEQ ID NO: 16243 - DNA, 15 bp, Homo sapiens
aaacaaaaaagaaaa

SEQ ID NO: 16244 - DNA, 15 bp, Homo sapiens
aaaacaaaaaagaaa

SEQ ID NO: 16245 - DNA, 15 bp, Homo sapiens
aaaaacaaaaaagaa

SEQ ID NO: 16246 - DNA, 15 bp, Homo sapiens
acaaaaacaaaaaag

SEQ ID NO: 16247 - DNA, 15 bp, Homo sapiens
aacaaaaacaaaaaa

SEQ ID NO: 16248 - DNA, 15 bp, Homo sapiens
aaaaacaaaaacaaa

SEQ ID NO: 16249 - DNA, 15 bp, Homo sapiens
caaaaacaaaaacaa

SEQ ID NO: 16250 - DNA, 15 bp, Homo sapiens
caaaacaaaaacaaa

SEQ ID NO: 16251 - DNA, 15 bp, Homo sapiens
tcaaaacaaaaacaa

SEQ ID NO: 16252 - DNA, 15 bp, Homo sapiens
ctcaaaacaaaaaca

SEQ ID NO: 16253 - DNA, 15 bp, Homo sapiens
tctcaaaacaaaaac

SEQ ID NO: 16254 - DNA, 15 bp, Homo sapiens
gtctcaaaacaaaaa

SEQ ID NO: 16255 - DNA, 15 bp, Homo sapiens
tgtctcaaaacaaaa

SEQ ID NO: 16256 - DNA, 15 bp, Homo sapiens
ctgtctcaaaacaaa

SEQ ID NO: 16257 - DNA, 15 bp, Homo sapiens
cctgtctcaaaacaa

SEQ ID NO: 16258 - DNA, 15 bp, Homo sapiens
gcctgtctcaaaaca

SEQ ID NO: 16259 - DNA, 15 bp, Homo sapiens
agcctgtctcaaaac

SEQ ID NO: 16260 - DNA, 15 bp, Homo sapiens
gagcctgtctcaaaa

SEQ ID NO: 16261 - DNA, 15 bp, Homo sapiens
agagcctgtctcaaa

SEQ ID NO: 16262 - DNA, 15 bp, Homo sapiens
aagagcctgtctcaa

SEQ ID NO: 16263 - DNA, 15 bp, Homo sapiens
caagagcctgtctca

SEQ ID NO: 16264 - DNA, 15 bp, Homo sapiens
gcaagagcctgtctc

SEQ ID NO: 16265 - DNA, 15 bp, Homo sapiens
agcaagagcctgtct

SEQ ID NO: 16266 - DNA, 15 bp, Homo sapiens
gagcaagagcctgtc

SEQ ID NO: 16267 - DNA, 15 bp, Homo sapiens
agagcaagagcctgt

SEQ ID NO: 16268 - DNA, 15 bp, Homo sapiens
cagagcaagagcctg

SEQ ID NO: 16269 - DNA, 15 bp, Homo sapiens
acagagcaagagcct

SEQ ID NO: 16270 - DNA, 15 bp, Homo sapiens
aacagagcaagagcc

SEQ ID NO: 16271 - DNA, 15 bp, Homo sapiens
caacagagcaagagc

SEQ ID NO: 16272 - DNA, 15 bp, Homo sapiens
gcaacagagcaagag

SEQ ID NO: 16273 - DNA, 15 bp, Homo sapiens
agcaacagagcaaga

SEQ ID NO: 16274 - DNA, 15 bp, Homo sapiens
gagcaacagagcaag

SEQ ID NO: 16275 - DNA, 15 bp, Homo sapiens
tgagcaacagagcaa

SEQ ID NO: 16276 - DNA, 15 bp, Homo sapiens
ctgagcaacagagca

SEQ ID NO: 16277 - DNA, 15 bp, Homo sapiens
cctgagcaacagagc

SEQ ID NO: 16278 - DNA, 15 bp, Homo sapiens
gcctgagcaacagag

SEQ ID NO: 16279 - DNA, 15 bp, Homo sapiens
agcctgagcaacaga

SEQ ID NO: 16280 - DNA, 15 bp, Homo sapiens
cagcctgagcaacag

SEQ ID NO: 16281 - DNA, 15 bp, Homo sapiens
tccagcctgagcaac

SEQ ID NO: 16282 - DNA, 15 bp, Homo sapiens
ctccagcctgagcaa

SEQ ID NO: 16283 - DNA, 15 bp, Homo sapiens
actccagcctgagca

SEQ ID NO: 16284 - DNA, 15 bp, Homo sapiens
cactccagcctgagc

SEQ ID NO: 16285 - DNA, 15 bp, Homo sapiens
gcactccagcctgag

SEQ ID NO: 16286 - DNA, 15 bp, Homo sapiens
tgcactccagcctga

SEQ ID NO: 16287 - DNA, 15 bp, Homo sapiens
tcactgcactccagc

SEQ ID NO: 16288 - DNA, 15 bp, Homo sapiens
atcactgcactccag

SEQ ID NO: 16289 - DNA, 15 bp, Homo sapiens
catcactgcactcca

SEQ ID NO: 16290 - DNA, 15 bp, Homo sapiens
acatcactgcactcc

SEQ ID NO: 16291 - DNA, 15 bp, Homo sapiens
gacatcactgcactc

SEQ ID NO: 16292 - DNA, 15 bp, Homo sapiens
tgacatcactgcact

SEQ ID NO: 16293 - DNA, 15 bp, Homo sapiens
gtgacatcactgcac

SEQ ID NO: 16294 - DNA, 15 bp, Homo sapiens
tgtgacatcactgca

SEQ ID NO: 16295 - DNA, 15 bp, Homo sapiens
ctgtgacatcactgc

SEQ ID NO: 16296 - DNA, 15 bp, Homo sapiens
gctgtgacatcactg

SEQ ID NO: 16297 - DNA, 15 bp, Homo sapiens
agctgtgacatcact

SEQ ID NO: 16298 - DNA, 15 bp, Homo sapiens
gagctgtgacatcac

SEQ ID NO: 16299 - DNA, 15 bp, Homo sapiens
tgagctgtgacatca

SEQ ID NO: 16300 - DNA, 15 bp, Homo sapiens
gtgagctgtgacatc

SEQ ID NO: 16301 - DNA, 15 bp, Homo sapiens
agtgagctgtgacat

SEQ ID NO: 16302 - DNA, 15 bp, Homo sapiens
tagtgagctgtgaca

SEQ ID NO: 16303 - DNA, 15 bp, Homo sapiens
gtagtgagctgtgac

SEQ ID NO: 16304 - DNA, 15 bp, Homo sapiens
ggctgtagtgagctg

SEQ ID NO: 16305 - DNA, 15 bp, Homo sapiens
aggctgtagtgagct

SEQ ID NO: 16306 - DNA, 15 bp, Homo sapiens
gaggctgtagtgagc

SEQ ID NO: 16307 - DNA, 15 bp, Homo sapiens
ggaggctgtagtgag

SEQ ID NO: 16308 - DNA, 15 bp, Homo sapiens
tggaggctgtagtga

SEQ ID NO: 16309 - DNA, 15 bp, Homo sapiens
gtggaggctgtagtg

SEQ ID NO: 16310 - DNA, 15 bp, Homo sapiens
ggtggaggctgtagt

SEQ ID NO: 16311 - DNA, 15 bp, Homo sapiens
aggtggaggctgtag

SEQ ID NO: 16312 - DNA, 15 bp, Homo sapiens
gaggtggaggctgta

SEQ ID NO: 16313 - DNA, 15 bp, Homo sapiens
ggaggtggaggctgt

SEQ ID NO: 16314 - DNA, 15 bp, Homo sapiens
tggaggtggaggctg

SEQ ID NO: 16315 - DNA, 15 bp, Homo sapiens
ctggaggtggaggct

SEQ ID NO: 16316 - DNA, 15 bp, Homo sapiens
actggaggtggaggc

SEQ ID NO: 16317 - DNA, 15 bp, Homo sapiens
aactggaggtggagg

SEQ ID NO: 16318 - DNA, 15 bp, Homo sapiens
aaactggaggtggag

SEQ ID NO: 16319 - DNA, 15 bp, Homo sapiens
gaaactggaggtgga

SEQ ID NO: 16320 - DNA, 15 bp, Homo sapiens
tgaaactggaggtgg

SEQ ID NO: 16321 - DNA, 15 bp, Homo sapiens
ttgaaactggaggtg

SEQ ID NO: 16322 - DNA, 15 bp, Homo sapiens
cttgaaactggaggt

SEQ ID NO: 16323 - DNA, 15 bp, Homo sapiens
acttgaaactggagg

SEQ ID NO: 16324 - DNA, 15 bp, Homo sapiens
tacttgaaactggag

SEQ ID NO: 16325 - DNA, 15 bp, Homo sapiens
atacttgaaactgga

SEQ ID NO: 16326 - DNA, 15 bp, Homo sapiens
aatacttgaaactgg

SEQ ID NO: 16327 - DNA, 15 bp, Homo sapiens
gaatacttgaaactg

SEQ ID NO: 16328 - DNA, 15 bp, Homo sapiens
ggaatacttgaaact

SEQ ID NO: 16329 - DNA, 15 bp, Homo sapiens
tggaatacttgaaac

SEQ ID NO: 16330 - DNA, 15 bp, Homo sapiens
gtggaatacttgaaa

SEQ ID NO: 16331 - DNA, 15 bp, Homo sapiens
ggtggaatacttgaa

SEQ ID NO: 16332 - DNA, 15 bp, Homo sapiens
aggtggaatacttga

SEQ ID NO: 16333 - DNA, 15 bp, Homo sapiens
taggtggaatacttg

SEQ ID NO: 16334 - DNA, 15 bp, Homo sapiens
gtaggtggaatactt

SEQ ID NO: 16335 - DNA, 15 bp, Homo sapiens
ggtaggtggaatact

SEQ ID NO: 16336 - DNA, 15 bp, Homo sapiens
aggtaggtggaatac

SEQ ID NO: 16337 - DNA, 15 bp, Homo sapiens
gaggtaggtggaata

SEQ ID NO: 16338 - DNA, 15 bp, Homo sapiens
tgaggtaggtggaat

SEQ ID NO: 16339 - DNA, 15 bp, Homo sapiens
ctgaggtaggtggaa

SEQ ID NO: 16340 - DNA, 15 bp, Homo sapiens
gctgaggtaggtgga

SEQ ID NO: 16341 - DNA, 15 bp, Homo sapiens
ggctgaggtaggtgg

SEQ ID NO: 16342 - DNA, 15 bp, Homo sapiens
aggctgaggtaggtg

SEQ ID NO: 16343 - DNA, 15 bp, Homo sapiens
gaggctgaggtaggt

SEQ ID NO: 16344 - DNA, 15 bp, Homo sapiens
ggaggctgaggtagg

SEQ ID NO: 16345 - DNA, 15 bp, Homo sapiens
tggaggctgaggtag

SEQ ID NO: 16346 - DNA, 15 bp, Homo sapiens
ttggaggctgaggta

SEQ ID NO: 16347 - DNA, 15 bp, Homo sapiens
cttggaggctgaggt

SEQ ID NO: 16348 - DNA, 15 bp, Homo sapiens
tcttggaggctgagg

SEQ ID NO: 16349 - DNA, 15 bp, Homo sapiens
atcttggaggctgag

SEQ ID NO: 16350 - DNA, 15 bp, Homo sapiens
tatcttggaggctga

SEQ ID NO: 16351 - DNA, 15 bp, Homo sapiens
ctatcttggaggctg

SEQ ID NO: 16352 - DNA, 15 bp, Homo sapiens
gctatcttggaggct

SEQ ID NO: 16353 - DNA, 15 bp, Homo sapiens
agctatcttggaggc

SEQ ID NO: 16354 - DNA, 15 bp, Homo sapiens
tagctatcttggagg

SEQ ID NO: 16355 - DNA, 15 bp, Homo sapiens
ttagctatcttggag

SEQ ID NO: 16356 - DNA, 15 bp, Homo sapiens
cttagctatcttgga

SEQ ID NO: 16357 - DNA, 15 bp, Homo sapiens
tcttagctatcttgg

SEQ ID NO: 16358 - DNA, 15 bp, Homo sapiens
gtcttagctatcttg

SEQ ID NO: 16359 - DNA, 15 bp, Homo sapiens
agtcttagctatctt

SEQ ID NO: 16360 - DNA, 15 bp, Homo sapiens
tagtcttagctatct

SEQ ID NO: 16361 - DNA, 15 bp, Homo sapiens
gtagtcttagctatc

SEQ ID NO: 16362 - DNA, 15 bp, Homo sapiens
tgtagtcttagctat

SEQ ID NO: 16363 - DNA, 15 bp, Homo sapiens
ctgtagtcttagcta

SEQ ID NO: 16364 - DNA, 15 bp, Homo sapiens
cctgtagtcttagct

SEQ ID NO: 16365 - DNA, 15 bp, Homo sapiens
gcctgtagtcttagc

SEQ ID NO: 16366 - DNA, 15 bp, Homo sapiens
tgcctgtagtcttag

SEQ ID NO: 16367 - DNA, 15 bp, Homo sapiens
gtgcctgtagtctta

SEQ ID NO: 16368 - DNA, 15 bp, Homo sapiens
tgtgcctgtagtctt

SEQ ID NO: 16369 - DNA, 15 bp, Homo sapiens
atgtgcctgtagtct

SEQ ID NO: 16370 - DNA, 15 bp, Homo sapiens
catgtgcctgtagtc

SEQ ID NO: 16371 - DNA, 15 bp, Homo sapiens
acatgtgcctgtagt

SEQ ID NO: 16372 - DNA, 15 bp, Homo sapiens
gacatgtgcctgtag

SEQ ID NO: 16373 - DNA, 15 bp, Homo sapiens
tgacatgtgcctgta

SEQ ID NO: 16374 - DNA, 15 bp, Homo sapiens
gtgacatgtgcctgt

SEQ ID NO: 16375 - DNA, 15 bp, Homo sapiens
cgtgacatgtgcctg

SEQ ID NO: 16376 - DNA, 15 bp, Homo sapiens
tcgtgacatgtgcct

SEQ ID NO: 16377 - DNA, 15 bp, Homo sapiens
gtcgtgacatgtgcc

SEQ ID NO: 16378 - DNA, 15 bp, Homo sapiens
cgtcgtgacatgtgc

SEQ ID NO: 16379 - DNA, 15 bp, Homo sapiens
gcgtcgtgacatgtg

SEQ ID NO: 16380 - DNA, 15 bp, Homo sapiens
ggcgtcgtgacatgt

SEQ ID NO: 16381 - DNA, 15 bp, Homo sapiens
aggcgtcgtgacatg

SEQ ID NO: 16382 - DNA, 15 bp, Homo sapiens
caggcgtcgtgacat

SEQ ID NO: 16383 - DNA, 15 bp, Homo sapiens
ccaggcgtcgtgaca

SEQ ID NO: 16384 - DNA, 15 bp, Homo sapiens
gccaggcgtcgtgac

SEQ ID NO: 16385 - DNA, 15 bp, Homo sapiens
agccaggcgtcgtga

SEQ ID NO: 16386 - DNA, 15 bp, Homo sapiens
tagccaggcgtcgtg

SEQ ID NO: 16387 - DNA, 15 bp, Homo sapiens
ttagccaggcgtcgt

SEQ ID NO: 16388 - DNA, 15 bp, Homo sapiens
attagccaggcgtcg

SEQ ID NO: 16389 - DNA, 15 bp, Homo sapiens
aattagccaggcgtc

SEQ ID NO: 16390 - DNA, 15 bp, Homo sapiens
taaaaattagccagg

SEQ ID NO: 16391 - DNA, 15 bp, Homo sapiens
ttaaaaattagccag

SEQ ID NO: 16392 - DNA, 15 bp, Homo sapiens
tttaaaaattagcca

SEQ ID NO: 16393 - DNA, 15 bp, Homo sapiens
ttttaaaaattagcc

SEQ ID NO: 16394 - DNA, 15 bp, Homo sapiens
attttaaaaattagc

SEQ ID NO: 16395 - DNA, 15 bp, Homo sapiens
tattttaaaaattag

SEQ ID NO: 16396 - DNA, 15 bp, Homo sapiens
atattttaaaaatta

SEQ ID NO: 16397 - DNA, 15 bp, Homo sapiens
aatattttaaaaatt

SEQ ID NO: 16398 - DNA, 15 bp, Homo sapiens
aaatattttaaaaat

SEQ ID NO: 16399 - DNA, 15 bp, Homo sapiens
aaaatattttaaaaa

SEQ ID NO: 16400 - DNA, 15 bp, Homo sapiens
aaaaatattttaaaa

SEQ ID NO: 16401 - DNA, 15 bp, Homo sapiens
aaaaaatattttaaa

SEQ ID NO: 16402 - DNA, 15 bp, Homo sapiens
caaaaaatattttaa

SEQ ID NO: 16403 - DNA, 15 bp, Homo sapiens
gcaaaaaatatttta

SEQ ID NO: 16404 - DNA, 15 bp, Homo sapiens
tgcaaaaaatatttt

SEQ ID NO: 16405 - DNA, 15 bp, Homo sapiens
ctgcaaaaaatattt

SEQ ID NO: 16406 - DNA, 15 bp, Homo sapiens
tctgcaaaaaatatt

SEQ ID NO: 16407 - DNA, 15 bp, Homo sapiens
ttctgcaaaaaatat

SEQ ID NO: 16408 - DNA, 15 bp, Homo sapiens
tttctgcaaaaaata

SEQ ID NO: 16409 - DNA, 15 bp, Homo sapiens
atttctgcaaaaaat

SEQ ID NO: 16410 - DNA, 15 bp, Homo sapiens
catttctgcaaaaaa

SEQ ID NO: 16411 - DNA, 15 bp, Homo sapiens
ccatttctgcaaaaa

SEQ ID NO: 16412 - DNA, 15 bp, Homo sapiens
cccatttctgcaaaa

SEQ ID NO: 16413 - DNA, 15 bp, Homo sapiens
tcccatttctgcaaa

SEQ ID NO: 16414 - DNA, 15 bp, Homo sapiens
atcccatttctgcaa

SEQ ID NO: 16415 - DNA, 15 bp, Homo sapiens
aatcccatttctgca

SEQ ID NO: 16416 - DNA, 15 bp, Homo sapiens
aaatcccatttctgc

SEQ ID NO: 16417 - DNA, 15 bp, Homo sapiens
gaaatcccatttctg

SEQ ID NO: 16418 - DNA, 15 bp, Homo sapiens
tgaaatcccatttct

SEQ ID NO: 16419 - DNA, 15 bp, Homo sapiens
gtgaaatcccatttc

SEQ ID NO: 16420 - DNA, 15 bp, Homo sapiens
agtgaaatcccattt

SEQ ID NO: 16421 - DNA, 15 bp, Homo sapiens
tagtgaaatcccatt

SEQ ID NO: 16422 - DNA, 15 bp, Homo sapiens
atagtgaaatcccat

SEQ ID NO: 16423 - DNA, 15 bp, Homo sapiens
catagtgaaatccca

SEQ ID NO: 16424 - DNA, 15 bp, Homo sapiens
acatagtgaaatccc

SEQ ID NO: 16425 - DNA, 15 bp, Homo sapiens
aacatagtgaaatcc

SEQ ID NO: 16426 - DNA, 15 bp, Homo sapiens
caacatagtgaaatc

SEQ ID NO: 16427 - DNA, 15 bp, Homo sapiens
gcaacatagtgaaat

SEQ ID NO: 16428 - DNA, 15 bp, Homo sapiens
ggcaacatagtgaaa

SEQ ID NO: 16429 - DNA, 15 bp, Homo sapiens
gggcaacatagtgaa

SEQ ID NO: 16430 - DNA, 15 bp, Homo sapiens
tgggcaacatagtga

SEQ ID NO: 16431 - DNA, 15 bp, Homo sapiens
ctgggcaacatagtg

SEQ ID NO: 16432 - DNA, 15 bp, Homo sapiens
cctgggcaacatagt

SEQ ID NO: 16433 - DNA, 15 bp, Homo sapiens
cagcctgggcaacat

SEQ ID NO: 16434 - DNA, 15 bp, Homo sapiens
gccagcctgggcaac

SEQ ID NO: 16435 - DNA, 15 bp, Homo sapiens
ggccagcctgggcaa

SEQ ID NO: 16436 - DNA, 15 bp, Homo sapiens
aggccagcctgggca

SEQ ID NO: 16437 - DNA, 15 bp, Homo sapiens
gaggccagcctgggc

SEQ ID NO: 16438 - DNA, 15 bp, Homo sapiens
tgaggccagcctggg

SEQ ID NO: 16439 - DNA, 15 bp, Homo sapiens
ttgaggccagcctgg

SEQ ID NO: 16440 - DNA, 15 bp, Homo sapiens
tttgaggccagcctg

SEQ ID NO: 16441 - DNA, 15 bp, Homo sapiens
gtttgaggccagcct

SEQ ID NO: 16442 - DNA, 15 bp, Homo sapiens
agtttgaggccagcc

SEQ ID NO: 16443 - DNA, 15 bp, Homo sapiens
cagtttgaggccagc

SEQ ID NO: 16444 - DNA, 15 bp, Homo sapiens
gcagtttgaggccag

SEQ ID NO: 16445 - DNA, 15 bp, Homo sapiens
agcagtttgaggcca

SEQ ID NO: 16446 - DNA, 15 bp, Homo sapiens
cagcagtttgaggcc

SEQ ID NO: 16447 - DNA, 15 bp, Homo sapiens
ccagcagtttgaggc

SEQ ID NO: 16448 - DNA, 15 bp, Homo sapiens
gccagcagtttgagg

SEQ ID NO: 16449 - DNA, 15 bp, Homo sapiens
ggccagcagtttgag

SEQ ID NO: 16450 - DNA, 15 bp, Homo sapiens
aggccagcagtttga

SEQ ID NO: 16451 - DNA, 15 bp, Homo sapiens
gaggccagcagtttg

SEQ ID NO: 16452 - DNA, 15 bp, Homo sapiens
tgaggccagcagttt

SEQ ID NO: 16453 - DNA, 15 bp, Homo sapiens
ttgaggccagcagtt

SEQ ID NO: 16454 - DNA, 15 bp, Homo sapiens
cttgaggccagcagt

SEQ ID NO: 16455 - DNA, 15 bp, Homo sapiens
acttgaggccagcag

SEQ ID NO: 16456 - DNA, 15 bp, Homo sapiens
cacttgaggccagca

SEQ ID NO: 16457 - DNA, 15 bp, Homo sapiens
tcacttgaggccagc

SEQ ID NO: 16458 - DNA, 15 bp, Homo sapiens
aagatcacttgaggc

SEQ ID NO: 16459 - DNA, 15 bp, Homo sapiens
gaagatcacttgagg

SEQ ID NO: 16460 - DNA, 15 bp, Homo sapiens
aggaagatcacttga

SEQ ID NO: 16461 - DNA, 15 bp, Homo sapiens
caggaagatcacttg

SEQ ID NO: 16462 - DNA, 15 bp, Homo sapiens
gcaggaagatcactt

SEQ ID NO: 16463 - DNA, 15 bp, Homo sapiens
ggcaggaagatcact

SEQ ID NO: 16464 - DNA, 15 bp, Homo sapiens
aggcaggaagatcac

SEQ ID NO: 16465 - DNA, 15 bp, Homo sapiens
aaggcaggaagatca

SEQ ID NO: 16466 - DNA, 15 bp, Homo sapiens
caaggcaggaagatc

SEQ ID NO: 16467 - DNA, 15 bp, Homo sapiens
ccaaggcaggaagat

SEQ ID NO: 16468 - DNA, 15 bp, Homo sapiens
gccaaggcaggaaga

SEQ ID NO: 16469 - DNA, 15 bp, Homo sapiens
ggccaaggcaggaag

SEQ ID NO: 16470 - DNA, 15 bp, Homo sapiens
aggccaaggcaggaa

SEQ ID NO: 16471 - DNA, 15 bp, Homo sapiens
actgtaatcccagca

SEQ ID NO: 16472 - DNA, 15 bp, Homo sapiens
gactgtaatcccagc

SEQ ID NO: 16473 - DNA, 15 bp, Homo sapiens
cgactgtaatcccag

SEQ ID NO: 16474 - DNA, 15 bp, Homo sapiens
acgactgtaatccca

SEQ ID NO: 16475 - DNA, 15 bp, Homo sapiens
cacgactgtaatccc

SEQ ID NO: 16476 - DNA, 15 bp, Homo sapiens
tcacgactgtaatcc

SEQ ID NO: 16477 - DNA, 15 bp, Homo sapiens
ctcacgactgtaatc

SEQ ID NO: 16478 - DNA, 15 bp, Homo sapiens
gctcacgactgtaat

SEQ ID NO: 16479 - DNA, 15 bp, Homo sapiens
ggctcacgactgtaa

SEQ ID NO: 16480 - DNA, 15 bp, Homo sapiens
tggctcacgactgta

SEQ ID NO: 16481 - DNA, 15 bp, Homo sapiens
gtggctcacgactgt

SEQ ID NO: 16482 - DNA, 15 bp, Homo sapiens
agtggctcacgactg

SEQ ID NO: 16483 - DNA, 15 bp, Homo sapiens
cagtggctcacgact

SEQ ID NO: 16484 - DNA, 15 bp, Homo sapiens
acagtggctcacgac

SEQ ID NO: 16485 - DNA, 15 bp, Homo sapiens
cacagtggctcacga

SEQ ID NO: 16486 - DNA, 15 bp, Homo sapiens
gcacagtggctcacg

SEQ ID NO: 16487 - DNA, 15 bp, Homo sapiens
ggcacagtggctcac

SEQ ID NO: 16488 - DNA, 15 bp, Homo sapiens
tgggcacagtggctc

SEQ ID NO: 16489 - DNA, 15 bp, Homo sapiens
ctgggcacagtggct

SEQ ID NO: 16490 - DNA, 15 bp, Homo sapiens
gctgggcacagtggc

SEQ ID NO: 16491 - DNA, 15 bp, Homo sapiens
ggctgggcacagtgg

SEQ ID NO: 16492 - DNA, 15 bp, Homo sapiens
aggctgggcacagtg

SEQ ID NO: 16493 - DNA, 15 bp, Homo sapiens
caggctgggcacagt

SEQ ID NO: 16494 - DNA, 15 bp, Homo sapiens
gcaggctgggcacag

SEQ ID NO: 16495 - DNA, 15 bp, Homo sapiens
tgcaggctgggcaca

SEQ ID NO: 16496 - DNA, 15 bp, Homo sapiens
atgcaggctgggcac

SEQ ID NO: 16497 - DNA, 15 bp, Homo sapiens
aatgcaggctgggca

SEQ ID NO: 16498 - DNA, 15 bp, Homo sapiens
aaatgcaggctgggc

SEQ ID NO: 16499 - DNA, 15 bp, Homo sapiens
aaaatgcaggctggg

SEQ ID NO: 16500 - DNA, 15 bp, Homo sapiens
gaaaatgcaggctgg

SEQ ID NO: 16501 - DNA, 15 bp, Homo sapiens
agaaaatgcaggctg

SEQ ID NO: 16502 - DNA, 15 bp, Homo sapiens
aagaaaatgcaggct

SEQ ID NO: 16503 - DNA, 15 bp, Homo sapiens
taagaaaatgcaggc

SEQ ID NO: 16504 - DNA, 15 bp, Homo sapiens
ataagaaaatgcagg

SEQ ID NO: 16505 - DNA, 15 bp, Homo sapiens
aataagaaaatgcag

SEQ ID NO: 16506 - DNA, 15 bp, Homo sapiens
taataagaaaatgca

SEQ ID NO: 16507 - DNA, 15 bp, Homo sapiens
ataataagaaaatgc

SEQ ID NO: 16508 - DNA, 15 bp, Homo sapiens
tataataagaaaatg

SEQ ID NO: 16509 - DNA, 15 bp, Homo sapiens
ttataataagaaaat

SEQ ID NO: 16510 - DNA, 15 bp, Homo sapiens
tttataataagaaaa

SEQ ID NO: 16511 - DNA, 15 bp, Homo sapiens
ttttataataagaaa

SEQ ID NO: 16512 - DNA, 15 bp, Homo sapiens
cttttataataagaa

SEQ ID NO: 16513 - DNA, 15 bp, Homo sapiens
acttttataataaga

SEQ ID NO: 16514 - DNA, 15 bp, Homo sapiens
tacttttataataag

SEQ ID NO: 16515 - DNA, 15 bp, Homo sapiens
ttacttttataataa

SEQ ID NO: 16516 - DNA, 15 bp, Homo sapiens
attacttttataata

SEQ ID NO: 16517 - DNA, 15 bp, Homo sapiens
tattacttttataat

SEQ ID NO: 16518 - DNA, 15 bp, Homo sapiens
gtattacttttataa

SEQ ID NO: 16519 - DNA, 15 bp, Homo sapiens
tgtattacttttata

SEQ ID NO: 16520 - DNA, 15 bp, Homo sapiens
atgtattacttttat

SEQ ID NO: 16521 - DNA, 15 bp, Homo sapiens
catgtattactttta

SEQ ID NO: 16522 - DNA, 15 bp, Homo sapiens
acatgtattactttt

SEQ ID NO: 16523 - DNA, 15 bp, Homo sapiens
aacatgtattacttt

SEQ ID NO: 16524 - DNA, 15 bp, Homo sapiens
gaacatgtattactt

SEQ ID NO: 16525 - DNA, 15 bp, Homo sapiens
tgaacatgtattact

SEQ ID NO: 16526 - DNA, 15 bp, Homo sapiens
ttgaacatgtattac

SEQ ID NO: 16527 - DNA, 15 bp, Homo sapiens
attgaacatgtatta

SEQ ID NO: 16528 - DNA, 15 bp, Homo sapiens
cattgaacatgtatt

SEQ ID NO: 16529 - DNA, 15 bp, Homo sapiens
ccattgaacatgtat

SEQ ID NO: 16530 - DNA, 15 bp, Homo sapiens
tccattgaacatgta

SEQ ID NO: 16531 - DNA, 15 bp, Homo sapiens
gtccattgaacatgt

SEQ ID NO: 16532 - DNA, 15 bp, Homo sapiens
tgtccattgaacatg

SEQ ID NO: 16533 - DNA, 15 bp, Homo sapiens
ttgtccattgaacat

SEQ ID NO: 16534 - DNA, 15 bp, Homo sapiens
tttgtccattgaaca

SEQ ID NO: 16535 - DNA, 15 bp, Homo sapiens
ttttgtccattgaac

SEQ ID NO: 16536 - DNA, 15 bp, Homo sapiens
tttttgtccattgaa

SEQ ID NO: 16537 - DNA, 15 bp, Homo sapiens
ttttttgtccattga

SEQ ID NO: 16538 - DNA, 15 bp, Homo sapiens
attttttgtccattg

SEQ ID NO: 16539 - DNA, 15 bp, Homo sapiens
aattttttgtccatt

SEQ ID NO: 16540 - DNA, 15 bp, Homo sapiens
aaattttttgtccat

SEQ ID NO: 16541 - DNA, 15 bp, Homo sapiens
aaaattttttgtcca

SEQ ID NO: 16542 - DNA, 15 bp, Homo sapiens
gaaaattttttgtcc

SEQ ID NO: 16543 - DNA, 15 bp, Homo sapiens
tgaaaattttttgtc

SEQ ID NO: 16544 - DNA, 15 bp, Homo sapiens
ctgaaaattttttgt

SEQ ID NO: 16545 - DNA, 15 bp, Homo sapiens
tctgaaaattttttg

SEQ ID NO: 16546 - DNA, 15 bp, Homo sapiens
ttctgaaaatttttt

SEQ ID NO: 16547 - DNA, 15 bp, Homo sapiens
tttctgaaaattttt

SEQ ID NO: 16548 - DNA, 15 bp, Homo sapiens
ttttctgaaaatttt

SEQ ID NO: 16549 - DNA, 15 bp, Homo sapiens
attttctgaaaattt

SEQ ID NO: 16550 - DNA, 15 bp, Homo sapiens
tattttctgaaaatt

SEQ ID NO: 16551 - DNA, 15 bp, Homo sapiens
atattttctgaaaat

SEQ ID NO: 16552 - DNA, 15 bp, Homo sapiens
catattttctgaaaa

SEQ ID NO: 16553 - DNA, 15 bp, Homo sapiens
gcatattttctgaaa

SEQ ID NO: 16554 - DNA, 15 bp, Homo sapiens
tgcatattttctgaa

SEQ ID NO: 16555 - DNA, 15 bp, Homo sapiens
ttgcatattttctga

SEQ ID NO: 16556 - DNA, 15 bp, Homo sapiens
tttgcatattttctg

SEQ ID NO: 16557 - DNA, 15 bp, Homo sapiens
ctttgcatattttct

SEQ ID NO: 16558 - DNA, 15 bp, Homo sapiens
tctttgcatattttc

SEQ ID NO: 16559 - DNA, 15 bp, Homo sapiens
atctttgcatatttt

SEQ ID NO: 16560 - DNA, 15 bp, Homo sapiens
catctttgcatattt

SEQ ID NO: 16561 - DNA, 15 bp, Homo sapiens
tcatctttgcatatt

SEQ ID NO: 16562 - DNA, 15 bp, Homo sapiens
ttcatctttgcatat

SEQ ID NO: 16563 - DNA, 15 bp, Homo sapiens
tttcatctttgcata

SEQ ID NO: 16564 - DNA, 15 bp, Homo sapiens
ttttcatctttgcat

SEQ ID NO: 16565 - DNA, 15 bp, Homo sapiens
cttttcatctttgca

SEQ ID NO: 16566 - DNA, 15 bp, Homo sapiens
acttttcatctttgc

SEQ ID NO: 16567 - DNA, 15 bp, Homo sapiens
tacttttcatctttg

SEQ ID NO: 16568 - DNA, 15 bp, Homo sapiens
ttacttttcatcttt

SEQ ID NO: 16569 - DNA, 15 bp, Homo sapiens
tttacttttcatctt

SEQ ID NO: 16570 - DNA, 15 bp, Homo sapiens
ttttacttttcatct

SEQ ID NO: 16571 - DNA, 15 bp, Homo sapiens
tttttacttttcatc

SEQ ID NO: 16572 - DNA, 15 bp, Homo sapiens
atttttacttttcat

SEQ ID NO: 16573 - DNA, 15 bp, Homo sapiens
aatttttacttttca

SEQ ID NO: 16574 - DNA, 15 bp, Homo sapiens
caatttttacttttc

SEQ ID NO: 16575 - DNA, 15 bp, Homo sapiens
acaatttttactttt

SEQ ID NO: 16576 - DNA, 15 bp, Homo sapiens
gacaatttttacttt

SEQ ID NO: 16577 - DNA, 15 bp, Homo sapiens
ggacaatttttactt

SEQ ID NO: 16578 - DNA, 15 bp, Homo sapiens
tggacaatttttact

SEQ ID NO: 16579 - DNA, 15 bp, Homo sapiens
atggacaatttttac

SEQ ID NO: 16580 - DNA, 15 bp, Homo sapiens
tatggacaattttta

SEQ ID NO: 16581 - DNA, 15 bp, Homo sapiens
ttatggacaattttt

SEQ ID NO: 16582 - DNA, 15 bp, Homo sapiens
tttatggacaatttt

SEQ ID NO: 16583 - DNA, 15 bp, Homo sapiens
atttatggacaattt

SEQ ID NO: 16584 - DNA, 15 bp, Homo sapiens
gatttatggacaatt

SEQ ID NO: 16585 - DNA, 15 bp, Homo sapiens
agatttatggacaat

SEQ ID NO: 16586 - DNA, 15 bp, Homo sapiens
cagatttatggacaa

SEQ ID NO: 16587 - DNA, 15 bp, Homo sapiens
acagatttatggaca

SEQ ID NO: 16588 - DNA, 15 bp, Homo sapiens
gacagatttatggac

SEQ ID NO: 16589 - DNA, 15 bp, Homo sapiens
tgacagatttatgga

SEQ ID NO: 16590 - DNA, 15 bp, Homo sapiens
atgacagatttatgg

SEQ ID NO: 16591 - DNA, 15 bp, Homo sapiens
gatgacagatttatg

SEQ ID NO: 16592 - DNA, 15 bp, Homo sapiens
agatgacagatttat

SEQ ID NO: 16593 - DNA, 15 bp, Homo sapiens
tagatgacagattta

SEQ ID NO: 16594 - DNA, 15 bp, Homo sapiens
gtagatgacagattt

SEQ ID NO: 16595 - DNA, 15 bp, Homo sapiens
tgtagatgacagatt

SEQ ID NO: 16596 - DNA, 15 bp, Homo sapiens
ctgtagatgacagat

SEQ ID NO: 16597 - DNA, 15 bp, Homo sapiens
tctgtagatgacaga

SEQ ID NO: 16598 - DNA, 15 bp, Homo sapiens
atctgtagatgacag

SEQ ID NO: 16599 - DNA, 15 bp, Homo sapiens
tatctgtagatgaca

SEQ ID NO: 16600 - DNA, 15 bp, Homo sapiens
ttatctgtagatgac

SEQ ID NO: 16601 - DNA, 15 bp, Homo sapiens
tttatctgtagatga

SEQ ID NO: 16602 - DNA, 15 bp, Homo sapiens
ctttatctgtagatg

SEQ ID NO: 16603 - DNA, 15 bp, Homo sapiens
tctttatctgtagat

SEQ ID NO: 16604 - DNA, 15 bp, Homo sapiens
atctttatctgtaga

SEQ ID NO: 16605 - DNA, 15 bp, Homo sapiens
tatctttatctgtag

SEQ ID NO: 16606 - DNA, 15 bp, Homo sapiens
ttatctttatctgta

SEQ ID NO: 16607 - DNA, 15 bp, Homo sapiens
gttatctttatctgt

SEQ ID NO: 16608 - DNA, 15 bp, Homo sapiens
agttatctttatctg

SEQ ID NO: 16609 - DNA, 15 bp, Homo sapiens
aagttatctttatct

SEQ ID NO: 16610 - DNA, 15 bp, Homo sapiens
gaagttatctttatc

SEQ ID NO: 16611 - DNA, 15 bp, Homo sapiens
agaagttatctttat

SEQ ID NO: 16612 - DNA, 15 bp, Homo sapiens
cagaagttatcttta

SEQ ID NO: 16613 - DNA, 15 bp, Homo sapiens
ccagaagttatcttt

SEQ ID NO: 16614 - DNA, 15 bp, Homo sapiens
tccagaagttatctt

SEQ ID NO: 16615 - DNA, 15 bp, Homo sapiens
atccagaagttatct

SEQ ID NO: 16616 - DNA, 15 bp, Homo sapiens
tatccagaagttatc

SEQ ID NO: 16617 - DNA, 15 bp, Homo sapiens
ttatccagaagttat

SEQ ID NO: 16618 - DNA, 15 bp, Homo sapiens
attatccagaagtta

SEQ ID NO: 16619 - DNA, 15 bp, Homo sapiens
cattatccagaagtt

SEQ ID NO: 16620 - DNA, 15 bp, Homo sapiens
acattatccagaagt

SEQ ID NO: 16621 - DNA, 15 bp, Homo sapiens
aacattatccagaag

SEQ ID NO: 16622 - DNA, 15 bp, Homo sapiens
aaacattatccagaa

SEQ ID NO: 16623 - DNA, 15 bp, Homo sapiens
aaaacattatccaga

SEQ ID NO: 16624 - DNA, 15 bp, Homo sapiens
aaaaacattatccag

SEQ ID NO: 16625 - DNA, 15 bp, Homo sapiens
gaaaaacattatcca

SEQ ID NO: 16626 - DNA, 15 bp, Homo sapiens
agaaaaacattatcc

SEQ ID NO: 16627 - DNA, 15 bp, Homo sapiens
tagaaaaacattatc

SEQ ID NO: 16628 - DNA, 15 bp, Homo sapiens
gtagaaaaacattat

SEQ ID NO: 16629 - DNA, 15 bp, Homo sapiens
ggtagaaaaacatta

SEQ ID NO: 16630 - DNA, 15 bp, Homo sapiens
tggtagaaaaacatt

SEQ ID NO: 16631 - DNA, 15 bp, Homo sapiens
atggtagaaaaacat

SEQ ID NO: 16632 - DNA, 15 bp, Homo sapiens
gatggtagaaaaaca

SEQ ID NO: 16633 - DNA, 15 bp, Homo sapiens
tgatggtagaaaaac

SEQ ID NO: 16634 - DNA, 15 bp, Homo sapiens
atgatggtagaaaaa

SEQ ID NO: 16635 - DNA, 15 bp, Homo sapiens
aatgatggtagaaaa

SEQ ID NO: 16636 - DNA, 15 bp, Homo sapiens
aaatgatggtagaaa

SEQ ID NO: 16637 - DNA, 15 bp, Homo sapiens
aaaatgatggtagaa

SEQ ID NO: 16638 - DNA, 15 bp, Homo sapiens
aaaaatgatggtaga

SEQ ID NO: 16639 - DNA, 15 bp, Homo sapiens
taaaaatgatggtag

SEQ ID NO: 16640 - DNA, 15 bp, Homo sapiens
ctaaaaatgatggta

SEQ ID NO: 16641 - DNA, 15 bp, Homo sapiens
actaaaaatgatggt

SEQ ID NO: 16642 - DNA, 15 bp, Homo sapiens
tactaaaaatgatgg

SEQ ID NO: 16643 - DNA, 15 bp, Homo sapiens
ttactaaaaatgatg

SEQ ID NO: 16644 - DNA, 15 bp, Homo sapiens
attactaaaaatgat

SEQ ID NO: 16645 - DNA, 15 bp, Homo sapiens
gattactaaaaatga

SEQ ID NO: 16646 - DNA, 15 bp, Homo sapiens
tgattactaaaaatg

SEQ ID NO: 16647 - DNA, 15 bp, Homo sapiens
gtgattactaaaaat

SEQ ID NO: 16648 - DNA, 15 bp, Homo sapiens
tgtgattactaaaaa

SEQ ID NO: 16649 - DNA, 15 bp, Homo sapiens
atgtgattactaaaa

SEQ ID NO: 16650 - DNA, 15 bp, Homo sapiens
tatgtgattactaaa

SEQ ID NO: 16651 - DNA, 15 bp, Homo sapiens
ttatgtgattactaa

SEQ ID NO: 16652 - DNA, 15 bp, Homo sapiens
gttatgtgattacta

SEQ ID NO: 16653 - DNA, 15 bp, Homo sapiens
tgttatgtgattact

SEQ ID NO: 16654 - DNA, 15 bp, Homo sapiens
atgttatgtgattac

SEQ ID NO: 16655 - DNA, 15 bp, Homo sapiens
aatgttatgtgatta

SEQ ID NO: 16656 - DNA, 15 bp, Homo sapiens
aaatgttatgtgatt

SEQ ID NO: 16657 - DNA, 15 bp, Homo sapiens
gaaatgttatgtgat

SEQ ID NO: 16658 - DNA, 15 bp, Homo sapiens
cgaaatgttatgtga

SEQ ID NO: 16659 - DNA, 15 bp, Homo sapiens
acgaaatgttatgtg

SEQ ID NO: 16660 - DNA, 15 bp, Homo sapiens
aacgaaatgttatgt

SEQ ID NO: 16661 - DNA, 15 bp, Homo sapiens
caacgaaatgttatg

SEQ ID NO: 16662 - DNA, 15 bp, Homo sapiens
acaacgaaatgttat

SEQ ID NO: 16663 - DNA, 15 bp, Homo sapiens
tacaacgaaatgtta

SEQ ID NO: 16664 - DNA, 15 bp, Homo sapiens
atacaacgaaatgtt

SEQ ID NO: 16665 - DNA, 15 bp, Homo sapiens
catacaacgaaatgt

SEQ ID NO: 16666 - DNA, 15 bp, Homo sapiens
acatacaacgaaatg

SEQ ID NO: 16667 - DNA, 15 bp, Homo sapiens
gacatacaacgaaat

SEQ ID NO: 16668 - DNA, 15 bp, Homo sapiens
agacatacaacgaaa

SEQ ID NO: 16669 - DNA, 15 bp, Homo sapiens
tagacatacaacgaa

SEQ ID NO: 16670 - DNA, 15 bp, Homo sapiens
atagacatacaacga

SEQ ID NO: 16671 - DNA, 15 bp, Homo sapiens
catagacatacaacg

SEQ ID NO: 16672 - DNA, 15 bp, Homo sapiens
gcatagacatacaac

SEQ ID NO: 16673 - DNA, 15 bp, Homo sapiens
ggcatagacatacaa

SEQ ID NO: 16674 - DNA, 15 bp, Homo sapiens
aggcatagacataca

SEQ ID NO: 16675 - DNA, 15 bp, Homo sapiens
aaggcatagacatac

SEQ ID NO: 16676 - DNA, 15 bp, Homo sapiens
gaaggcatagacata

SEQ ID NO: 16677 - DNA, 15 bp, Homo sapiens
tgaaggcatagacat

SEQ ID NO: 16678 - DNA, 15 bp, Homo sapiens
atgaaggcatagaca

SEQ ID NO: 16679 - DNA, 15 bp, Homo sapiens
aatgaaggcatagac

SEQ ID NO: 16680 - DNA, 15 bp, Homo sapiens
aaatgaaggcataga

SEQ ID NO: 16681 - DNA, 15 bp, Homo sapiens
taaatgaaggcatag

SEQ ID NO: 16682 - DNA, 15 bp, Homo sapiens
ttaaatgaaggcata

SEQ ID NO: 16683 - DNA, 15 bp, Homo sapiens
attaaatgaaggcat

SEQ ID NO: 16684 - DNA, 15 bp, Homo sapiens
aattaaatgaaggca

SEQ ID NO: 16685 - DNA, 15 bp, Homo sapiens
taattaaatgaaggc

SEQ ID NO: 16686 - DNA, 15 bp, Homo sapiens
ttaattaaatgaagg

SEQ ID NO: 16687 - DNA, 15 bp, Homo sapiens
cttaattaaatgaag

SEQ ID NO: 16688 - DNA, 15 bp, Homo sapiens
tcttaattaaatgaa

SEQ ID NO: 16689 - DNA, 15 bp, Homo sapiens
ctcttaattaaatga

SEQ ID NO: 16690 - DNA, 15 bp, Homo sapiens
cctcttaattaaatg

SEQ ID NO: 16691 - DNA, 15 bp, Homo sapiens
gcctcttaattaaat

SEQ ID NO: 16692 - DNA, 15 bp, Homo sapiens
tgcctcttaattaaa

SEQ ID NO: 16693 - DNA, 15 bp, Homo sapiens
atgcctcttaattaa

SEQ ID NO: 16694 - DNA, 15 bp, Homo sapiens
aatgcctcttaatta

SEQ ID NO: 16695 - DNA, 15 bp, Homo sapiens
aaatgcctcttaatt

SEQ ID NO: 16696 - DNA, 15 bp, Homo sapiens
gaaatgcctcttaat

SEQ ID NO: 16697 - DNA, 15 bp, Homo sapiens
ggaaatgcctcttaa

SEQ ID NO: 16698 - DNA, 15 bp, Homo sapiens
tggaaatgcctctta

SEQ ID NO: 16699 - DNA, 15 bp, Homo sapiens
atggaaatgcctctt

SEQ ID NO: 16700 - DNA, 15 bp, Homo sapiens
aatggaaatgcctct

SEQ ID NO: 16701 - DNA, 15 bp, Homo sapiens
taatggaaatgcctc

SEQ ID NO: 16702 - DNA, 15 bp, Homo sapiens
ataatggaaatgcct

SEQ ID NO: 16703 - DNA, 15 bp, Homo sapiens
aataatggaaatgcc

SEQ ID NO: 16704 - DNA, 15 bp, Homo sapiens
aaataatggaaatgc

SEQ ID NO: 16705 - DNA, 15 bp, Homo sapiens
gaaataatggaaatg

SEQ ID NO: 16706 - DNA, 15 bp, Homo sapiens
agaaataatggaaat

SEQ ID NO: 16707 - DNA, 15 bp, Homo sapiens
cagaaataatggaaa

SEQ ID NO: 16708 - DNA, 15 bp, Homo sapiens
gcagaaataatggaa

SEQ ID NO: 16709 - DNA, 15 bp, Homo sapiens
tgcagaaataatgga

SEQ ID NO: 16710 - DNA, 15 bp, Homo sapiens
atgcagaaataatgg

SEQ ID NO: 16711 - DNA, 15 bp, Homo sapiens
catgcagaaataatg

SEQ ID NO: 16712 - DNA, 15 bp, Homo sapiens
acatgcagaaataat

SEQ ID NO: 16713 - DNA, 15 bp, Homo sapiens
aacatgcagaaataa

SEQ ID NO: 16714 - DNA, 15 bp, Homo sapiens
gaacatgcagaaata

SEQ ID NO: 16715 - DNA, 15 bp, Homo sapiens
tgaacatgcagaaat

SEQ ID NO: 16716 - DNA, 15 bp, Homo sapiens
atgaacatgcagaaa

SEQ ID NO: 16717 - DNA, 15 bp, Homo sapiens
catgaacatgcagaa

SEQ ID NO: 16718 - DNA, 15 bp, Homo sapiens
tcatgaacatgcaga

SEQ ID NO: 16719 - DNA, 15 bp, Homo sapiens
gtcatgaacatgcag

SEQ ID NO: 16720 - DNA, 15 bp, Homo sapiens
agtcatgaacatgca

SEQ ID NO: 16721 - DNA, 15 bp, Homo sapiens
gagtcatgaacatgc

SEQ ID NO: 16722 - DNA, 15 bp, Homo sapiens
agagtcatgaacatg

SEQ ID NO: 16723 - DNA, 15 bp, Homo sapiens
cagagtcatgaacat

SEQ ID NO: 16724 - DNA, 15 bp, Homo sapiens
tcagagtcatgaaca

SEQ ID NO: 16725 - DNA, 15 bp, Homo sapiens
ttcagagtcatgaac

SEQ ID NO: 16726 - DNA, 15 bp, Homo sapiens
attcagagtcatgaa

SEQ ID NO: 16727 - DNA, 15 bp, Homo sapiens
cattcagagtcatga

SEQ ID NO: 16728 - DNA, 15 bp, Homo sapiens
tcattcagagtcatg

SEQ ID NO: 16729 - DNA, 15 bp, Homo sapiens
atcattcagagtcat

SEQ ID NO: 16730 - DNA, 15 bp, Homo sapiens
catcattcagagtca

SEQ ID NO: 16731 - DNA, 15 bp, Homo sapiens
tcatcattcagagtc

SEQ ID NO: 16732 - DNA, 15 bp, Homo sapiens
atcatcattcagagt

SEQ ID NO: 16733 - DNA, 15 bp, Homo sapiens
tatcatcattcagag

SEQ ID NO: 16734 - DNA, 15 bp, Homo sapiens
atatcatcattcaga

SEQ ID NO: 16735 - DNA, 15 bp, Homo sapiens
catatcatcattcag

SEQ ID NO: 16736 - DNA, 15 bp, Homo sapiens
acatatcatcattca

SEQ ID NO: 16737 - DNA, 15 bp, Homo sapiens
gacatatcatcattc

SEQ ID NO: 16738 - DNA, 15 bp, Homo sapiens
agacatatcatcatt

SEQ ID NO: 16739 - DNA, 15 bp, Homo sapiens
cagacatatcatcat

SEQ ID NO: 16740 - DNA, 15 bp, Homo sapiens
gcagacatatcatca

SEQ ID NO: 16741 - DNA, 15 bp, Homo sapiens
ggcagacatatcatc

SEQ ID NO: 16742 - DNA, 15 bp, Homo sapiens
aggcagacatatcat

SEQ ID NO: 16743 - DNA, 15 bp, Homo sapiens
caggcagacatatca

SEQ ID NO: 16744 - DNA, 15 bp, Homo sapiens
gcaggcagacatatc

SEQ ID NO: 16745 - DNA, 15 bp, Homo sapiens
agcaggcagacatat

SEQ ID NO: 16746 - DNA, 15 bp, Homo sapiens
cagcaggcagacata

SEQ ID NO: 16747 - DNA, 15 bp, Homo sapiens
tcagcaggcagacat

SEQ ID NO: 16748 - DNA, 15 bp, Homo sapiens
atcagcaggcagaca

SEQ ID NO: 16749 - DNA, 15 bp, Homo sapiens
catcagcaggcagac

SEQ ID NO: 16750 - DNA, 15 bp, Homo sapiens
ccatcagcaggcaga

SEQ ID NO: 16751 - DNA, 15 bp, Homo sapiens
gccatcagcaggcag

SEQ ID NO: 16752 - DNA, 15 bp, Homo sapiens
agccatcagcaggca

SEQ ID NO: 16753 - DNA, 15 bp, Homo sapiens
tagccatcagcaggc

SEQ ID NO: 16754 - DNA, 15 bp, Homo sapiens
gtagccatcagcagg

SEQ ID NO: 16755 - DNA, 15 bp, Homo sapiens
tgtagccatcagcag

SEQ ID NO: 16756 - DNA, 15 bp, Homo sapiens
ttgtagccatcagca

SEQ ID NO: 16757 - DNA, 15 bp, Homo sapiens
gttgtagccatcagc

SEQ ID NO: 16758 - DNA, 15 bp, Homo sapiens
ggttgtagccatcag

SEQ ID NO: 16759 - DNA, 15 bp, Homo sapiens
gggttgtagccatca

SEQ ID NO: 16760 - DNA, 15 bp, Homo sapiens
agggttgtagccatc

SEQ ID NO: 16761 - DNA, 15 bp, Homo sapiens
cagggttgtagccat

SEQ ID NO: 16762 - DNA, 15 bp, Homo sapiens
acagggttgtagcca

SEQ ID NO: 16763 - DNA, 15 bp, Homo sapiens
aacagggttgtagcc

SEQ ID NO: 16764 - DNA, 15 bp, Homo sapiens
aaacagggttgtagc

SEQ ID NO: 16765 - DNA, 15 bp, Homo sapiens
gaaacagggttgtag

SEQ ID NO: 16766 - DNA, 15 bp, Homo sapiens
agaaacagggttgta

SEQ ID NO: 16767 - DNA, 15 bp, Homo sapiens
cagaaacagggttgt

SEQ ID NO: 16768 - DNA, 15 bp, Homo sapiens
gcagaaacagggttg

SEQ ID NO: 16769 - DNA, 15 bp, Homo sapiens
tgcagaaacagggtt

SEQ ID NO: 16770 - DNA, 15 bp, Homo sapiens
atgcagaaacagggt

SEQ ID NO: 16771 - DNA, 15 bp, Homo sapiens
aatgcagaaacaggg

SEQ ID NO: 16772 - DNA, 15 bp, Homo sapiens
aaatgcagaaacagg

SEQ ID NO: 16773 - DNA, 15 bp, Homo sapiens
gaaatgcagaaacag

SEQ ID NO: 16774 - DNA, 15 bp, Homo sapiens
tgaaatgcagaaaca

SEQ ID NO: 16775 - DNA, 15 bp, Homo sapiens
ttgaaatgcagaaac

SEQ ID NO: 16776 - DNA, 15 bp, Homo sapiens
tttgaaatgcagaaa

SEQ ID NO: 16777 - DNA, 15 bp, Homo sapiens
gtttgaaatgcagaa

SEQ ID NO: 16778 - DNA, 15 bp, Homo sapiens
ggtttgaaatgcaga

SEQ ID NO: 16779 - DNA, 15 bp, Homo sapiens
aggtttgaaatgcag

SEQ ID NO: 16780 - DNA, 15 bp, Homo sapiens
gaggtttgaaatgca

SEQ ID NO: 16781 - DNA, 15 bp, Homo sapiens
agaggtttgaaatgc

SEQ ID NO: 16782 - DNA, 15 bp, Homo sapiens
gagaggtttgaaatg

SEQ ID NO: 16783 - DNA, 15 bp, Homo sapiens
agagaggtttgaaat

SEQ ID NO: 16784 - DNA, 15 bp, Homo sapiens
gagagaggtttgaaa

SEQ ID NO: 16785 - DNA, 15 bp, Homo sapiens
agagagaggtttgaa

SEQ ID NO: 16786 - DNA, 15 bp, Homo sapiens
aagagagaggtttga

SEQ ID NO: 16787 - DNA, 15 bp, Homo sapiens
caagagagaggtttg

SEQ ID NO: 16788 - DNA, 15 bp, Homo sapiens
tcaagagagaggttt

SEQ ID NO: 16789 - DNA, 15 bp, Homo sapiens
ctcaagagagaggtt

SEQ ID NO: 16790 - DNA, 15 bp, Homo sapiens
gctcaagagagaggt

SEQ ID NO: 16791 - DNA, 15 bp, Homo sapiens
agctcaagagagagg

SEQ ID NO: 16792 - DNA, 15 bp, Homo sapiens
gagctcaagagagag

SEQ ID NO: 16793 - DNA, 15 bp, Homo sapiens
ggagctcaagagaga

SEQ ID NO: 16794 - DNA, 15 bp, Homo sapiens
tggagctcaagagag

SEQ ID NO: 16795 - DNA, 15 bp, Homo sapiens
ctggagctcaagaga

SEQ ID NO: 16796 - DNA, 15 bp, Homo sapiens
tctggagctcaagag

SEQ ID NO: 16797 - DNA, 15 bp, Homo sapiens
atctggagctcaaga

SEQ ID NO: 16798 - DNA, 15 bp, Homo sapiens
aatctggagctcaag

SEQ ID NO: 16799 - DNA, 15 bp, Homo sapiens
aaatctggagctcaa

SEQ ID NO: 16800 - DNA, 15 bp, Homo sapiens
caaatctggagctca

SEQ ID NO: 16801 - DNA, 15 bp, Homo sapiens
tcaaatctggagctc

SEQ ID NO: 16802 - DNA, 15 bp, Homo sapiens
atcaaatctggagct

SEQ ID NO: 16803 - DNA, 15 bp, Homo sapiens
catcaaatctggagc

SEQ ID NO: 16804 - DNA, 15 bp, Homo sapiens
ccatcaaatctggag

SEQ ID NO: 16805 - DNA, 15 bp, Homo sapiens
gccatcaaatctgga

SEQ ID NO: 16806 - DNA, 15 bp, Homo sapiens
ggccatcaaatctgg

SEQ ID NO: 16807 - DNA, 15 bp, Homo sapiens
aggccatcaaatctg

SEQ ID NO: 16808 - DNA, 15 bp, Homo sapiens
gaggccatcaaatct

SEQ ID NO: 16809 - DNA, 15 bp, Homo sapiens
cgaggccatcaaatc

SEQ ID NO: 16810 - DNA, 15 bp, Homo sapiens
acgaggccatcaaat

SEQ ID NO: 16811 - DNA, 15 bp, Homo sapiens
gacgaggccatcaaa

SEQ ID NO: 16812 - DNA, 15 bp, Homo sapiens
tgacgaggccatcaa

SEQ ID NO: 16813 - DNA, 15 bp, Homo sapiens
ctgacgaggccatca

SEQ ID NO: 16814 - DNA, 15 bp, Homo sapiens
gctgacgaggccatc

SEQ ID NO: 16815 - DNA, 15 bp, Homo sapiens
tgctgacgaggccat

SEQ ID NO: 16816 - DNA, 15 bp, Homo sapiens
atgctgacgaggcca

SEQ ID NO: 16817 - DNA, 15 bp, Homo sapiens
aatgctgacgaggcc

SEQ ID NO: 16818 - DNA, 15 bp, Homo sapiens
aaatgctgacgaggc

SEQ ID NO: 16819 - DNA, 15 bp, Homo sapiens
taaatgctgacgagg

SEQ ID NO: 16820 - DNA, 15 bp, Homo sapiens
gtaaatgctgacgag

SEQ ID NO: 16821 - DNA, 15 bp, Homo sapiens
agtaaatgctgacga

SEQ ID NO: 16822 - DNA, 15 bp, Homo sapiens
aagtaaatgctgacg

SEQ ID NO: 16823 - DNA, 15 bp, Homo sapiens
caagtaaatgctgac

SEQ ID NO: 16824 - DNA, 15 bp, Homo sapiens
tcaagtaaatgctga

SEQ ID NO: 16825 - DNA, 15 bp, Homo sapiens
ctcaagtaaatgctg

SEQ ID NO: 16826 - DNA, 15 bp, Homo sapiens
actcaagtaaatgct

SEQ ID NO: 16827 - DNA, 15 bp, Homo sapiens
aactcaagtaaatgc

SEQ ID NO: 16828 - DNA, 15 bp, Homo sapiens
caactcaagtaaatg

SEQ ID NO: 16829 - DNA, 15 bp, Homo sapiens
gcaactcaagtaaat

SEQ ID NO: 16830 - DNA, 15 bp, Homo sapiens
agcaactcaagtaaa

SEQ ID NO: 16831 - DNA, 15 bp, Homo sapiens
gagcaactcaagtaa

SEQ ID NO: 16832 - DNA, 15 bp, Homo sapiens
tgagcaactcaagta

SEQ ID NO: 16833 - DNA, 15 bp, Homo sapiens
atgagcaactcaagt

SEQ ID NO: 16834 - DNA, 15 bp, Homo sapiens
tatgagcaactcaag

SEQ ID NO: 16835 - DNA, 15 bp, Homo sapiens
ttatgagcaactcaa

SEQ ID NO: 16836 - DNA, 15 bp, Homo sapiens
cttatgagcaactca

SEQ ID NO: 16837 - DNA, 15 bp, Homo sapiens
acttatgagcaactc

SEQ ID NO: 16838 - DNA, 15 bp, Homo sapiens
cacttatgagcaact

SEQ ID NO: 16839 - DNA, 15 bp, Homo sapiens
acacttatgagcaac

SEQ ID NO: 16840 - DNA, 15 bp, Homo sapiens
gacacttatgagcaa

SEQ ID NO: 16841 - DNA, 15 bp, Homo sapiens
agacacttatgagca

SEQ ID NO: 16842 - DNA, 15 bp, Homo sapiens
gagacacttatgagc

SEQ ID NO: 16843 - DNA, 15 bp, Homo sapiens
tgagacacttatgag

SEQ ID NO: 16844 - DNA, 15 bp, Homo sapiens
ttgagacacttatga

SEQ ID NO: 16845 - DNA, 15 bp, Homo sapiens
tttgagacacttatg

SEQ ID NO: 16846 - DNA, 15 bp, Homo sapiens
atttgagacacttat

SEQ ID NO: 16847 - DNA, 15 bp, Homo sapiens
aatttgagacactta

SEQ ID NO: 16848 - DNA, 15 bp, Homo sapiens
aaatttgagacactt

SEQ ID NO: 16849 - DNA, 15 bp, Homo sapiens
taaatttgagacact

SEQ ID NO: 16850 - DNA, 15 bp, Homo sapiens
ttaaatttgagacac

SEQ ID NO: 16851 - DNA, 15 bp, Homo sapiens
gttaaatttgagaca

SEQ ID NO: 16852 - DNA, 15 bp, Homo sapiens
tgttaaatttgagac

SEQ ID NO: 16853 - DNA, 15 bp, Homo sapiens
ttgttaaatttgaga

SEQ ID NO: 16854 - DNA, 15 bp, Homo sapiens
cttgttaaatttgag

SEQ ID NO: 16855 - DNA, 15 bp, Homo sapiens
acttgttaaatttga

SEQ ID NO: 16856 - DNA, 15 bp, Homo sapiens
gacttgttaaatttg

SEQ ID NO: 16857 - DNA, 15 bp, Homo sapiens
ggacttgttaaattt

SEQ ID NO: 16858 - DNA, 15 bp, Homo sapiens
gggacttgttaaatt

SEQ ID NO: 16859 - DNA, 15 bp, Homo sapiens
tgggacttgttaaat

SEQ ID NO: 16860 - DNA, 15 bp, Homo sapiens
ctgggacttgttaaa

SEQ ID NO: 16861 - DNA, 15 bp, Homo sapiens
actgggacttgttaa

SEQ ID NO: 16862 - DNA, 15 bp, Homo sapiens
gactgggacttgtta

SEQ ID NO: 16863 - DNA, 15 bp, Homo sapiens
agactgggacttgtt

SEQ ID NO: 16864 - DNA, 15 bp, Homo sapiens
aagactgggacttgt

SEQ ID NO: 16865 - DNA, 15 bp, Homo sapiens
caagactgggacttg

SEQ ID NO: 16866 - DNA, 15 bp, Homo sapiens
tcaagactgggactt

SEQ ID NO: 16867 - DNA, 15 bp, Homo sapiens
atcaagactgggact

SEQ ID NO: 16868 - DNA, 15 bp, Homo sapiens
aatcaagactgggac

SEQ ID NO: 16869 - DNA, 15 bp, Homo sapiens
aaatcaagactggga

SEQ ID NO: 16870 - DNA, 15 bp, Homo sapiens
aaaatcaagactggg

SEQ ID NO: 16871 - DNA, 15 bp, Homo sapiens
aaaaatcaagactgg

SEQ ID NO: 16872 - DNA, 15 bp, Homo sapiens
aaaaaatcaagactg

SEQ ID NO: 16873 - DNA, 15 bp, Homo sapiens
aaaaaaatcaagact

SEQ ID NO: 16874 - DNA, 15 bp, Homo sapiens
gaaaaaaatcaagac

SEQ ID NO: 16875 - DNA, 15 bp, Homo sapiens
ggaaaaaaatcaaga

SEQ ID NO: 16876 - DNA, 15 bp, Homo sapiens
gggaaaaaaatcaag

SEQ ID NO: 16877 - DNA, 15 bp, Homo sapiens
ggggaaaaaaatcaa

SEQ ID NO: 16878 - DNA, 15 bp, Homo sapiens
gggggaaaaaaatca

SEQ ID NO: 16879 - DNA, 15 bp, Homo sapiens
agggggaaaaaaatc

SEQ ID NO: 16880 - DNA, 15 bp, Homo sapiens
aagggggaaaaaaat

SEQ ID NO: 16881 - DNA, 15 bp, Homo sapiens
gaagggggaaaaaaa

SEQ ID NO: 16882 - DNA, 15 bp, Homo sapiens
tgaagggggaaaaaa

SEQ ID NO: 16883 - DNA, 15 bp, Homo sapiens
ttgaagggggaaaaa

SEQ ID NO: 16884 - DNA, 15 bp, Homo sapiens
tttgaagggggaaaa

SEQ ID NO: 16885 - DNA, 15 bp, Homo sapiens
gtttgaagggggaaa

SEQ ID NO: 16886 - DNA, 15 bp, Homo sapiens
ggtttgaagggggaa

SEQ ID NO: 16887 - DNA, 15 bp, Homo sapiens
aggtttgaaggggga

SEQ ID NO: 16888 - DNA, 15 bp, Homo sapiens
taggtttgaaggggg

SEQ ID NO: 16889 - DNA, 15 bp, Homo sapiens
ataggtttgaagggg

SEQ ID NO: 16890 - DNA, 15 bp, Homo sapiens
aataggtttgaaggg

SEQ ID NO: 16891 - DNA, 15 bp, Homo sapiens
gaataggtttgaagg

SEQ ID NO: 16892 - DNA, 15 bp, Homo sapiens
ggaataggtttgaag

SEQ ID NO: 16893 - DNA, 15 bp, Homo sapiens
aggaataggtttgaa

SEQ ID NO: 16894 - DNA, 15 bp, Homo sapiens
gaggaataggtttga

SEQ ID NO: 16895 - DNA, 15 bp, Homo sapiens
tgaggaataggtttg

SEQ ID NO: 16896 - DNA, 15 bp, Homo sapiens
atgaggaataggttt

SEQ ID NO: 16897 - DNA, 15 bp, Homo sapiens
catgaggaataggtt

SEQ ID NO: 16898 - DNA, 15 bp, Homo sapiens
acatgaggaataggt

SEQ ID NO: 16899 - DNA, 15 bp, Homo sapiens
aacatgaggaatagg

SEQ ID NO: 16900 - DNA, 15 bp, Homo sapiens
caacatgaggaatag

SEQ ID NO: 16901 - DNA, 15 bp, Homo sapiens
acaacatgaggaata

SEQ ID NO: 16902 - DNA, 15 bp, Homo sapiens
gacaacatgaggaat

SEQ ID NO: 16903 - DNA, 15 bp, Homo sapiens
agacaacatgaggaa

SEQ ID NO: 16904 - DNA, 15 bp, Homo sapiens
gagacaacatgagga

SEQ ID NO: 16905 - DNA, 15 bp, Homo sapiens
agagacaacatgagg

SEQ ID NO: 16906 - DNA, 15 bp, Homo sapiens
tagagacaacatgag

SEQ ID NO: 16907 - DNA, 15 bp, Homo sapiens
atagagacaacatga

SEQ ID NO: 16908 - DNA, 15 bp, Homo sapiens
aatagagacaacatg

SEQ ID NO: 16909 - DNA, 15 bp, Homo sapiens
aaatagagacaacat

SEQ ID NO: 16910 - DNA, 15 bp, Homo sapiens
gaaatagagacaaca

SEQ ID NO: 16911 - DNA, 15 bp, Homo sapiens
tgaaatagagacaac

SEQ ID NO: 16912 - DNA, 15 bp, Homo sapiens
ctgaaatagagacaa

SEQ ID NO: 16913 - DNA, 15 bp, Homo sapiens
actgaaatagagaca

SEQ ID NO: 16914 - DNA, 15 bp, Homo sapiens
tactgaaatagagac

SEQ ID NO: 16915 - DNA, 15 bp, Homo sapiens
ttactgaaatagaga

SEQ ID NO: 16916 - DNA, 15 bp, Homo sapiens
tttactgaaatagag

SEQ ID NO: 16917 - DNA, 15 bp, Homo sapiens
gtttactgaaataga

SEQ ID NO: 16918 - DNA, 15 bp, Homo sapiens
tgtttactgaaatag

SEQ ID NO: 16919 - DNA, 15 bp, Homo sapiens
ttgtttactgaaata

SEQ ID NO: 16920 - DNA, 15 bp, Homo sapiens
attgtttactgaaat

SEQ ID NO: 16921 - DNA, 15 bp, Homo sapiens
tattgtttactgaaa

SEQ ID NO: 16922 - DNA, 15 bp, Homo sapiens
atattgtttactgaa

SEQ ID NO: 16923 - DNA, 15 bp, Homo sapiens
gatattgtttactga

SEQ ID NO: 16924 - DNA, 15 bp, Homo sapiens
tgatattgtttactg

SEQ ID NO: 16925 - DNA, 15 bp, Homo sapiens
ttgatattgtttact

SEQ ID NO: 16926 - DNA, 15 bp, Homo sapiens
gttgatattgtttac

SEQ ID NO: 16927 - DNA, 15 bp, Homo sapiens
tgttgatattgttta

SEQ ID NO: 16928 - DNA, 15 bp, Homo sapiens
atgttgatattgttt

SEQ ID NO: 16929 - DNA, 15 bp, Homo sapiens
gatgttgatattgtt

SEQ ID NO: 16930 - DNA, 15 bp, Homo sapiens
ggatgttgatattgt

SEQ ID NO: 16931 - DNA, 15 bp, Homo sapiens
tggatgttgatattg

SEQ ID NO: 16932 - DNA, 15 bp, Homo sapiens
gtggatgttgatatt

SEQ ID NO: 16933 - DNA, 15 bp, Homo sapiens
ggtggatgttgatat

SEQ ID NO: 16934 - DNA, 15 bp, Homo sapiens
gggtggatgttgata

SEQ ID NO: 16935 - DNA, 15 bp, Homo sapiens
tgggtggatgttgat

SEQ ID NO: 16936 - DNA, 15 bp, Homo sapiens
ctgggtggatgttga

SEQ ID NO: 16937 - DNA, 15 bp, Homo sapiens
actgggtggatgttg

SEQ ID NO: 16938 - DNA, 15 bp, Homo sapiens
aactgggtggatgtt

SEQ ID NO: 16939 - DNA, 15 bp, Homo sapiens
taactgggtggatgt

SEQ ID NO: 16940 - DNA, 15 bp, Homo sapiens
gtaactgggtggatg

SEQ ID NO: 16941 - DNA, 15 bp, Homo sapiens
agtaactgggtggat

SEQ ID NO: 16942 - DNA, 15 bp, Homo sapiens
gagtaactgggtgga

SEQ ID NO: 16943 - DNA, 15 bp, Homo sapiens
tgagtaactgggtgg

SEQ ID NO: 16944 - DNA, 15 bp, Homo sapiens
ctgagtaactgggtg

SEQ ID NO: 16945 - DNA, 15 bp, Homo sapiens
actgagtaactgggt

SEQ ID NO: 16946 - DNA, 15 bp, Homo sapiens
gactgagtaactggg

SEQ ID NO: 16947 - DNA, 15 bp, Homo sapiens
ggactgagtaactgg

SEQ ID NO: 16948 - DNA, 15 bp, Homo sapiens
tggactgagtaactg

SEQ ID NO: 16949 - DNA, 15 bp, Homo sapiens
ttggactgagtaact

SEQ ID NO: 16950 - DNA, 15 bp, Homo sapiens
tttggactgagtaac

SEQ ID NO: 16951 - DNA, 15 bp, Homo sapiens
ttttggactgagtaa

SEQ ID NO: 16952 - DNA, 15 bp, Homo sapiens
attttggactgagta

SEQ ID NO: 16953 - DNA, 15 bp, Homo sapiens
aattttggactgagt

SEQ ID NO: 16954 - DNA, 15 bp, Homo sapiens
gaattttggactgag

SEQ ID NO: 16955 - DNA, 15 bp, Homo sapiens
agaattttggactga

SEQ ID NO: 16956 - DNA, 15 bp, Homo sapiens
tagaattttggactg

SEQ ID NO: 16957 - DNA, 15 bp, Homo sapiens
ctagaattttggact

SEQ ID NO: 16958 - DNA, 15 bp, Homo sapiens
cctagaattttggac

SEQ ID NO: 16959 - DNA, 15 bp, Homo sapiens
tcctagaattttgga

SEQ ID NO: 16960 - DNA, 15 bp, Homo sapiens
ctcctagaattttgg

SEQ ID NO: 16961 - DNA, 15 bp, Homo sapiens
actcctagaattttg

SEQ ID NO: 16962 - DNA, 15 bp, Homo sapiens
gactcctagaatttt

SEQ ID NO: 16963 - DNA, 15 bp, Homo sapiens
tgactcctagaattt

SEQ ID NO: 16964 - DNA, 15 bp, Homo sapiens
atgactcctagaatt

SEQ ID NO: 16965 - DNA, 15 bp, Homo sapiens
gatgactcctagaat

SEQ ID NO: 16966 - DNA, 15 bp, Homo sapiens
ggatgactcctagaa

SEQ ID NO: 16967 - DNA, 15 bp, Homo sapiens
aggatgactcctaga

SEQ ID NO: 16968 - DNA, 15 bp, Homo sapiens
aaggatgactcctag

SEQ ID NO: 16969 - DNA, 15 bp, Homo sapiens
caaggatgactccta

SEQ ID NO: 16970 - DNA, 15 bp, Homo sapiens
tcaaggatgactcct

SEQ ID NO: 16971 - DNA, 15 bp, Homo sapiens
atcaaggatgactcc

SEQ ID NO: 16972 - DNA, 15 bp, Homo sapiens
aatcaaggatgactc

SEQ ID NO: 16973 - DNA, 15 bp, Homo sapiens
gaatcaaggatgact

SEQ ID NO: 16974 - DNA, 15 bp, Homo sapiens
agaatcaaggatgac

SEQ ID NO: 16975 - DNA, 15 bp, Homo sapiens
cagaatcaaggatga

SEQ ID NO: 16976 - DNA, 15 bp, Homo sapiens
gcagaatcaaggatg

SEQ ID NO: 16977 - DNA, 15 bp, Homo sapiens
agcagaatcaaggat

SEQ ID NO: 16978 - DNA, 15 bp, Homo sapiens
gagcagaatcaagga

SEQ ID NO: 16979 - DNA, 15 bp, Homo sapiens
agagcagaatcaagg

SEQ ID NO: 16980 - DNA, 15 bp, Homo sapiens
aagagcagaatcaag

SEQ ID NO: 16981 - DNA, 15 bp, Homo sapiens
aaagagcagaatcaa

SEQ ID NO: 16982 - DNA, 15 bp, Homo sapiens
gaaagagcagaatca

SEQ ID NO: 16983 - DNA, 15 bp, Homo sapiens
agaaagagcagaatc

SEQ ID NO: 16984 - DNA, 15 bp, Homo sapiens
aagaaagagcagaat

SEQ ID NO: 16985 - DNA, 15 bp, Homo sapiens
aaagaaagagcagaa

SEQ ID NO: 16986 - DNA, 15 bp, Homo sapiens
aaaagaaagagcaga

SEQ ID NO: 16987 - DNA, 15 bp, Homo sapiens
aaaaagaaagagcag

SEQ ID NO: 16988 - DNA, 15 bp, Homo sapiens
aaaaaagaaagagca

SEQ ID NO: 16989 - DNA, 15 bp, Homo sapiens
aaaaaaagaaagagc

SEQ ID NO: 16990 - DNA, 15 bp, Homo sapiens
aaaaaaaagaaagag

SEQ ID NO: 16991 - DNA, 15 bp, Homo sapiens
ggcctgggcgacaga

SEQ ID NO: 16992 - DNA, 15 bp, Homo sapiens
cggcctgggcgacag

SEQ ID NO: 16993 - DNA, 15 bp, Homo sapiens
ccggcctgggcgaca

SEQ ID NO: 16994 - DNA, 15 bp, Homo sapiens
tccggcctgggcgac

SEQ ID NO: 16995 - DNA, 15 bp, Homo sapiens
gtccggcctgggcga

SEQ ID NO: 16996 - DNA, 15 bp, Homo sapiens
agtccggcctgggcg

SEQ ID NO: 16997 - DNA, 15 bp, Homo sapiens
cagtccggcctgggc

SEQ ID NO: 16998 - DNA, 15 bp, Homo sapiens
gcagtccggcctggg

SEQ ID NO: 16999 - DNA, 15 bp, Homo sapiens
cgcagtccggcctgg

SEQ ID NO: 17000 - DNA, 15 bp, Homo sapiens
ccgcagtccggcctg

SEQ ID NO: 17001 - DNA, 15 bp, Homo sapiens
tccgcagtccggcct

SEQ ID NO: 17002 - DNA, 15 bp, Homo sapiens
gtccgcagtccggcc

SEQ ID NO: 17003 - DNA, 15 bp, Homo sapiens
agtccgcagtccggc

SEQ ID NO: 17004 - DNA, 15 bp, Homo sapiens
cagtccgcagtccgg

SEQ ID NO: 17005 - DNA, 15 bp, Homo sapiens
gcagtccgcagtccg

SEQ ID NO: 17006 - DNA, 15 bp, Homo sapiens
tgcagtccgcagtcc

SEQ ID NO: 17007 - DNA, 15 bp, Homo sapiens
ctgcagtccgcagtc

SEQ ID NO: 17008 - DNA, 15 bp, Homo sapiens
actgcagtccgcagt

SEQ ID NO: 17009 - DNA, 15 bp, Homo sapiens
cactgcagtccgcag

SEQ ID NO: 17010 - DNA, 15 bp, Homo sapiens
ccactgcagtccgca

SEQ ID NO: 17011 - DNA, 15 bp, Homo sapiens
gccactgcagtccgc

SEQ ID NO: 17012 - DNA, 15 bp, Homo sapiens
cgccactgcagtccg

SEQ ID NO: 17013 - DNA, 15 bp, Homo sapiens
gcgccactgcagtcc

SEQ ID NO: 17014 - DNA, 15 bp, Homo sapiens
cgcgccactgcagtc

SEQ ID NO: 17015 - DNA, 15 bp, Homo sapiens
tcgcgccactgcagt

SEQ ID NO: 17016 - DNA, 15 bp, Homo sapiens
atcgcgccactgcag

SEQ ID NO: 17017 - DNA, 15 bp, Homo sapiens
gatcgcgccactgca

SEQ ID NO: 17018 - DNA, 15 bp, Homo sapiens
agatcgcgccactgc

SEQ ID NO: 17019 - DNA, 15 bp, Homo sapiens
gagatcgcgccactg

SEQ ID NO: 17020 - DNA, 15 bp, Homo sapiens
cgagatcgcgccact

SEQ ID NO: 17021 - DNA, 15 bp, Homo sapiens
ccgagatcgcgccac

SEQ ID NO: 17022 - DNA, 15 bp, Homo sapiens
gccgagatcgcgcca

SEQ ID NO: 17023 - DNA, 15 bp, Homo sapiens
agccgagatcgcgcc

SEQ ID NO: 17024 - DNA, 15 bp, Homo sapiens
gagccgagatcgcgc

SEQ ID NO: 17025 - DNA, 15 bp, Homo sapiens
tgagccgagatcgcg

SEQ ID NO: 17026 - DNA, 15 bp, Homo sapiens
gtgagccgagatcgc

SEQ ID NO: 17027 - DNA, 15 bp, Homo sapiens
agcggagcttgcagt

SEQ ID NO: 17028 - DNA, 15 bp, Homo sapiens
aagcggagcttgcag

SEQ ID NO: 17029 - DNA, 15 bp, Homo sapiens
gaagcggagcttgca

SEQ ID NO: 17030 - DNA, 15 bp, Homo sapiens
ggaagcggagcttgc

SEQ ID NO: 17031 - DNA, 15 bp, Homo sapiens
gggaagcggagcttg

SEQ ID NO: 17032 - DNA, 15 bp, Homo sapiens
cgggaagcggagctt

SEQ ID NO: 17033 - DNA, 15 bp, Homo sapiens
ccgggaagcggagct

SEQ ID NO: 17034 - DNA, 15 bp, Homo sapiens
cccgggaagcggagc

SEQ ID NO: 17035 - DNA, 15 bp, Homo sapiens
acccgggaagcggag

SEQ ID NO: 17036 - DNA, 15 bp, Homo sapiens
aacccgggaagcgga

SEQ ID NO: 17037 - DNA, 15 bp, Homo sapiens
gaacccgggaagcgg

SEQ ID NO: 17038 - DNA, 15 bp, Homo sapiens
tgaacccgggaagcg

SEQ ID NO: 17039 - DNA, 15 bp, Homo sapiens
gtgaacccgggaagc

SEQ ID NO: 17040 - DNA, 15 bp, Homo sapiens
cgtgaacccgggaag

SEQ ID NO: 17041 - DNA, 15 bp, Homo sapiens
gcgtgaacccgggaa

SEQ ID NO: 17042 - DNA, 15 bp, Homo sapiens
cggtggcgggcgcct

SEQ ID NO: 17043 - DNA, 15 bp, Homo sapiens
gcggtggcgggcgcc

SEQ ID NO: 17044 - DNA, 15 bp, Homo sapiens
cgcggtggcgggcgc

SEQ ID NO: 17045 - DNA, 15 bp, Homo sapiens
gcgcggtggcgggcg

SEQ ID NO: 17046 - DNA, 15 bp, Homo sapiens
ggcgcggtggcgggc

SEQ ID NO: 17047 - DNA, 15 bp, Homo sapiens
gggcgcggtggcggg

SEQ ID NO: 17048 - DNA, 15 bp, Homo sapiens
cgggcgcggtggcgg

SEQ ID NO: 17049 - DNA, 15 bp, Homo sapiens
ccgggcgcggtggcg

SEQ ID NO: 17050 - DNA, 15 bp, Homo sapiens
gccgggcgcggtggc

SEQ ID NO: 17051 - DNA, 15 bp, Homo sapiens
agccgggcgcggtgg

SEQ ID NO: 17052 - DNA, 15 bp, Homo sapiens
tagccgggcgcggtg

SEQ ID NO: 17053 - DNA, 15 bp, Homo sapiens
ttagccgggcgcggt

SEQ ID NO: 17054 - DNA, 15 bp, Homo sapiens
attagccgggcgcgg

SEQ ID NO: 17055 - DNA, 15 bp, Homo sapiens
aattagccgggcgcg

SEQ ID NO: 17056 - DNA, 15 bp, Homo sapiens
aaattagccgggcgc

SEQ ID NO: 17057 - DNA, 15 bp, Homo sapiens
cctggctaacaaggt

SEQ ID NO: 17058 - DNA, 15 bp, Homo sapiens
tcctggctaacaagg

SEQ ID NO: 17059 - DNA, 15 bp, Homo sapiens
atcctggctaacaag

SEQ ID NO: 17060 - DNA, 15 bp, Homo sapiens
catcctggctaacaa

SEQ ID NO: 17061 - DNA, 15 bp, Homo sapiens
ccatcctggctaaca

SEQ ID NO: 17062 - DNA, 15 bp, Homo sapiens
accatcctggctaac

SEQ ID NO: 17063 - DNA, 15 bp, Homo sapiens
tgaggtcaggagatc

SEQ ID NO: 17064 - DNA, 15 bp, Homo sapiens
atgaggtcaggagat

SEQ ID NO: 17065 - DNA, 15 bp, Homo sapiens
catgaggtcaggaga

SEQ ID NO: 17066 - DNA, 15 bp, Homo sapiens
tcatgaggtcaggag

SEQ ID NO: 17067 - DNA, 15 bp, Homo sapiens
atcatgaggtcagga

SEQ ID NO: 17068 - DNA, 15 bp, Homo sapiens
gatcatgaggtcagg

SEQ ID NO: 17069 - DNA, 15 bp, Homo sapiens
ggatcatgaggtcag

SEQ ID NO: 17070 - DNA, 15 bp, Homo sapiens
tggatcatgaggtca

SEQ ID NO: 17071 - DNA, 15 bp, Homo sapiens
gtggatcatgaggtc

SEQ ID NO: 17072 - DNA, 15 bp, Homo sapiens
ggtggatcatgaggt

SEQ ID NO: 17073 - DNA, 15 bp, Homo sapiens
gggtggatcatgagg

SEQ ID NO: 17074 - DNA, 15 bp, Homo sapiens
cgggtggatcatgag

SEQ ID NO: 17075 - DNA, 15 bp, Homo sapiens
gcgggtggatcatga

SEQ ID NO: 17076 - DNA, 15 bp, Homo sapiens
ggcgggtggatcatg

SEQ ID NO: 17077 - DNA, 15 bp, Homo sapiens
aggcgggtggatcat

SEQ ID NO: 17078 - DNA, 15 bp, Homo sapiens
cgaggcgggtggatc

SEQ ID NO: 17079 - DNA, 15 bp, Homo sapiens
ccgaggcgggtggat

SEQ ID NO: 17080 - DNA, 15 bp, Homo sapiens
gccgaggcgggtgga

SEQ ID NO: 17081 - DNA, 15 bp, Homo sapiens
ggccgaggcgggtgg

SEQ ID NO: 17082 - DNA, 15 bp, Homo sapiens
aggccgaggcgggtg

SEQ ID NO: 17083 - DNA, 15 bp, Homo sapiens
gaggccgaggcgggt

SEQ ID NO: 17084 - DNA, 15 bp, Homo sapiens
ggaggccgaggcggg

SEQ ID NO: 17085 - DNA, 15 bp, Homo sapiens
cgggcgcggtggctc

SEQ ID NO: 17086 - DNA, 15 bp, Homo sapiens
ccgggcgcggtggct

SEQ ID NO: 17087 - DNA, 15 bp, Homo sapiens
ggccgggcgcggtgg

SEQ ID NO: 17088 - DNA, 15 bp, Homo sapiens
aggccgggcgcggtg

SEQ ID NO: 17089 - DNA, 15 bp, Homo sapiens
gaggccgggcgcggt

SEQ ID NO: 17090 - DNA, 15 bp, Homo sapiens
agaggccgggcgcgg

SEQ ID NO: 17091 - DNA, 15 bp, Homo sapiens
aagaggccgggcgcg

SEQ ID NO: 17092 - DNA, 15 bp, Homo sapiens
aaagaggccgggcgc

SEQ ID NO: 17093 - DNA, 15 bp, Homo sapiens
aaaagaggccgggcg

SEQ ID NO: 17094 - DNA, 15 bp, Homo sapiens
aaaaagaggccgggc

SEQ ID NO: 17095 - DNA, 15 bp, Homo sapiens
aaaaaagaggccggg

SEQ ID NO: 17096 - DNA, 15 bp, Homo sapiens
aaaaaaagaggccgg

SEQ ID NO: 17097 - DNA, 15 bp, Homo sapiens
aaaaaaaagaggccg

SEQ ID NO: 17098 - DNA, 15 bp, Homo sapiens
aaaaaaaaagaggcc

SEQ ID NO: 17099 - DNA, 15 bp, Homo sapiens
aaaaaaaaaagaggc

SEQ ID NO: 17100 - DNA, 15 bp, Homo sapiens
aaaaaaaaaaagagg

SEQ ID NO: 17101 - DNA, 15 bp, Homo sapiens
caaaaaaaaaaaaga

SEQ ID NO: 17102 - DNA, 15 bp, Homo sapiens
tcaaaaaaaaaaaag

SEQ ID NO: 17103 - DNA, 15 bp, Homo sapiens
atcaaaaaaaaaaaa

SEQ ID NO: 17104 - DNA, 15 bp, Homo sapiens
tatcaaaaaaaaaaa

SEQ ID NO: 17105 - DNA, 15 bp, Homo sapiens
gtatcaaaaaaaaaa

SEQ ID NO: 17106 - DNA, 15 bp, Homo sapiens
cgtatcaaaaaaaaa

SEQ ID NO: 17107 - DNA, 15 bp, Homo sapiens
ccgtatcaaaaaaaa

SEQ ID NO: 17108 - DNA, 15 bp, Homo sapiens
tccgtatcaaaaaaa

SEQ ID NO: 17109 - DNA, 15 bp, Homo sapiens
ctccgtatcaaaaaa

SEQ ID NO: 17110 - DNA, 15 bp, Homo sapiens
actccgtatcaaaaa

SEQ ID NO: 17111 - DNA, 15 bp, Homo sapiens
gactccgtatcaaaa

SEQ ID NO: 17112 - DNA, 15 bp, Homo sapiens
agactccgtatcaaa

SEQ ID NO: 17113 - DNA, 15 bp, Homo sapiens
gagactccgtatcaa

SEQ ID NO: 17114 - DNA, 15 bp, Homo sapiens
tgagactccgtatca

SEQ ID NO: 17115 - DNA, 15 bp, Homo sapiens
atgagactccgtatc

SEQ ID NO: 17116 - DNA, 15 bp, Homo sapiens
aatgagactccgtat

SEQ ID NO: 17117 - DNA, 15 bp, Homo sapiens
gaatgagactccgta

SEQ ID NO: 17118 - DNA, 15 bp, Homo sapiens
agaatgagactccgt

SEQ ID NO: 17119 - DNA, 15 bp, Homo sapiens
gagaatgagactccg

SEQ ID NO: 17120 - DNA, 15 bp, Homo sapiens
cgagaatgagactcc

SEQ ID NO: 17121 - DNA, 15 bp, Homo sapiens
acgagaatgagactc

SEQ ID NO: 17122 - DNA, 15 bp, Homo sapiens
gacgagaatgagact

SEQ ID NO: 17123 - DNA, 15 bp, Homo sapiens
tgacgagaatgagac

SEQ ID NO: 17124 - DNA, 15 bp, Homo sapiens
atgacgagaatgaga

SEQ ID NO: 17125 - DNA, 15 bp, Homo sapiens
gatgacgagaatgag

SEQ ID NO: 17126 - DNA, 15 bp, Homo sapiens
ggatgacgagaatga

SEQ ID NO: 17127 - DNA, 15 bp, Homo sapiens
tggatgacgagaatg

SEQ ID NO: 17128 - DNA, 15 bp, Homo sapiens
ctggatgacgagaat

SEQ ID NO: 17129 - DNA, 15 bp, Homo sapiens
cctggatgacgagaa

SEQ ID NO: 17130 - DNA, 15 bp, Homo sapiens
gcctggatgacgaga

SEQ ID NO: 17131 - DNA, 15 bp, Homo sapiens
agcctggatgacgag

SEQ ID NO: 17132 - DNA, 15 bp, Homo sapiens
cagcctggatgacga

SEQ ID NO: 17133 - DNA, 15 bp, Homo sapiens
ccagcctggatgacg

SEQ ID NO: 17134 - DNA, 15 bp, Homo sapiens
cactccagcctggat

SEQ ID NO: 17135 - DNA, 15 bp, Homo sapiens
gcactccagcctgga

SEQ ID NO: 17136 - DNA, 15 bp, Homo sapiens
aagattgcaccactg

SEQ ID NO: 17137 - DNA, 15 bp, Homo sapiens
caagattgcaccact

SEQ ID NO: 17138 - DNA, 15 bp, Homo sapiens
ccaagattgcaccac

SEQ ID NO: 17139 - DNA, 15 bp, Homo sapiens
gccaagattgcacca

SEQ ID NO: 17140 - DNA, 15 bp, Homo sapiens
agccaagattgcacc

SEQ ID NO: 17141 - DNA, 15 bp, Homo sapiens
gagccaagattgcac

SEQ ID NO: 17142 - DNA, 15 bp, Homo sapiens
tgagccaagattgca

SEQ ID NO: 17143 - DNA, 15 bp, Homo sapiens
gtgagccaagattgc

SEQ ID NO: 17144 - DNA, 15 bp, Homo sapiens
ttgaacccgggaggc

SEQ ID NO: 17145 - DNA, 15 bp, Homo sapiens
cttgaacccgggagg

SEQ ID NO: 17146 - DNA, 15 bp, Homo sapiens
gcttgaacccgggag

SEQ ID NO: 17147 - DNA, 15 bp, Homo sapiens
tgcttgaacccggga

SEQ ID NO: 17148 - DNA, 15 bp, Homo sapiens
ttgcttgaacccggg

SEQ ID NO: 17149 - DNA, 15 bp, Homo sapiens
attgcttgaacccgg

SEQ ID NO: 17150 - DNA, 15 bp, Homo sapiens
aattgcttgaacccg

SEQ ID NO: 17151 - DNA, 15 bp, Homo sapiens
gggcagaagaattgc

SEQ ID NO: 17152 - DNA, 15 bp, Homo sapiens
ggggcagaagaattg

SEQ ID NO: 17153 - DNA, 15 bp, Homo sapiens
tggggcagaagaatt

SEQ ID NO: 17154 - DNA, 15 bp, Homo sapiens
ttggggcagaagaat

SEQ ID NO: 17155 - DNA, 15 bp, Homo sapiens
gttggggcagaagaa

SEQ ID NO: 17156 - DNA, 15 bp, Homo sapiens
ggttggggcagaaga

SEQ ID NO: 17157 - DNA, 15 bp, Homo sapiens
aggttggggcagaag

SEQ ID NO: 17158 - DNA, 15 bp, Homo sapiens
gaggttggggcagaa

SEQ ID NO: 17159 - DNA, 15 bp, Homo sapiens
ggaggttggggcaga

SEQ ID NO: 17160 - DNA, 15 bp, Homo sapiens
aggaggttggggcag

SEQ ID NO: 17161 - DNA, 15 bp, Homo sapiens
caggaggttggggca

SEQ ID NO: 17162 - DNA, 15 bp, Homo sapiens
tcaggaggttggggc

SEQ ID NO: 17163 - DNA, 15 bp, Homo sapiens
ctcaggaggttgggg

SEQ ID NO: 17164 - DNA, 15 bp, Homo sapiens
actcaggaggttggg

SEQ ID NO: 17165 - DNA, 15 bp, Homo sapiens
tactcaggaggttgg

SEQ ID NO: 17166 - DNA, 15 bp, Homo sapiens
ctactcaggaggttg

SEQ ID NO: 17167 - DNA, 15 bp, Homo sapiens
gctactcaggaggtt

SEQ ID NO: 17168 - DNA, 15 bp, Homo sapiens
agctactcaggaggt

SEQ ID NO: 17169 - DNA, 15 bp, Homo sapiens
gcccagctactcagg

SEQ ID NO: 17170 - DNA, 15 bp, Homo sapiens
ggcccagctactcag

SEQ ID NO: 17171 - DNA, 15 bp, Homo sapiens
aggcccagctactca

SEQ ID NO: 17172 - DNA, 15 bp, Homo sapiens
caggcccagctactc

SEQ ID NO: 17173 - DNA, 15 bp, Homo sapiens
ccaggcccagctact

SEQ ID NO: 17174 - DNA, 15 bp, Homo sapiens
gccaggcccagctac

SEQ ID NO: 17175 - DNA, 15 bp, Homo sapiens
agccaggcccagcta

SEQ ID NO: 17176 - DNA, 15 bp, Homo sapiens
tagccaggcccagct

SEQ ID NO: 17177 - DNA, 15 bp, Homo sapiens
ttagccaggcccagc

SEQ ID NO: 17178 - DNA, 15 bp, Homo sapiens
attagccaggcccag

SEQ ID NO: 17179 - DNA, 15 bp, Homo sapiens
aattagccaggccca

SEQ ID NO: 17180 - DNA, 15 bp, Homo sapiens
aaattagccaggccc

SEQ ID NO: 17181 - DNA, 15 bp, Homo sapiens
aaaattagccaggcc

SEQ ID NO: 17182 - DNA, 15 bp, Homo sapiens
ggaccagcctggcca

SEQ ID NO: 17183 - DNA, 15 bp, Homo sapiens
aggaccagcctggcc

SEQ ID NO: 17184 - DNA, 15 bp, Homo sapiens
caggaccagcctggc

SEQ ID NO: 17185 - DNA, 15 bp, Homo sapiens
tcaggaccagcctgg

SEQ ID NO: 17186 - DNA, 15 bp, Homo sapiens
ttcaggaccagcctg

SEQ ID NO: 17187 - DNA, 15 bp, Homo sapiens
gttcaggaccagcct

SEQ ID NO: 17188 - DNA, 15 bp, Homo sapiens
agttcaggaccagcc

SEQ ID NO: 17189 - DNA, 15 bp, Homo sapiens
gagttcaggaccagc

SEQ ID NO: 17190 - DNA, 15 bp, Homo sapiens
ggagttcaggaccag

SEQ ID NO: 17191 - DNA, 15 bp, Homo sapiens
aggagttcaggacca

SEQ ID NO: 17192 - DNA, 15 bp, Homo sapiens
caggagttcaggacc

SEQ ID NO: 17193 - DNA, 15 bp, Homo sapiens
tcaggagttcaggac

SEQ ID NO: 17194 - DNA, 15 bp, Homo sapiens
gtcaggagttcagga

SEQ ID NO: 17195 - DNA, 15 bp, Homo sapiens
ggtcaggagttcagg

SEQ ID NO: 17196 - DNA, 15 bp, Homo sapiens
aggtcaggagttcag

SEQ ID NO: 17197 - DNA, 15 bp, Homo sapiens
aaggtcaggagttca

SEQ ID NO: 17198 - DNA, 15 bp, Homo sapiens
caaggtcaggagttc

SEQ ID NO: 17199 - DNA, 15 bp, Homo sapiens
acaaggtcaggagtt

SEQ ID NO: 17200 - DNA, 15 bp, Homo sapiens
cacaaggtcaggagt

SEQ ID NO: 17201 - DNA, 15 bp, Homo sapiens
tgggcggatcacaag

SEQ ID NO: 17202 - DNA, 15 bp, Homo sapiens
gtgggcggatcacaa

SEQ ID NO: 17203 - DNA, 15 bp, Homo sapiens
ggtgggcggatcaca

SEQ ID NO: 17204 - DNA, 15 bp, Homo sapiens
aggtgggcggatcac

SEQ ID NO: 17205 - DNA, 15 bp, Homo sapiens
gaggtgggcggatca

SEQ ID NO: 17206 - DNA, 15 bp, Homo sapiens
tgaggtgggcggatc

SEQ ID NO: 17207 - DNA, 15 bp, Homo sapiens
ctgaggtgggcggat

SEQ ID NO: 17208 - DNA, 15 bp, Homo sapiens
gctgaggtgggcgga

SEQ ID NO: 17209 - DNA, 15 bp, Homo sapiens
ggctgaggtgggcgg

SEQ ID NO: 17210 - DNA, 15 bp, Homo sapiens
aggctgaggtgggcg

SEQ ID NO: 17211 - DNA, 15 bp, Homo sapiens
gaggctgaggtgggc

SEQ ID NO: 17212 - DNA, 15 bp, Homo sapiens
ggaggctgaggtggg

SEQ ID NO: 17213 - DNA, 15 bp, Homo sapiens
gggaggctgaggtgg

SEQ ID NO: 17214 - DNA, 15 bp, Homo sapiens
tgggaggctgaggtg

SEQ ID NO: 17215 - DNA, 15 bp, Homo sapiens
ttgggaggctgaggt

SEQ ID NO: 17216 - DNA, 15 bp, Homo sapiens
tttgggaggctgagg

SEQ ID NO: 17217 - DNA, 15 bp, Homo sapiens
ctttgggaggctgag

SEQ ID NO: 17218 - DNA, 15 bp, Homo sapiens
gggtgcagtggctca

SEQ ID NO: 17219 - DNA, 15 bp, Homo sapiens
cgggtgcagtggctc

SEQ ID NO: 17220 - DNA, 15 bp, Homo sapiens
gcgggtgcagtggct

SEQ ID NO: 17221 - DNA, 15 bp, Homo sapiens
ggcgggtgcagtggc

SEQ ID NO: 17222 - DNA, 15 bp, Homo sapiens
gggcgggtgcagtgg

SEQ ID NO: 17223 - DNA, 15 bp, Homo sapiens
agggcgggtgcagtg

SEQ ID NO: 17224 - DNA, 15 bp, Homo sapiens
cagggcgggtgcagt

SEQ ID NO: 17225 - DNA, 15 bp, Homo sapiens
tcagggcgggtgcag

SEQ ID NO: 17226 - DNA, 15 bp, Homo sapiens
atcagggcgggtgca

SEQ ID NO: 17227 - DNA, 15 bp, Homo sapiens
aatcagggcgggtgc

SEQ ID NO: 17228 - DNA, 15 bp, Homo sapiens
gaatcagggcgggtg

SEQ ID NO: 17229 - DNA, 15 bp, Homo sapiens
agaatcagggcgggt

SEQ ID NO: 17230 - DNA, 15 bp, Homo sapiens
cagaatcagggcggg

SEQ ID NO: 17231 - DNA, 15 bp, Homo sapiens
gcagaatcagggcgg

SEQ ID NO: 17232 - DNA, 15 bp, Homo sapiens
agcagaatcagggcg

SEQ ID NO: 17233 - DNA, 15 bp, Homo sapiens
gagcagaatcagggc

SEQ ID NO: 17234 - DNA, 15 bp, Homo sapiens
agagcagaatcaggg

SEQ ID NO: 17235 - DNA, 15 bp, Homo sapiens
aagagcagaatcagg

SEQ ID NO: 17236 - DNA, 15 bp, Homo sapiens
aaagagcagaatcag

SEQ ID NO: 17237 - DNA, 15 bp, Homo sapiens
gagaaagagcagaat

SEQ ID NO: 17238 - DNA, 15 bp, Homo sapiens
agagaaagagcagaa

SEQ ID NO: 17239 - DNA, 15 bp, Homo sapiens
gagagaaagagcaga

SEQ ID NO: 17240 - DNA, 15 bp, Homo sapiens
tgagagaaagagcag

SEQ ID NO: 17241 - DNA, 15 bp, Homo sapiens
atgagagaaagagca

SEQ ID NO: 17242 - DNA, 15 bp, Homo sapiens
gatgagagaaagagc

SEQ ID NO: 17243 - DNA, 15 bp, Homo sapiens
tgatgagagaaagag

SEQ ID NO: 17244 - DNA, 15 bp, Homo sapiens
atgatgagagaaaga

SEQ ID NO: 17245 - DNA, 15 bp, Homo sapiens
gatgatgagagaaag

SEQ ID NO: 17246 - DNA, 15 bp, Homo sapiens
ggatgatgagagaaa

SEQ ID NO: 17247 - DNA, 15 bp, Homo sapiens
gggatgatgagagaa

SEQ ID NO: 17248 - DNA, 15 bp, Homo sapiens
agggatgatgagaga

SEQ ID NO: 17249 - DNA, 15 bp, Homo sapiens
cagggatgatgagag

SEQ ID NO: 17250 - DNA, 15 bp, Homo sapiens
tcagggatgatgaga

SEQ ID NO: 17251 - DNA, 15 bp, Homo sapiens
atcagggatgatgag

SEQ ID NO: 17252 - DNA, 15 bp, Homo sapiens
gatcagggatgatga

SEQ ID NO: 17253 - DNA, 15 bp, Homo sapiens
agatcagggatgatg

SEQ ID NO: 17254 - DNA, 15 bp, Homo sapiens
cagatcagggatgat

SEQ ID NO: 17255 - DNA, 15 bp, Homo sapiens
acagatcagggatga

SEQ ID NO: 17256 - DNA, 15 bp, Homo sapiens
gacagatcagggatg

SEQ ID NO: 17257 - DNA, 15 bp, Homo sapiens
tgacagatcagggat

SEQ ID NO: 17258 - DNA, 15 bp, Homo sapiens
ctgacagatcaggga

SEQ ID NO: 17259 - DNA, 15 bp, Homo sapiens
gctgacagatcaggg

SEQ ID NO: 17260 - DNA, 15 bp, Homo sapiens
tgctgacagatcagg

SEQ ID NO: 17261 - DNA, 15 bp, Homo sapiens
ttgctgacagatcag

SEQ ID NO: 17262 - DNA, 15 bp, Homo sapiens
cttgctgacagatca

SEQ ID NO: 17263 - DNA, 15 bp, Homo sapiens
acttgctgacagatc

SEQ ID NO: 17264 - DNA, 15 bp, Homo sapiens
gacttgctgacagat

SEQ ID NO: 17265 - DNA, 15 bp, Homo sapiens
ggacttgctgacaga

SEQ ID NO: 17266 - DNA, 15 bp, Homo sapiens
aggacttgctgacag

SEQ ID NO: 17267 - DNA, 15 bp, Homo sapiens
caggacttgctgaca

SEQ ID NO: 17268 - DNA, 15 bp, Homo sapiens
acaggacttgctgac

SEQ ID NO: 17269 - DNA, 15 bp, Homo sapiens
aacaggacttgctga

SEQ ID NO: 17270 - DNA, 15 bp, Homo sapiens
taacaggacttgctg

SEQ ID NO: 17271 - DNA, 15 bp, Homo sapiens
ctaacaggacttgct

SEQ ID NO: 17272 - DNA, 15 bp, Homo sapiens
cctaacaggacttgc

SEQ ID NO: 17273 - DNA, 15 bp, Homo sapiens
gcctaacaggacttg

SEQ ID NO: 17274 - DNA, 15 bp, Homo sapiens
ggcctaacaggactt

SEQ ID NO: 17275 - DNA, 15 bp, Homo sapiens
tggcctaacaggact

SEQ ID NO: 17276 - DNA, 15 bp, Homo sapiens
ttggcctaacaggac

SEQ ID NO: 17277 - DNA, 15 bp, Homo sapiens
gttggcctaacagga

SEQ ID NO: 17278 - DNA, 15 bp, Homo sapiens
ggttggcctaacagg

SEQ ID NO: 17279 - DNA, 15 bp, Homo sapiens
tggttggcctaacag

SEQ ID NO: 17280 - DNA, 15 bp, Homo sapiens
gtggttggcctaaca

SEQ ID NO: 17281 - DNA, 15 bp, Homo sapiens
agtggttggcctaac

SEQ ID NO: 17282 - DNA, 15 bp, Homo sapiens
aagtggttggcctaa

SEQ ID NO: 17283 - DNA, 15 bp, Homo sapiens
gaagtggttggccta

SEQ ID NO: 17284 - DNA, 15 bp, Homo sapiens
agaagtggttggcct

SEQ ID NO: 17285 - DNA, 15 bp, Homo sapiens
gagaagtggttggcc

SEQ ID NO: 17286 - DNA, 15 bp, Homo sapiens
tgagaagtggttggc

SEQ ID NO: 17287 - DNA, 15 bp, Homo sapiens
ctgagaagtggttgg

SEQ ID NO: 17288 - DNA, 15 bp, Homo sapiens
gctgagaagtggttg

SEQ ID NO: 17289 - DNA, 15 bp, Homo sapiens
tgctgagaagtggtt

SEQ ID NO: 17290 - DNA, 15 bp, Homo sapiens
atgctgagaagtggt

SEQ ID NO: 17291 - DNA, 15 bp, Homo sapiens
gatgctgagaagtgg

SEQ ID NO: 17292 - DNA, 15 bp, Homo sapiens
agatgctgagaagtg

SEQ ID NO: 17293 - DNA, 15 bp, Homo sapiens
cagatgctgagaagt

SEQ ID NO: 17294 - DNA, 15 bp, Homo sapiens
gcagatgctgagaag

SEQ ID NO: 17295 - DNA, 15 bp, Homo sapiens
tgcagatgctgagaa

SEQ ID NO: 17296 - DNA, 15 bp, Homo sapiens
gtgcagatgctgaga

SEQ ID NO: 17297 - DNA, 15 bp, Homo sapiens
agtgcagatgctgag

SEQ ID NO: 17298 - DNA, 15 bp, Homo sapiens
cagtgcagatgctga

SEQ ID NO: 17299 - DNA, 15 bp, Homo sapiens
gcagtgcagatgctg

SEQ ID NO: 17300 - DNA, 15 bp, Homo sapiens
ggcagtgcagatgct

SEQ ID NO: 17301 - DNA, 15 bp, Homo sapiens
tggcagtgcagatgc

SEQ ID NO: 17302 - DNA, 15 bp, Homo sapiens
ctggcagtgcagatg

SEQ ID NO: 17303 - DNA, 15 bp, Homo sapiens
actggcagtgcagat

SEQ ID NO: 17304 - DNA, 15 bp, Homo sapiens
tactggcagtgcaga

SEQ ID NO: 17305 - DNA, 15 bp, Homo sapiens
atactggcagtgcag

SEQ ID NO: 17306 - DNA, 15 bp, Homo sapiens
catactggcagtgca

SEQ ID NO: 17307 - DNA, 15 bp, Homo sapiens
gcatactggcagtgc

SEQ ID NO: 17308 - DNA, 15 bp, Homo sapiens
agcatactggcagtg

SEQ ID NO: 17309 - DNA, 15 bp, Homo sapiens
tagcatactggcagt

SEQ ID NO: 17310 - DNA, 15 bp, Homo sapiens
ctagcatactggcag

SEQ ID NO: 17311 - DNA, 15 bp, Homo sapiens
actagcatactggca

SEQ ID NO: 17312 - DNA, 15 bp, Homo sapiens
gactagcatactggc

SEQ ID NO: 17313 - DNA, 15 bp, Homo sapiens
ggactagcatactgg

SEQ ID NO: 17314 - DNA, 15 bp, Homo sapiens
tggactagcatactg

SEQ ID NO: 17315 - DNA, 15 bp, Homo sapiens
ttggactagcatact

SEQ ID NO: 17316 - DNA, 15 bp, Homo sapiens
cttggactagcatac

SEQ ID NO: 17317 - DNA, 15 bp, Homo sapiens
gcttggactagcata

SEQ ID NO: 17318 - DNA, 15 bp, Homo sapiens
ggcttggactagcat

SEQ ID NO: 17319 - DNA, 15 bp, Homo sapiens
tggcttggactagca

SEQ ID NO: 17320 - DNA, 15 bp, Homo sapiens
gtggcttggactagc

SEQ ID NO: 17321 - DNA, 15 bp, Homo sapiens
tgtggcttggactag

SEQ ID NO: 17322 - DNA, 15 bp, Homo sapiens
ttgtggcttggacta

SEQ ID NO: 17323 - DNA, 15 bp, Homo sapiens
tttgtggcttggact

SEQ ID NO: 17324 - DNA, 15 bp, Homo sapiens
ttttgtggcttggac

SEQ ID NO: 17325 - DNA, 15 bp, Homo sapiens
gttttgtggcttgga

SEQ ID NO: 17326 - DNA, 15 bp, Homo sapiens
tgttttgtggcttgg

SEQ ID NO: 17327 - DNA, 15 bp, Homo sapiens
gtgttttgtggcttg

SEQ ID NO: 17328 - DNA, 15 bp, Homo sapiens
ggtgttttgtggctt

SEQ ID NO: 17329 - DNA, 15 bp, Homo sapiens
aggtgttttgtggct

SEQ ID NO: 17330 - DNA, 15 bp, Homo sapiens
gaggtgttttgtggc

SEQ ID NO: 17331 - DNA, 15 bp, Homo sapiens
agaggtgttttgtgg

SEQ ID NO: 17332 - DNA, 15 bp, Homo sapiens
gagaggtgttttgtg

SEQ ID NO: 17333 - DNA, 15 bp, Homo sapiens
tgagaggtgttttgt

SEQ ID NO: 17334 - DNA, 15 bp, Homo sapiens
ctgagaggtgttttg

SEQ ID NO: 17335 - DNA, 15 bp, Homo sapiens
tctgagaggtgtttt

SEQ ID NO: 17336 - DNA, 15 bp, Homo sapiens
ctctgagaggtgttt

SEQ ID NO: 17337 - DNA, 15 bp, Homo sapiens
cctctgagaggtgtt

SEQ ID NO: 17338 - DNA, 15 bp, Homo sapiens
acctctgagaggtgt

SEQ ID NO: 17339 - DNA, 15 bp, Homo sapiens
tacctctgagaggtg

SEQ ID NO: 17340 - DNA, 15 bp, Homo sapiens
gtacctctgagaggt

SEQ ID NO: 17341 - DNA, 15 bp, Homo sapiens
cgtacctctgagagg

SEQ ID NO: 17342 - DNA, 15 bp, Homo sapiens
gcgtacctctgagag

SEQ ID NO: 17343 - DNA, 15 bp, Homo sapiens
tgcgtacctctgaga

SEQ ID NO: 17344 - DNA, 15 bp, Homo sapiens
ttgcgtacctctgag

SEQ ID NO: 17345 - DNA, 15 bp, Homo sapiens
gttgcgtacctctga

SEQ ID NO: 17346 - DNA, 15 bp, Homo sapiens
tgttgcgtacctctg

SEQ ID NO: 17347 - DNA, 15 bp, Homo sapiens
ctgttgcgtacctct

SEQ ID NO: 17348 - DNA, 15 bp, Homo sapiens
cctgttgcgtacctc

SEQ ID NO: 17349 - DNA, 15 bp, Homo sapiens
tcctgttgcgtacct

SEQ ID NO: 17350 - DNA, 15 bp, Homo sapiens
gtcctgttgcgtacc

SEQ ID NO: 17351 - DNA, 15 bp, Homo sapiens
agtcctgttgcgtac

SEQ ID NO: 17352 - DNA, 15 bp, Homo sapiens
aagtcctgttgcgta

SEQ ID NO: 17353 - DNA, 15 bp, Homo sapiens
aaagtcctgttgcgt

SEQ ID NO: 17354 - DNA, 15 bp, Homo sapiens
caaagtcctgttgcg

SEQ ID NO: 17355 - DNA, 15 bp, Homo sapiens
acaaagtcctgttgc

SEQ ID NO: 17356 - DNA, 15 bp, Homo sapiens
aacaaagtcctgttg

SEQ ID NO: 17357 - DNA, 15 bp, Homo sapiens
caacaaagtcctgtt

SEQ ID NO: 17358 - DNA, 15 bp, Homo sapiens
acaacaaagtcctgt

SEQ ID NO: 17359 - DNA, 15 bp, Homo sapiens
aacaacaaagtcctg

SEQ ID NO: 17360 - DNA, 15 bp, Homo sapiens
caacaacaaagtcct

SEQ ID NO: 17361 - DNA, 15 bp, Homo sapiens
acaacaacaaagtcc

SEQ ID NO: 17362 - DNA, 15 bp, Homo sapiens
aacaacaacaaagtc

SEQ ID NO: 17363 - DNA, 15 bp, Homo sapiens
caacaacaacaaagt

SEQ ID NO: 17364 - DNA, 15 bp, Homo sapiens
acaacaacaacaaag

SEQ ID NO: 17365 - DNA, 15 bp, Homo sapiens
cacaacaacaacaaa

SEQ ID NO: 17366 - DNA, 15 bp, Homo sapiens
acacaacaacaacaa

SEQ ID NO: 17367 - DNA, 15 bp, Homo sapiens
cacacaacaacaaca

SEQ ID NO: 17368 - DNA, 15 bp, Homo sapiens
acacacaacaacaac

SEQ ID NO: 17369 - DNA, 15 bp, Homo sapiens
cacacacaacaacaa

SEQ ID NO: 17370 - DNA, 15 bp, Homo sapiens
acacacacaacaaca

SEQ ID NO: 17371 - DNA, 15 bp, Homo sapiens
cacacacacaacaac

SEQ ID NO: 17372 - DNA, 15 bp, Homo sapiens
acacacacacaacaa

SEQ ID NO: 17373 - DNA, 15 bp, Homo sapiens
cacacacacacaaca

SEQ ID NO: 17374 - DNA, 15 bp, Homo sapiens
acacacacacacaac

SEQ ID NO: 17375 - DNA, 15 bp, Homo sapiens
cacacacacacacaa

SEQ ID NO: 17376 - DNA, 15 bp, Homo sapiens
aacacacacacacac

SEQ ID NO: 17377 - DNA, 15 bp, Homo sapiens
aaacacacacacaca

SEQ ID NO: 17378 - DNA, 15 bp, Homo sapiens
aaaacacacacacac

SEQ ID NO: 17379 - DNA, 15 bp, Homo sapiens
aaaaacacacacaca

SEQ ID NO: 17380 - DNA, 15 bp, Homo sapiens
aaaaaacacacacac

SEQ ID NO: 17381 - DNA, 15 bp, Homo sapiens
aaaaaaacacacaca

SEQ ID NO: 17382 - DNA, 15 bp, Homo sapiens
aaaaaaaacacacac

SEQ ID NO: 17383 - DNA, 15 bp, Homo sapiens
aaaaaaaaacacaca

SEQ ID NO: 17384 - DNA, 15 bp, Homo sapiens
aaaaaaaaaacacac

SEQ ID NO: 17385 - DNA, 15 bp, Homo sapiens
aaaaaaaaaaacaca

SEQ ID NO: 17386 - DNA, 15 bp, Homo sapiens
aaaaaaaaaaaacac

SEQ ID NO: 17387 - DNA, 15 bp, Homo sapiens
gtaaaaaaaaaaaaa

SEQ ID NO: 17388 - DNA, 15 bp, Homo sapiens
cgtaaaaaaaaaaaa

SEQ ID NO: 17389 - DNA, 15 bp, Homo sapiens
ccgtaaaaaaaaaaa

SEQ ID NO: 17390 - DNA, 15 bp, Homo sapiens
accgtaaaaaaaaaa

SEQ ID NO: 17391 - DNA, 15 bp, Homo sapiens
taccgtaaaaaaaaa

SEQ ID NO: 17392 - DNA, 15 bp, Homo sapiens
ctaccgtaaaaaaaa

SEQ ID NO: 17393 - DNA, 15 bp, Homo sapiens
tctaccgtaaaaaaa

SEQ ID NO: 17394 - DNA, 15 bp, Homo sapiens
ttctaccgtaaaaaa

SEQ ID NO: 17395 - DNA, 15 bp, Homo sapiens
attctaccgtaaaaa

SEQ ID NO: 17396 - DNA, 15 bp, Homo sapiens
aattctaccgtaaaa

SEQ ID NO: 17397 - DNA, 15 bp, Homo sapiens
taattctaccgtaaa

SEQ ID NO: 17398 - DNA, 15 bp, Homo sapiens
ataattctaccgtaa

SEQ ID NO: 17399 - DNA, 15 bp, Homo sapiens
aataattctaccgta

SEQ ID NO: 17400 - DNA, 15 bp, Homo sapiens
aaataattctaccgt

SEQ ID NO: 17401 - DNA, 15 bp, Homo sapiens
aaaataattctaccg

SEQ ID NO: 17402 - DNA, 15 bp, Homo sapiens
taaaataattctacc

SEQ ID NO: 17403 - DNA, 15 bp, Homo sapiens
ataaaataattctac

SEQ ID NO: 17404 - DNA, 15 bp, Homo sapiens
tataaaataattcta

SEQ ID NO: 17405 - DNA, 15 bp, Homo sapiens
ttataaaataattct

SEQ ID NO: 17406 - DNA, 15 bp, Homo sapiens
gttataaaataattc

SEQ ID NO: 17407 - DNA, 15 bp, Homo sapiens
agttataaaataatt

SEQ ID NO: 17408 - DNA, 15 bp, Homo sapiens
aagttataaaataat

SEQ ID NO: 17409 - DNA, 15 bp, Homo sapiens
caagttataaaataa

SEQ ID NO: 17410 - DNA, 15 bp, Homo sapiens
tcaagttataaaata

SEQ ID NO: 17411 - DNA, 15 bp, Homo sapiens
ttcaagttataaaat

SEQ ID NO: 17412 - DNA, 15 bp, Homo sapiens
cttcaagttataaaa

SEQ ID NO: 17413 - DNA, 15 bp, Homo sapiens
acttcaagttataaa

SEQ ID NO: 17414 - DNA, 15 bp, Homo sapiens
cacttcaagttataa

SEQ ID NO: 17415 - DNA, 15 bp, Homo sapiens
acacttcaagttata

SEQ ID NO: 17416 - DNA, 15 bp, Homo sapiens
tacacttcaagttat

SEQ ID NO: 17417 - DNA, 15 bp, Homo sapiens
ctacacttcaagtta

SEQ ID NO: 17418 - DNA, 15 bp, Homo sapiens
cctacacttcaagtt

SEQ ID NO: 17419 - DNA, 15 bp, Homo sapiens
ccctacacttcaagt

SEQ ID NO: 17420 - DNA, 15 bp, Homo sapiens
tccctacacttcaag

SEQ ID NO: 17421 - DNA, 15 bp, Homo sapiens
atccctacacttcaa

SEQ ID NO: 17422 - DNA, 15 bp, Homo sapiens
catccctacacttca

SEQ ID NO: 17423 - DNA, 15 bp, Homo sapiens
tcatccctacacttc

SEQ ID NO: 17424 - DNA, 15 bp, Homo sapiens
gtcatccctacactt

SEQ ID NO: 17425 - DNA, 15 bp, Homo sapiens
ggtcatccctacact

SEQ ID NO: 17426 - DNA, 15 bp, Homo sapiens
aggtcatccctacac

SEQ ID NO: 17427 - DNA, 15 bp, Homo sapiens
aaggtcatccctaca

SEQ ID NO: 17428 - DNA, 15 bp, Homo sapiens
gaaggtcatccctac

SEQ ID NO: 17429 - DNA, 15 bp, Homo sapiens
ggaaggtcatcccta

SEQ ID NO: 17430 - DNA, 15 bp, Homo sapiens
aggaaggtcatccct

SEQ ID NO: 17431 - DNA, 15 bp, Homo sapiens
aaggaaggtcatccc

SEQ ID NO: 17432 - DNA, 15 bp, Homo sapiens
aaaggaaggtcatcc

SEQ ID NO: 17433 - DNA, 15 bp, Homo sapiens
aaaaggaaggtcatc

SEQ ID NO: 17434 - DNA, 15 bp, Homo sapiens
taaaaggaaggtcat

SEQ ID NO: 17435 - DNA, 15 bp, Homo sapiens
ttaaaaggaaggtca

SEQ ID NO: 17436 - DNA, 15 bp, Homo sapiens
tttaaaaggaaggtc

SEQ ID NO: 17437 - DNA, 15 bp, Homo sapiens
ttttaaaaggaaggt

SEQ ID NO: 17438 - DNA, 15 bp, Homo sapiens
attttaaaaggaagg

SEQ ID NO: 17439 - DNA, 15 bp, Homo sapiens
aattttaaaaggaag

SEQ ID NO: 17440 - DNA, 15 bp, Homo sapiens
aaattttaaaaggaa

SEQ ID NO: 17441 - DNA, 15 bp, Homo sapiens
aaaattttaaaagga

SEQ ID NO: 17442 - DNA, 15 bp, Homo sapiens
taaaattttaaaagg

SEQ ID NO: 17443 - DNA, 15 bp, Homo sapiens
ataaaattttaaaag

SEQ ID NO: 17444 - DNA, 15 bp, Homo sapiens
aataaaattttaaaa

SEQ ID NO: 17445 - DNA, 15 bp, Homo sapiens
aaataaaattttaaa

SEQ ID NO: 17446 - DNA, 15 bp, Homo sapiens
taaataaaattttaa

SEQ ID NO: 17447 - DNA, 15 bp, Homo sapiens
ataaataaaatttta

SEQ ID NO: 17448 - DNA, 15 bp, Homo sapiens
aataaataaaatttt

SEQ ID NO: 17449 - DNA, 15 bp, Homo sapiens
aaataaataaaattt

SEQ ID NO: 17450 - DNA, 15 bp, Homo sapiens
aaaataaataaaatt

SEQ ID NO: 17451 - DNA, 15 bp, Homo sapiens
gaaaataaataaaat

SEQ ID NO: 17452 - DNA, 15 bp, Homo sapiens
agaaaataaataaaa

SEQ ID NO: 17453 - DNA, 15 bp, Homo sapiens
aagaaaataaataaa

SEQ ID NO: 17454 - DNA, 15 bp, Homo sapiens
taagaaaataaataa

SEQ ID NO: 17455 - DNA, 15 bp, Homo sapiens
ttaagaaaataaata

SEQ ID NO: 17456 - DNA, 15 bp, Homo sapiens
attaagaaaataaat

SEQ ID NO: 17457 - DNA, 15 bp, Homo sapiens
aattaagaaaataaa

SEQ ID NO: 17458 - DNA, 15 bp, Homo sapiens
aaattaagaaaataa

SEQ ID NO: 17459 - DNA, 15 bp, Homo sapiens
aaaattaagaaaata

SEQ ID NO: 17460 - DNA, 15 bp, Homo sapiens
aaaaattaagaaaat

SEQ ID NO: 17461 - DNA, 15 bp, Homo sapiens
aaaaaattaagaaaa

SEQ ID NO: 17462 - DNA, 15 bp, Homo sapiens
taaaaaattaagaaa

SEQ ID NO: 17463 - DNA, 15 bp, Homo sapiens
ataaaaaattaagaa

SEQ ID NO: 17464 - DNA, 15 bp, Homo sapiens
aataaaaaattaaga

SEQ ID NO: 17465 - DNA, 15 bp, Homo sapiens
gaataaaaaattaag

SEQ ID NO: 17466 - DNA, 15 bp, Homo sapiens
ggaataaaaaattaa

SEQ ID NO: 17467 - DNA, 15 bp, Homo sapiens
gggaataaaaaatta

SEQ ID NO: 17468 - DNA, 15 bp, Homo sapiens
tgggaataaaaaatt

SEQ ID NO: 17469 - DNA, 15 bp, Homo sapiens
atgggaataaaaaat

SEQ ID NO: 17470 - DNA, 15 bp, Homo sapiens
tatgggaataaaaaa

SEQ ID NO: 17471 - DNA, 15 bp, Homo sapiens
ctatgggaataaaaa

SEQ ID NO: 17472 - DNA, 15 bp, Homo sapiens
tctatgggaataaaa

SEQ ID NO: 17473 - DNA, 15 bp, Homo sapiens
atctatgggaataaa

SEQ ID NO: 17474 - DNA, 15 bp, Homo sapiens
aatctatgggaataa

SEQ ID NO: 17475 - DNA, 15 bp, Homo sapiens
aaatctatgggaata

SEQ ID NO: 17476 - DNA, 15 bp, Homo sapiens
aaaatctatgggaat

SEQ ID NO: 17477 - DNA, 15 bp, Homo sapiens
taaaatctatgggaa

SEQ ID NO: 17478 - DNA, 15 bp, Homo sapiens
ctaaaatctatggga

SEQ ID NO: 17479 - DNA, 15 bp, Homo sapiens
cctaaaatctatggg

SEQ ID NO: 17480 - DNA, 15 bp, Homo sapiens
ccctaaaatctatgg

SEQ ID NO: 17481 - DNA, 15 bp, Homo sapiens
cccctaaaatctatg

SEQ ID NO: 17482 - DNA, 15 bp, Homo sapiens
tcccctaaaatctat

SEQ ID NO: 17483 - DNA, 15 bp, Homo sapiens
ttcccctaaaatcta

SEQ ID NO: 17484 - DNA, 15 bp, Homo sapiens
gttcccctaaaatct

SEQ ID NO: 17485 - DNA, 15 bp, Homo sapiens
tgttcccctaaaatc

SEQ ID NO: 17486 - DNA, 15 bp, Homo sapiens
ctgttcccctaaaat

SEQ ID NO: 17487 - DNA, 15 bp, Homo sapiens
cctgttcccctaaaa

SEQ ID NO: 17488 - DNA, 15 bp, Homo sapiens
acctgttcccctaaa

SEQ ID NO: 17489 - DNA, 15 bp, Homo sapiens
cacctgttcccctaa

SEQ ID NO: 17490 - DNA, 15 bp, Homo sapiens
ccacctgttccccta

SEQ ID NO: 17491 - DNA, 15 bp, Homo sapiens
accacctgttcccct

SEQ ID NO: 17492 - DNA, 15 bp, Homo sapiens
taccacctgttcccc

SEQ ID NO: 17493 - DNA, 15 bp, Homo sapiens
ataccacctgttccc

SEQ ID NO: 17494 - DNA, 15 bp, Homo sapiens
aataccacctgttcc

SEQ ID NO: 17495 - DNA, 15 bp, Homo sapiens
aaataccacctgttc

SEQ ID NO: 17496 - DNA, 15 bp, Homo sapiens
caaataccacctgtt

SEQ ID NO: 17497 - DNA, 15 bp, Homo sapiens
ccaaataccacctgt

SEQ ID NO: 17498 - DNA, 15 bp, Homo sapiens
accaaataccacctg

SEQ ID NO: 17499 - DNA, 15 bp, Homo sapiens
caccaaataccacct

SEQ ID NO: 17500 - DNA, 15 bp, Homo sapiens
tcaccaaataccacc

SEQ ID NO: 17501 - DNA, 15 bp, Homo sapiens
gtcaccaaataccac

SEQ ID NO: 17502 - DNA, 15 bp, Homo sapiens
tgtcaccaaatacca

SEQ ID NO: 17503 - DNA, 15 bp, Homo sapiens
atgtcaccaaatacc

SEQ ID NO: 17504 - DNA, 15 bp, Homo sapiens
catgtcaccaaatac

SEQ ID NO: 17505 - DNA, 15 bp, Homo sapiens
tcatgtcaccaaata

SEQ ID NO: 17506 - DNA, 15 bp, Homo sapiens
ctcatgtcaccaaat

SEQ ID NO: 17507 - DNA, 15 bp, Homo sapiens
actcatgtcaccaaa

SEQ ID NO: 17508 - DNA, 15 bp, Homo sapiens
tactcatgtcaccaa

SEQ ID NO: 17509 - DNA, 15 bp, Homo sapiens
ttactcatgtcacca

SEQ ID NO: 17510 - DNA, 15 bp, Homo sapiens
cttactcatgtcacc

SEQ ID NO: 17511 - DNA, 15 bp, Homo sapiens
acttactcatgtcac

SEQ ID NO: 17512 - DNA, 15 bp, Homo sapiens
aacttactcatgtca

SEQ ID NO: 17513 - DNA, 15 bp, Homo sapiens
gaacttactcatgtc

SEQ ID NO: 17514 - DNA, 15 bp, Homo sapiens
agaacttactcatgt

SEQ ID NO: 17515 - DNA, 15 bp, Homo sapiens
aagaacttactcatg

SEQ ID NO: 17516 - DNA, 15 bp, Homo sapiens
aaagaacttactcat

SEQ ID NO: 17517 - DNA, 15 bp, Homo sapiens
taaagaacttactca

SEQ ID NO: 17518 - DNA, 15 bp, Homo sapiens
ttaaagaacttactc

SEQ ID NO: 17519 - DNA, 15 bp, Homo sapiens
attaaagaacttact

SEQ ID NO: 17520 - DNA, 15 bp, Homo sapiens
cattaaagaacttac

SEQ ID NO: 17521 - DNA, 15 bp, Homo sapiens
ccattaaagaactta

SEQ ID NO: 17522 - DNA, 15 bp, Homo sapiens
accattaaagaactt

SEQ ID NO: 17523 - DNA, 15 bp, Homo sapiens
caccattaaagaact

SEQ ID NO: 17524 - DNA, 15 bp, Homo sapiens
tcaccattaaagaac

SEQ ID NO: 17525 - DNA, 15 bp, Homo sapiens
atcaccattaaagaa

SEQ ID NO: 17526 - DNA, 15 bp, Homo sapiens
aatcaccattaaaga

SEQ ID NO: 17527 - DNA, 15 bp, Homo sapiens
aaatcaccattaaag

SEQ ID NO: 17528 - DNA, 15 bp, Homo sapiens
gaaatcaccattaaa

SEQ ID NO: 17529 - DNA, 15 bp, Homo sapiens
agaaatcaccattaa

SEQ ID NO: 17530 - DNA, 15 bp, Homo sapiens
cagaaatcaccatta

SEQ ID NO: 17531 - DNA, 15 bp, Homo sapiens
tcagaaatcaccatt

SEQ ID NO: 17532 - DNA, 15 bp, Homo sapiens
ctcagaaatcaccat

SEQ ID NO: 17533 - DNA, 15 bp, Homo sapiens
tctcagaaatcacca

SEQ ID NO: 17534 - DNA, 15 bp, Homo sapiens
atctcagaaatcacc

SEQ ID NO: 17535 - DNA, 15 bp, Homo sapiens
aatctcagaaatcac

SEQ ID NO: 17536 - DNA, 15 bp, Homo sapiens
aaatctcagaaatca

SEQ ID NO: 17537 - DNA, 15 bp, Homo sapiens
aaaatctcagaaatc

SEQ ID NO: 17538 - DNA, 15 bp, Homo sapiens
caaaatctcagaaat

SEQ ID NO: 17539 - DNA, 15 bp, Homo sapiens
ccaaaatctcagaaa

SEQ ID NO: 17540 - DNA, 15 bp, Homo sapiens
accaaaatctcagaa

SEQ ID NO: 17541 - DNA, 15 bp, Homo sapiens
caccaaaatctcaga

SEQ ID NO: 17542 - DNA, 15 bp, Homo sapiens
gcaccaaaatctcag

SEQ ID NO: 17543 - DNA, 15 bp, Homo sapiens
tgcaccaaaatctca

SEQ ID NO: 17544 - DNA, 15 bp, Homo sapiens
gtgcaccaaaatctc

SEQ ID NO: 17545 - DNA, 15 bp, Homo sapiens
ggtgcaccaaaatct

SEQ ID NO: 17546 - DNA, 15 bp, Homo sapiens
gggtgcaccaaaatc

SEQ ID NO: 17547 - DNA, 15 bp, Homo sapiens
tgggtgcaccaaaat

SEQ ID NO: 17548 - DNA, 15 bp, Homo sapiens
atgggtgcaccaaaa

SEQ ID NO: 17549 - DNA, 15 bp, Homo sapiens
gatgggtgcaccaaa

SEQ ID NO: 17550 - DNA, 15 bp, Homo sapiens
tgatgggtgcaccaa

SEQ ID NO: 17551 - DNA, 15 bp, Homo sapiens
gtgatgggtgcacca

SEQ ID NO: 17552 - DNA, 15 bp, Homo sapiens
ggtgatgggtgcacc

SEQ ID NO: 17553 - DNA, 15 bp, Homo sapiens
gggtgatgggtgcac

SEQ ID NO: 17554 - DNA, 15 bp, Homo sapiens
cgggtgatgggtgca

SEQ ID NO: 17555 - DNA, 15 bp, Homo sapiens
tcgggtgatgggtgc

SEQ ID NO: 17556 - DNA, 15 bp, Homo sapiens
ctcgggtgatgggtg

SEQ ID NO: 17557 - DNA, 15 bp, Homo sapiens
gctcgggtgatgggt

SEQ ID NO: 17558 - DNA, 15 bp, Homo sapiens
tgctcgggtgatggg

SEQ ID NO: 17559 - DNA, 15 bp, Homo sapiens
ctgctcgggtgatgg

SEQ ID NO: 17560 - DNA, 15 bp, Homo sapiens
actgctcgggtgatg

SEQ ID NO: 17561 - DNA, 15 bp, Homo sapiens
cactgctcgggtgat

SEQ ID NO: 17562 - DNA, 15 bp, Homo sapiens
acactgctcgggtga

SEQ ID NO: 17563 - DNA, 15 bp, Homo sapiens
tacactgctcgggtg

SEQ ID NO: 17564 - DNA, 15 bp, Homo sapiens
gtacactgctcgggt

SEQ ID NO: 17565 - DNA, 15 bp, Homo sapiens
tgtacactgctcggg

SEQ ID NO: 17566 - DNA, 15 bp, Homo sapiens
gtgtacactgctcgg

SEQ ID NO: 17567 - DNA, 15 bp, Homo sapiens
agtgtacactgctcg

SEQ ID NO: 17568 - DNA, 15 bp, Homo sapiens
cagtgtacactgctc

SEQ ID NO: 17569 - DNA, 15 bp, Homo sapiens
tcagtgtacactgct

SEQ ID NO: 17570 - DNA, 15 bp, Homo sapiens
ttcagtgtacactgc

SEQ ID NO: 17571 - DNA, 15 bp, Homo sapiens
gttcagtgtacactg

SEQ ID NO: 17572 - DNA, 15 bp, Homo sapiens
ggttcagtgtacact

SEQ ID NO: 17573 - DNA, 15 bp, Homo sapiens
gggttcagtgtacac

SEQ ID NO: 17574 - DNA, 15 bp, Homo sapiens
tgggttcagtgtaca

SEQ ID NO: 17575 - DNA, 15 bp, Homo sapiens
ttgggttcagtgtac

SEQ ID NO: 17576 - DNA, 15 bp, Homo sapiens
attgggttcagtgta

SEQ ID NO: 17577 - DNA, 15 bp, Homo sapiens
aattgggttcagtgt

SEQ ID NO: 17578 - DNA, 15 bp, Homo sapiens
aaattgggttcagtg

SEQ ID NO: 17579 - DNA, 15 bp, Homo sapiens
caaattgggttcagt

SEQ ID NO: 17580 - DNA, 15 bp, Homo sapiens
acaaattgggttcag

SEQ ID NO: 17581 - DNA, 15 bp, Homo sapiens
tacaaattgggttca

SEQ ID NO: 17582 - DNA, 15 bp, Homo sapiens
ctacaaattgggttc

SEQ ID NO: 17583 - DNA, 15 bp, Homo sapiens
actacaaattgggtt

SEQ ID NO: 17584 - DNA, 15 bp, Homo sapiens
gactacaaattgggt

SEQ ID NO: 17585 - DNA, 15 bp, Homo sapiens
agactacaaattggg

SEQ ID NO: 17586 - DNA, 15 bp, Homo sapiens
aagactacaaattgg

SEQ ID NO: 17587 - DNA, 15 bp, Homo sapiens
aaagactacaaattg

SEQ ID NO: 17588 - DNA, 15 bp, Homo sapiens
aaaagactacaaatt

SEQ ID NO: 17589 - DNA, 15 bp, Homo sapiens
taaaagactacaaat

SEQ ID NO: 17590 - DNA, 15 bp, Homo sapiens
ataaaagactacaaa

SEQ ID NO: 17591 - DNA, 15 bp, Homo sapiens
gataaaagactacaa

SEQ ID NO: 17592 - DNA, 15 bp, Homo sapiens
ggataaaagactaca

SEQ ID NO: 17593 - DNA, 15 bp, Homo sapiens
gggataaaagactac

SEQ ID NO: 17594 - DNA, 15 bp, Homo sapiens
agggataaaagacta

SEQ ID NO: 17595 - DNA, 15 bp, Homo sapiens
gagggataaaagact

SEQ ID NO: 17596 - DNA, 15 bp, Homo sapiens
tgagggataaaagac

SEQ ID NO: 17597 - DNA, 15 bp, Homo sapiens
gtgagggataaaaga

SEQ ID NO: 17598 - DNA, 15 bp, Homo sapiens
ggtgagggataaaag

SEQ ID NO: 17599 - DNA, 15 bp, Homo sapiens
gggtgagggataaaa

SEQ ID NO: 17600 - DNA, 15 bp, Homo sapiens
ggggtgagggataaa

SEQ ID NO: 17601 - DNA, 15 bp, Homo sapiens
gggggtgagggataa

SEQ ID NO: 17602 - DNA, 15 bp, Homo sapiens
agggggtgagggata

SEQ ID NO: 17603 - DNA, 15 bp, Homo sapiens
gagggggtgagggat

SEQ ID NO: 17604 - DNA, 15 bp, Homo sapiens
ggagggggtgaggga

SEQ ID NO: 17605 - DNA, 15 bp, Homo sapiens
gggagggggtgaggg

SEQ ID NO: 17606 - DNA, 15 bp, Homo sapiens
tgggagggggtgagg

SEQ ID NO: 17607 - DNA, 15 bp, Homo sapiens
gtgggagggggtgag

SEQ ID NO: 17608 - DNA, 15 bp, Homo sapiens
ggtgggagggggtga

SEQ ID NO: 17609 - DNA, 15 bp, Homo sapiens
gggtgggagggggtg

SEQ ID NO: 17610 - DNA, 15 bp, Homo sapiens
agggtgggagggggt

SEQ ID NO: 17611 - DNA, 15 bp, Homo sapiens
aagggtgggaggggg

SEQ ID NO: 17612 - DNA, 15 bp, Homo sapiens
aaagggtgggagggg

SEQ ID NO: 17613 - DNA, 15 bp, Homo sapiens
gaaagggtgggaggg

SEQ ID NO: 17614 - DNA, 15 bp, Homo sapiens
ggaaagggtgggagg

SEQ ID NO: 17615 - DNA, 15 bp, Homo sapiens
gggaaagggtgggag

SEQ ID NO: 17616 - DNA, 15 bp, Homo sapiens
agggaaagggtggga

SEQ ID NO: 17617 - DNA, 15 bp, Homo sapiens
gagggaaagggtggg

SEQ ID NO: 17618 - DNA, 15 bp, Homo sapiens
tgagggaaagggtgg

SEQ ID NO: 17619 - DNA, 15 bp, Homo sapiens
ttgagggaaagggtg

SEQ ID NO: 17620 - DNA, 15 bp, Homo sapiens
cttgagggaaagggt

SEQ ID NO: 17621 - DNA, 15 bp, Homo sapiens
acttgagggaaaggg

SEQ ID NO: 17622 - DNA, 15 bp, Homo sapiens
gacttgagggaaagg

SEQ ID NO: 17623 - DNA, 15 bp, Homo sapiens
ggacttgagggaaag

SEQ ID NO: 17624 - DNA, 15 bp, Homo sapiens
gggacttgagggaaa

SEQ ID NO: 17625 - DNA, 15 bp, Homo sapiens
ggggacttgagggaa

SEQ ID NO: 17626 - DNA, 15 bp, Homo sapiens
tggggacttgaggga

SEQ ID NO: 17627 - DNA, 15 bp, Homo sapiens
ttggggacttgaggg

SEQ ID NO: 17628 - DNA, 15 bp, Homo sapiens
tttggggacttgagg

SEQ ID NO: 17629 - DNA, 15 bp, Homo sapiens
ctttggggacttgag

SEQ ID NO: 17630 - DNA, 15 bp, Homo sapiens
actttggggacttga

SEQ ID NO: 17631 - DNA, 15 bp, Homo sapiens
gactttggggacttg

SEQ ID NO: 17632 - DNA, 15 bp, Homo sapiens
ggactttggggactt

SEQ ID NO: 17633 - DNA, 15 bp, Homo sapiens
tggactttggggact

SEQ ID NO: 17634 - DNA, 15 bp, Homo sapiens
atggactttggggac

SEQ ID NO: 17635 - DNA, 15 bp, Homo sapiens
aatggactttgggga

SEQ ID NO: 17636 - DNA, 15 bp, Homo sapiens
caatggactttgggg

SEQ ID NO: 17637 - DNA, 15 bp, Homo sapiens
acaatggactttggg

SEQ ID NO: 17638 - DNA, 15 bp, Homo sapiens
tacaatggactttgg

SEQ ID NO: 17639 - DNA, 15 bp, Homo sapiens
atacaatggactttg

SEQ ID NO: 17640 - DNA, 15 bp, Homo sapiens
gatacaatggacttt

SEQ ID NO: 17641 - DNA, 15 bp, Homo sapiens
tgatacaatggactt

SEQ ID NO: 17642 - DNA, 15 bp, Homo sapiens
atgatacaatggact

SEQ ID NO: 17643 - DNA, 15 bp, Homo sapiens
aatgatacaatggac

SEQ ID NO: 17644 - DNA, 15 bp, Homo sapiens
gaatgatacaatgga

SEQ ID NO: 17645 - DNA, 15 bp, Homo sapiens
agaatgatacaatgg

SEQ ID NO: 17646 - DNA, 15 bp, Homo sapiens
cagaatgatacaatg

SEQ ID NO: 17647 - DNA, 15 bp, Homo sapiens
tcagaatgatacaat

SEQ ID NO: 17648 - DNA, 15 bp, Homo sapiens
atcagaatgatacaa

SEQ ID NO: 17649 - DNA, 15 bp, Homo sapiens
catcagaatgataca

SEQ ID NO: 17650 - DNA, 15 bp, Homo sapiens
gcatcagaatgatac

SEQ ID NO: 17651 - DNA, 15 bp, Homo sapiens
ggcatcagaatgata

SEQ ID NO: 17652 - DNA, 15 bp, Homo sapiens
aggcatcagaatgat

SEQ ID NO: 17653 - DNA, 15 bp, Homo sapiens
aaggcatcagaatga

SEQ ID NO: 17654 - DNA, 15 bp, Homo sapiens
aaaggcatcagaatg

SEQ ID NO: 17655 - DNA, 15 bp, Homo sapiens
caaaggcatcagaat

SEQ ID NO: 17656 - DNA, 15 bp, Homo sapiens
gcaaaggcatcagaa

SEQ ID NO: 17657 - DNA, 15 bp, Homo sapiens
tgcaaaggcatcaga

SEQ ID NO: 17658 - DNA, 15 bp, Homo sapiens
atgcaaaggcatcag

SEQ ID NO: 17659 - DNA, 15 bp, Homo sapiens
gatgcaaaggcatca

SEQ ID NO: 17660 - DNA, 15 bp, Homo sapiens
ggatgcaaaggcatc

SEQ ID NO: 17661 - DNA, 15 bp, Homo sapiens
aggatgcaaaggcat

SEQ ID NO: 17662 - DNA, 15 bp, Homo sapiens
gaggatgcaaaggca

SEQ ID NO: 17663 - DNA, 15 bp, Homo sapiens
tgaggatgcaaaggc

SEQ ID NO: 17664 - DNA, 15 bp, Homo sapiens
atgaggatgcaaagg

SEQ ID NO: 17665 - DNA, 15 bp, Homo sapiens
tatgaggatgcaaag

SEQ ID NO: 17666 - DNA, 15 bp, Homo sapiens
ctatgaggatgcaaa

SEQ ID NO: 17667 - DNA, 15 bp, Homo sapiens
gctatgaggatgcaa

SEQ ID NO: 17668 - DNA, 15 bp, Homo sapiens
agctatgaggatgca

SEQ ID NO: 17669 - DNA, 15 bp, Homo sapiens
aagctatgaggatgc

SEQ ID NO: 17670 - DNA, 15 bp, Homo sapiens
taagctatgaggatg

SEQ ID NO: 17671 - DNA, 15 bp, Homo sapiens
ctaagctatgaggat

SEQ ID NO: 17672 - DNA, 15 bp, Homo sapiens
gctaagctatgagga

SEQ ID NO: 17673 - DNA, 15 bp, Homo sapiens
agctaagctatgagg

SEQ ID NO: 17674 - DNA, 15 bp, Homo sapiens
gagctaagctatgag

SEQ ID NO: 17675 - DNA, 15 bp, Homo sapiens
ggagctaagctatga

SEQ ID NO: 17676 - DNA, 15 bp, Homo sapiens
gggagctaagctatg

SEQ ID NO: 17677 - DNA, 15 bp, Homo sapiens
tgggagctaagctat

SEQ ID NO: 17678 - DNA, 15 bp, Homo sapiens
gtgggagctaagcta

SEQ ID NO: 17679 - DNA, 15 bp, Homo sapiens
agtgggagctaagct

SEQ ID NO: 17680 - DNA, 15 bp, Homo sapiens
aagtgggagctaagc

SEQ ID NO: 17681 - DNA, 15 bp, Homo sapiens
taagtgggagctaag

SEQ ID NO: 17682 - DNA, 15 bp, Homo sapiens
ataagtgggagctaa

SEQ ID NO: 17683 - DNA, 15 bp, Homo sapiens
cataagtgggagcta

SEQ ID NO: 17684 - DNA, 15 bp, Homo sapiens
tcataagtgggagct

SEQ ID NO: 17685 - DNA, 15 bp, Homo sapiens
ctcataagtgggagc

SEQ ID NO: 17686 - DNA, 15 bp, Homo sapiens
actcataagtgggag

SEQ ID NO: 17687 - DNA, 15 bp, Homo sapiens
cactcataagtggga

SEQ ID NO: 17688 - DNA, 15 bp, Homo sapiens
tcactcataagtggg

SEQ ID NO: 17689 - DNA, 15 bp, Homo sapiens
ctcactcataagtgg

SEQ ID NO: 17690 - DNA, 15 bp, Homo sapiens
tctcactcataagtg

SEQ ID NO: 17691 - DNA, 15 bp, Homo sapiens
ttctcactcataagt

SEQ ID NO: 17692 - DNA, 15 bp, Homo sapiens
gttctcactcataag

SEQ ID NO: 17693 - DNA, 15 bp, Homo sapiens
tgttctcactcataa

SEQ ID NO: 17694 - DNA, 15 bp, Homo sapiens
atgttctcactcata

SEQ ID NO: 17695 - DNA, 15 bp, Homo sapiens
tatgttctcactcat

SEQ ID NO: 17696 - DNA, 15 bp, Homo sapiens
gtatgttctcactca

SEQ ID NO: 17697 - DNA, 15 bp, Homo sapiens
cgtatgttctcactc

SEQ ID NO: 17698 - DNA, 15 bp, Homo sapiens
ccgtatgttctcact

SEQ ID NO: 17699 - DNA, 15 bp, Homo sapiens
accgtatgttctcac

SEQ ID NO: 17700 - DNA, 15 bp, Homo sapiens
caccgtatgttctca

SEQ ID NO: 17701 - DNA, 15 bp, Homo sapiens
acaccgtatgttctc

SEQ ID NO: 17702 - DNA, 15 bp, Homo sapiens
aacaccgtatgttct

SEQ ID NO: 17703 - DNA, 15 bp, Homo sapiens
aaacaccgtatgttc

SEQ ID NO: 17704 - DNA, 15 bp, Homo sapiens
caaacaccgtatgtt

SEQ ID NO: 17705 - DNA, 15 bp, Homo sapiens
ccaaacaccgtatgt

SEQ ID NO: 17706 - DNA, 15 bp, Homo sapiens
accaaacaccgtatg

SEQ ID NO: 17707 - DNA, 15 bp, Homo sapiens
aaccaaacaccgtat

SEQ ID NO: 17708 - DNA, 15 bp, Homo sapiens
aaaccaaacaccgta

SEQ ID NO: 17709 - DNA, 15 bp, Homo sapiens
aaaaccaaacaccgt

SEQ ID NO: 17710 - DNA, 15 bp, Homo sapiens
gaaaaccaaacaccg

SEQ ID NO: 17711 - DNA, 15 bp, Homo sapiens
ggaaaaccaaacacc

SEQ ID NO: 17712 - DNA, 15 bp, Homo sapiens
tggaaaaccaaacac

SEQ ID NO: 17713 - DNA, 15 bp, Homo sapiens
atggaaaaccaaaca

SEQ ID NO: 17714 - DNA, 15 bp, Homo sapiens
aatggaaaaccaaac

SEQ ID NO: 17715 - DNA, 15 bp, Homo sapiens
gaatggaaaaccaaa

SEQ ID NO: 17716 - DNA, 15 bp, Homo sapiens
ggaatggaaaaccaa

SEQ ID NO: 17717 - DNA, 15 bp, Homo sapiens
aggaatggaaaacca

SEQ ID NO: 17718 - DNA, 15 bp, Homo sapiens
caggaatggaaaacc

SEQ ID NO: 17719 - DNA, 15 bp, Homo sapiens
tcaggaatggaaaac

SEQ ID NO: 17720 - DNA, 15 bp, Homo sapiens
ctcaggaatggaaaa

SEQ ID NO: 17721 - DNA, 15 bp, Homo sapiens
actcaggaatggaaa

SEQ ID NO: 17722 - DNA, 15 bp, Homo sapiens
aactcaggaatggaa

SEQ ID NO: 17723 - DNA, 15 bp, Homo sapiens
taactcaggaatgga

SEQ ID NO: 17724 - DNA, 15 bp, Homo sapiens
gtaactcaggaatgg

SEQ ID NO: 17725 - DNA, 15 bp, Homo sapiens
agtaactcaggaatg

SEQ ID NO: 17726 - DNA, 15 bp, Homo sapiens
aagtaactcaggaat

SEQ ID NO: 17727 - DNA, 15 bp, Homo sapiens
gaagtaactcaggaa

SEQ ID NO: 17728 - DNA, 15 bp, Homo sapiens
tgaagtaactcagga

SEQ ID NO: 17729 - DNA, 15 bp, Homo sapiens
gtgaagtaactcagg

SEQ ID NO: 17730 - DNA, 15 bp, Homo sapiens
agtgaagtaactcag

SEQ ID NO: 17731 - DNA, 15 bp, Homo sapiens
aagtgaagtaactca

SEQ ID NO: 17732 - DNA, 15 bp, Homo sapiens
taagtgaagtaactc

SEQ ID NO: 17733 - DNA, 15 bp, Homo sapiens
ctaagtgaagtaact

SEQ ID NO: 17734 - DNA, 15 bp, Homo sapiens
tctaagtgaagtaac

SEQ ID NO: 17735 - DNA, 15 bp, Homo sapiens
ttctaagtgaagtaa

SEQ ID NO: 17736 - DNA, 15 bp, Homo sapiens
attctaagtgaagta

SEQ ID NO: 17737 - DNA, 15 bp, Homo sapiens
tattctaagtgaagt

SEQ ID NO: 17738 - DNA, 15 bp, Homo sapiens
ttattctaagtgaag

SEQ ID NO: 17739 - DNA, 15 bp, Homo sapiens
attattctaagtgaa

SEQ ID NO: 17740 - DNA, 15 bp, Homo sapiens
tattattctaagtga

SEQ ID NO: 17741 - DNA, 15 bp, Homo sapiens
ctattattctaagtg

SEQ ID NO: 17742 - DNA, 15 bp, Homo sapiens
actattattctaagt

SEQ ID NO: 17743 - DNA, 15 bp, Homo sapiens
gactattattctaag

SEQ ID NO: 17744 - DNA, 15 bp, Homo sapiens
agactattattctaa

SEQ ID NO: 17745 - DNA, 15 bp, Homo sapiens
gagactattattcta

SEQ ID NO: 17746 - DNA, 15 bp, Homo sapiens
agagactattattct

SEQ ID NO: 17747 - DNA, 15 bp, Homo sapiens
tagagactattattc

SEQ ID NO: 17748 - DNA, 15 bp, Homo sapiens
ctagagactattatt

SEQ ID NO: 17749 - DNA, 15 bp, Homo sapiens
actagagactattat

SEQ ID NO: 17750 - DNA, 15 bp, Homo sapiens
aactagagactatta

SEQ ID NO: 17751 - DNA, 15 bp, Homo sapiens
gaactagagactatt

SEQ ID NO: 17752 - DNA, 15 bp, Homo sapiens
ggaactagagactat

SEQ ID NO: 17753 - DNA, 15 bp, Homo sapiens
tggaactagagacta

SEQ ID NO: 17754 - DNA, 15 bp, Homo sapiens
atggaactagagact

SEQ ID NO: 17755 - DNA, 15 bp, Homo sapiens
gatggaactagagac

SEQ ID NO: 17756 - DNA, 15 bp, Homo sapiens
ggatggaactagaga

SEQ ID NO: 17757 - DNA, 15 bp, Homo sapiens
tggatggaactagag

SEQ ID NO: 17758 - DNA, 15 bp, Homo sapiens
ctggatggaactaga

SEQ ID NO: 17759 - DNA, 15 bp, Homo sapiens
cctggatggaactag

SEQ ID NO: 17760 - DNA, 15 bp, Homo sapiens
acctggatggaacta

SEQ ID NO: 17761 - DNA, 15 bp, Homo sapiens
aacctggatggaact

SEQ ID NO: 17762 - DNA, 15 bp, Homo sapiens
caacctggatggaac

SEQ ID NO: 17763 - DNA, 15 bp, Homo sapiens
gcaacctggatggaa

SEQ ID NO: 17764 - DNA, 15 bp, Homo sapiens
agcaacctggatgga

SEQ ID NO: 17765 - DNA, 15 bp, Homo sapiens
cagcaacctggatgg

SEQ ID NO: 17766 - DNA, 15 bp, Homo sapiens
acagcaacctggatg

SEQ ID NO: 17767 - DNA, 15 bp, Homo sapiens
cacagcaacctggat

SEQ ID NO: 17768 - DNA, 15 bp, Homo sapiens
tcacagcaacctgga

SEQ ID NO: 17769 - DNA, 15 bp, Homo sapiens
ttcacagcaacctgg

SEQ ID NO: 17770 - DNA, 15 bp, Homo sapiens
attcacagcaacctg

SEQ ID NO: 17771 - DNA, 15 bp, Homo sapiens
cattcacagcaacct

SEQ ID NO: 17772 - DNA, 15 bp, Homo sapiens
gcattcacagcaacc

SEQ ID NO: 17773 - DNA, 15 bp, Homo sapiens
ggcattcacagcaac

SEQ ID NO: 17774 - DNA, 15 bp, Homo sapiens
tggcattcacagcaa

SEQ ID NO: 17775 - DNA, 15 bp, Homo sapiens
atggcattcacagca

SEQ ID NO: 17776 - DNA, 15 bp, Homo sapiens
aatggcattcacagc

SEQ ID NO: 17777 - DNA, 15 bp, Homo sapiens
taatggcattcacag

SEQ ID NO: 17778 - DNA, 15 bp, Homo sapiens
ttaatggcattcaca

SEQ ID NO: 17779 - DNA, 15 bp, Homo sapiens
cttaatggcattcac

SEQ ID NO: 17780 - DNA, 15 bp, Homo sapiens
acttaatggcattca

SEQ ID NO: 17781 - DNA, 15 bp, Homo sapiens
gacttaatggcattc

SEQ ID NO: 17782 - DNA, 15 bp, Homo sapiens
tgacttaatggcatt

SEQ ID NO: 17783 - DNA, 15 bp, Homo sapiens
atgacttaatggcat

SEQ ID NO: 17784 - DNA, 15 bp, Homo sapiens
aatgacttaatggca

SEQ ID NO: 17785 - DNA, 15 bp, Homo sapiens
gaatgacttaatggc

SEQ ID NO: 17786 - DNA, 15 bp, Homo sapiens
ggaatgacttaatgg

SEQ ID NO: 17787 - DNA, 15 bp, Homo sapiens
aggaatgacttaatg

SEQ ID NO: 17788 - DNA, 15 bp, Homo sapiens
aaggaatgacttaat

SEQ ID NO: 17789 - DNA, 15 bp, Homo sapiens
aaaggaatgacttaa

SEQ ID NO: 17790 - DNA, 15 bp, Homo sapiens
aaaaggaatgactta

SEQ ID NO: 17791 - DNA, 15 bp, Homo sapiens
aaaaaggaatgactt

SEQ ID NO: 17792 - DNA, 15 bp, Homo sapiens
taaaaaggaatgact

SEQ ID NO: 17793 - DNA, 15 bp, Homo sapiens
ataaaaaggaatgac

SEQ ID NO: 17794 - DNA, 15 bp, Homo sapiens
cataaaaaggaatga

SEQ ID NO: 17795 - DNA, 15 bp, Homo sapiens
ccataaaaaggaatg

SEQ ID NO: 17796 - DNA, 15 bp, Homo sapiens
gccataaaaaggaat

SEQ ID NO: 17797 - DNA, 15 bp, Homo sapiens
agccataaaaaggaa

SEQ ID NO: 17798 - DNA, 15 bp, Homo sapiens
cagccataaaaagga

SEQ ID NO: 17799 - DNA, 15 bp, Homo sapiens
tcagccataaaaagg

SEQ ID NO: 17800 - DNA, 15 bp, Homo sapiens
ctcagccataaaaag

SEQ ID NO: 17801 - DNA, 15 bp, Homo sapiens
actcagccataaaaa

SEQ ID NO: 17802 - DNA, 15 bp, Homo sapiens
tactcagccataaaa

SEQ ID NO: 17803 - DNA, 15 bp, Homo sapiens
ctactcagccataaa

SEQ ID NO: 17804 - DNA, 15 bp, Homo sapiens
actactcagccataa

SEQ ID NO: 17805 - DNA, 15 bp, Homo sapiens
tactactcagccata

SEQ ID NO: 17806 - DNA, 15 bp, Homo sapiens
atactactcagccat

SEQ ID NO: 17807 - DNA, 15 bp, Homo sapiens
aatactactcagcca

SEQ ID NO: 17808 - DNA, 15 bp, Homo sapiens
gaatactactcagcc

SEQ ID NO: 17809 - DNA, 15 bp, Homo sapiens
ggaatactactcagc

SEQ ID NO: 17810 - DNA, 15 bp, Homo sapiens
aggaatactactcag

SEQ ID NO: 17811 - DNA, 15 bp, Homo sapiens
aaggaatactactca

SEQ ID NO: 17812 - DNA, 15 bp, Homo sapiens
aaaggaatactactc

SEQ ID NO: 17813 - DNA, 15 bp, Homo sapiens
caaaggaatactact

SEQ ID NO: 17814 - DNA, 15 bp, Homo sapiens
acaaaggaatactac

SEQ ID NO: 17815 - DNA, 15 bp, Homo sapiens
tacaaaggaatacta

SEQ ID NO: 17816 - DNA, 15 bp, Homo sapiens
atacaaaggaatact

SEQ ID NO: 17817 - DNA, 15 bp, Homo sapiens
tatacaaaggaatac

SEQ ID NO: 17818 - DNA, 15 bp, Homo sapiens
atatacaaaggaata

SEQ ID NO: 17819 - DNA, 15 bp, Homo sapiens
tatatacaaaggaat

SEQ ID NO: 17820 - DNA, 15 bp, Homo sapiens
atatatacaaaggaa

SEQ ID NO: 17821 - DNA, 15 bp, Homo sapiens
tatatatacaaagga

SEQ ID NO: 17822 - DNA, 15 bp, Homo sapiens
atatatatacaaagg

SEQ ID NO: 17823 - DNA, 15 bp, Homo sapiens
catatatatacaaag

SEQ ID NO: 17824 - DNA, 15 bp, Homo sapiens
gcatatatatacaaa

SEQ ID NO: 17825 - DNA, 15 bp, Homo sapiens
ggcatatatatacaa

SEQ ID NO: 17826 - DNA, 15 bp, Homo sapiens
tggcatatatataca

SEQ ID NO: 17827 - DNA, 15 bp, Homo sapiens
gtggcatatatatac

SEQ ID NO: 17828 - DNA, 15 bp, Homo sapiens
tgtggcatatatata

SEQ ID NO: 17829 - DNA, 15 bp, Homo sapiens
ttgtggcatatatat

SEQ ID NO: 17830 - DNA, 15 bp, Homo sapiens
attgtggcatatata

SEQ ID NO: 17831 - DNA, 15 bp, Homo sapiens
aattgtggcatatat

SEQ ID NO: 17832 - DNA, 15 bp, Homo sapiens
aaattgtggcatata

SEQ ID NO: 17833 - DNA, 15 bp, Homo sapiens
gaaattgtggcatat

SEQ ID NO: 17834 - DNA, 15 bp, Homo sapiens
agaaattgtggcata

SEQ ID NO: 17835 - DNA, 15 bp, Homo sapiens
gagaaattgtggcat

SEQ ID NO: 17836 - DNA, 15 bp, Homo sapiens
agagaaattgtggca

SEQ ID NO: 17837 - DNA, 15 bp, Homo sapiens
tagagaaattgtggc

SEQ ID NO: 17838 - DNA, 15 bp, Homo sapiens
atagagaaattgtgg

SEQ ID NO: 17839 - DNA, 15 bp, Homo sapiens
aatagagaaattgtg

SEQ ID NO: 17840 - DNA, 15 bp, Homo sapiens
gaatagagaaattgt

SEQ ID NO: 17841 - DNA, 15 bp, Homo sapiens
tgaatagagaaattg

SEQ ID NO: 17842 - DNA, 15 bp, Homo sapiens
gtgaatagagaaatt

SEQ ID NO: 17843 - DNA, 15 bp, Homo sapiens
agtgaatagagaaat

SEQ ID NO: 17844 - DNA, 15 bp, Homo sapiens
aagtgaatagagaaa

SEQ ID NO: 17845 - DNA, 15 bp, Homo sapiens
aaagtgaatagagaa

SEQ ID NO: 17846 - DNA, 15 bp, Homo sapiens
gaaagtgaatagaga

SEQ ID NO: 17847 - DNA, 15 bp, Homo sapiens
agaaagtgaatagag

SEQ ID NO: 17848 - DNA, 15 bp, Homo sapiens
cagaaagtgaataga

SEQ ID NO: 17849 - DNA, 15 bp, Homo sapiens
tcagaaagtgaatag

SEQ ID NO: 17850 - DNA, 15 bp, Homo sapiens
atcagaaagtgaata

SEQ ID NO: 17851 - DNA, 15 bp, Homo sapiens
aatcagaaagtgaat

SEQ ID NO: 17852 - DNA, 15 bp, Homo sapiens
caatcagaaagtgaa

SEQ ID NO: 17853 - DNA, 15 bp, Homo sapiens
tcaatcagaaagtga

SEQ ID NO: 17854 - DNA, 15 bp, Homo sapiens
atcaatcagaaagtg

SEQ ID NO: 17855 - DNA, 15 bp, Homo sapiens
catcaatcagaaagt

SEQ ID NO: 17856 - DNA, 15 bp, Homo sapiens
ccatcaatcagaaag

SEQ ID NO: 17857 - DNA, 15 bp, Homo sapiens
cccatcaatcagaaa

SEQ ID NO: 17858 - DNA, 15 bp, Homo sapiens
gcccatcaatcagaa

SEQ ID NO: 17859 - DNA, 15 bp, Homo sapiens
tgcccatcaatcaga

SEQ ID NO: 17860 - DNA, 15 bp, Homo sapiens
atgcccatcaatcag

SEQ ID NO: 17861 - DNA, 15 bp, Homo sapiens
aatgcccatcaatca

SEQ ID NO: 17862 - DNA, 15 bp, Homo sapiens
aaatgcccatcaatc

SEQ ID NO: 17863 - DNA, 15 bp, Homo sapiens
caaatgcccatcaat

SEQ ID NO: 17864 - DNA, 15 bp, Homo sapiens
ccaaatgcccatcaa

SEQ ID NO: 17865 - DNA, 15 bp, Homo sapiens
cccaaatgcccatca

SEQ ID NO: 17866 - DNA, 15 bp, Homo sapiens
gcccaaatgcccatc

SEQ ID NO: 17867 - DNA, 15 bp, Homo sapiens
agcccaaatgcccat

SEQ ID NO: 17868 - DNA, 15 bp, Homo sapiens
cagcccaaatgccca

SEQ ID NO: 17869 - DNA, 15 bp, Homo sapiens
ccagcccaaatgccc

SEQ ID NO: 17870 - DNA, 15 bp, Homo sapiens
accagcccaaatgcc

SEQ ID NO: 17871 - DNA, 15 bp, Homo sapiens
aaccagcccaaatgc

SEQ ID NO: 17872 - DNA, 15 bp, Homo sapiens
gaaccagcccaaatg

SEQ ID NO: 17873 - DNA, 15 bp, Homo sapiens
agaaccagcccaaat

SEQ ID NO: 17874 - DNA, 15 bp, Homo sapiens
tagaaccagcccaaa

SEQ ID NO: 17875 - DNA, 15 bp, Homo sapiens
atagaaccagcccaa

SEQ ID NO: 17876 - DNA, 15 bp, Homo sapiens
tatagaaccagccca

SEQ ID NO: 17877 - DNA, 15 bp, Homo sapiens
atatagaaccagccc

SEQ ID NO: 17878 - DNA, 15 bp, Homo sapiens
aatatagaaccagcc

SEQ ID NO: 17879 - DNA, 15 bp, Homo sapiens
aaatatagaaccagc

SEQ ID NO: 17880 - DNA, 15 bp, Homo sapiens
aaaatatagaaccag

SEQ ID NO: 17881 - DNA, 15 bp, Homo sapiens
aaaaatatagaacca

SEQ ID NO: 17882 - DNA, 15 bp, Homo sapiens
caaaaatatagaacc

SEQ ID NO: 17883 - DNA, 15 bp, Homo sapiens
acaaaaatatagaac

SEQ ID NO: 17884 - DNA, 15 bp, Homo sapiens
tacaaaaatatagaa

SEQ ID NO: 17885 - DNA, 15 bp, Homo sapiens
ttacaaaaatataga

SEQ ID NO: 17886 - DNA, 15 bp, Homo sapiens
attacaaaaatatag

SEQ ID NO: 17887 - DNA, 15 bp, Homo sapiens
aattacaaaaatata

SEQ ID NO: 17888 - DNA, 15 bp, Homo sapiens
caattacaaaaatat

SEQ ID NO: 17889 - DNA, 15 bp, Homo sapiens
acaattacaaaaata

SEQ ID NO: 17890 - DNA, 15 bp, Homo sapiens
cacaattacaaaaat

SEQ ID NO: 17891 - DNA, 15 bp, Homo sapiens
tcacaattacaaaaa

SEQ ID NO: 17892 - DNA, 15 bp, Homo sapiens
ttcacaattacaaaa

SEQ ID NO: 17893 - DNA, 15 bp, Homo sapiens
attcacaattacaaa

SEQ ID NO: 17894 - DNA, 15 bp, Homo sapiens
aattcacaattacaa

SEQ ID NO: 17895 - DNA, 15 bp, Homo sapiens
caattcacaattaca

SEQ ID NO: 17896 - DNA, 15 bp, Homo sapiens
acaattcacaattac

SEQ ID NO: 17897 - DNA, 15 bp, Homo sapiens
cacaattcacaatta

SEQ ID NO: 17898 - DNA, 15 bp, Homo sapiens
gcacaattcacaatt

SEQ ID NO: 17899 - DNA, 15 bp, Homo sapiens
agcacaattcacaat

SEQ ID NO: 17900 - DNA, 15 bp, Homo sapiens
cagcacaattcacaa

SEQ ID NO: 17901 - DNA, 15 bp, Homo sapiens
gcagcacaattcaca

SEQ ID NO: 17902 - DNA, 15 bp, Homo sapiens
agcagcacaattcac

SEQ ID NO: 17903 - DNA, 15 bp, Homo sapiens
tagcagcacaattca

SEQ ID NO: 17904 - DNA, 15 bp, Homo sapiens
atagcagcacaattc

SEQ ID NO: 17905 - DNA, 15 bp, Homo sapiens
tatagcagcacaatt

SEQ ID NO: 17906 - DNA, 15 bp, Homo sapiens
ttatagcagcacaat

SEQ ID NO: 17907 - DNA, 15 bp, Homo sapiens
cttatagcagcacaa

SEQ ID NO: 17908 - DNA, 15 bp, Homo sapiens
gcttatagcagcaca

SEQ ID NO: 17909 - DNA, 15 bp, Homo sapiens
tgcttatagcagcac

SEQ ID NO: 17910 - DNA, 15 bp, Homo sapiens
atgcttatagcagca

SEQ ID NO: 17911 - DNA, 15 bp, Homo sapiens
catgcttatagcagc

SEQ ID NO: 17912 - DNA, 15 bp, Homo sapiens
gcatgcttatagcag

SEQ ID NO: 17913 - DNA, 15 bp, Homo sapiens
cgcatgcttatagca

SEQ ID NO: 17914 - DNA, 15 bp, Homo sapiens
acgcatgcttatagc

SEQ ID NO: 17915 - DNA, 15 bp, Homo sapiens
cacgcatgcttatag

SEQ ID NO: 17916 - DNA, 15 bp, Homo sapiens
acacgcatgcttata

SEQ ID NO: 17917 - DNA, 15 bp, Homo sapiens
cacacgcatgcttat

SEQ ID NO: 17918 - DNA, 15 bp, Homo sapiens
gcacacgcatgctta

SEQ ID NO: 17919 - DNA, 15 bp, Homo sapiens
tgcacacgcatgctt

SEQ ID NO: 17920 - DNA, 15 bp, Homo sapiens
ttgcacacgcatgct

SEQ ID NO: 17921 - DNA, 15 bp, Homo sapiens
cttgcacacgcatgc

SEQ ID NO: 17922 - DNA, 15 bp, Homo sapiens
acttgcacacgcatg

SEQ ID NO: 17923 - DNA, 15 bp, Homo sapiens
tacttgcacacgcat

SEQ ID NO: 17924 - DNA, 15 bp, Homo sapiens
atacttgcacacgca

SEQ ID NO: 17925 - DNA, 15 bp, Homo sapiens
gatacttgcacacgc

SEQ ID NO: 17926 - DNA, 15 bp, Homo sapiens
tgatacttgcacacg

SEQ ID NO: 17927 - DNA, 15 bp, Homo sapiens
atgatacttgcacac

SEQ ID NO: 17928 - DNA, 15 bp, Homo sapiens
aatgatacttgcaca

SEQ ID NO: 17929 - DNA, 15 bp, Homo sapiens
taatgatacttgcac

SEQ ID NO: 17930 - DNA, 15 bp, Homo sapiens
ataatgatacttgca

SEQ ID NO: 17931 - DNA, 15 bp, Homo sapiens
cataatgatacttgc

SEQ ID NO: 17932 - DNA, 15 bp, Homo sapiens
gcataatgatacttg

SEQ ID NO: 17933 - DNA, 15 bp, Homo sapiens
tgcataatgatactt

SEQ ID NO: 17934 - DNA, 15 bp, Homo sapiens
ttgcataatgatact

SEQ ID NO: 17935 - DNA, 15 bp, Homo sapiens
gttgcataatgatac

SEQ ID NO: 17936 - DNA, 15 bp, Homo sapiens
cgttgcataatgata

SEQ ID NO: 17937 - DNA, 15 bp, Homo sapiens
ccgttgcataatgat

SEQ ID NO: 17938 - DNA, 15 bp, Homo sapiens
cccgttgcataatga

SEQ ID NO: 17939 - DNA, 15 bp, Homo sapiens
tcccgttgcataatg

SEQ ID NO: 17940 - DNA, 15 bp, Homo sapiens
gtcccgttgcataat

SEQ ID NO: 17941 - DNA, 15 bp, Homo sapiens
agtcccgttgcataa

SEQ ID NO: 17942 - DNA, 15 bp, Homo sapiens
aagtcccgttgcata

SEQ ID NO: 17943 - DNA, 15 bp, Homo sapiens
gaagtcccgttgcat

SEQ ID NO: 17944 - DNA, 15 bp, Homo sapiens
cgaagtcccgttgca

SEQ ID NO: 17945 - DNA, 15 bp, Homo sapiens
ccgaagtcccgttgc

SEQ ID NO: 17946 - DNA, 15 bp, Homo sapiens
tccgaagtcccgttg

SEQ ID NO: 17947 - DNA, 15 bp, Homo sapiens
atccgaagtcccgtt

SEQ ID NO: 17948 - DNA, 15 bp, Homo sapiens
catccgaagtcccgt

SEQ ID NO: 17949 - DNA, 15 bp, Homo sapiens
tcatccgaagtcccg

SEQ ID NO: 17950 - DNA, 15 bp, Homo sapiens
gtcatccgaagtccc

SEQ ID NO: 17951 - DNA, 15 bp, Homo sapiens
tgtcatccgaagtcc

SEQ ID NO: 17952 - DNA, 15 bp, Homo sapiens
atgtcatccgaagtc

SEQ ID NO: 17953 - DNA, 15 bp, Homo sapiens
tatgtcatccgaagt

SEQ ID NO: 17954 - DNA, 15 bp, Homo sapiens
atatgtcatccgaag

SEQ ID NO: 17955 - DNA, 15 bp, Homo sapiens
aatatgtcatccgaa

SEQ ID NO: 17956 - DNA, 15 bp, Homo sapiens
caatatgtcatccga

SEQ ID NO: 17957 - DNA, 15 bp, Homo sapiens
tcaatatgtcatccg

SEQ ID NO: 17958 - DNA, 15 bp, Homo sapiens
ttcaatatgtcatcc

SEQ ID NO: 17959 - DNA, 15 bp, Homo sapiens
gttcaatatgtcatc

SEQ ID NO: 17960 - DNA, 15 bp, Homo sapiens
tgttcaatatgtcat

SEQ ID NO: 17961 - DNA, 15 bp, Homo sapiens
ttgttcaatatgtca

SEQ ID NO: 17962 - DNA, 15 bp, Homo sapiens
gttgttcaatatgtc

SEQ ID NO: 17963 - DNA, 15 bp, Homo sapiens
agttgttcaatatgt

SEQ ID NO: 17964 - DNA, 15 bp, Homo sapiens
aagttgttcaatatg

SEQ ID NO: 17965 - DNA, 15 bp, Homo sapiens
gaagttgttcaatat

SEQ ID NO: 17966 - DNA, 15 bp, Homo sapiens
ggaagttgttcaata

SEQ ID NO: 17967 - DNA, 15 bp, Homo sapiens
aggaagttgttcaat

SEQ ID NO: 17968 - DNA, 15 bp, Homo sapiens
gaggaagttgttcaa

SEQ ID NO: 17969 - DNA, 15 bp, Homo sapiens
tgaggaagttgttca

SEQ ID NO: 17970 - DNA, 15 bp, Homo sapiens
gtgaggaagttgttc

SEQ ID NO: 17971 - DNA, 15 bp, Homo sapiens
agtgaggaagttgtt

SEQ ID NO: 17972 - DNA, 15 bp, Homo sapiens
cagtgaggaagttgt

SEQ ID NO: 17973 - DNA, 15 bp, Homo sapiens
tcagtgaggaagttg

SEQ ID NO: 17974 - DNA, 15 bp, Homo sapiens
atcagtgaggaagtt

SEQ ID NO: 17975 - DNA, 15 bp, Homo sapiens
tatcagtgaggaagt

SEQ ID NO: 17976 - DNA, 15 bp, Homo sapiens
atatcagtgaggaag

SEQ ID NO: 17977 - DNA, 15 bp, Homo sapiens
gatatcagtgaggaa

SEQ ID NO: 17978 - DNA, 15 bp, Homo sapiens
ggatatcagtgagga

SEQ ID NO: 17979 - DNA, 15 bp, Homo sapiens
aggatatcagtgagg

SEQ ID NO: 17980 - DNA, 15 bp, Homo sapiens
aaggatatcagtgag

SEQ ID NO: 17981 - DNA, 15 bp, Homo sapiens
caaggatatcagtga

SEQ ID NO: 17982 - DNA, 15 bp, Homo sapiens
acaaggatatcagtg

SEQ ID NO: 17983 - DNA, 15 bp, Homo sapiens
cacaaggatatcagt

SEQ ID NO: 17984 - DNA, 15 bp, Homo sapiens
tcacaaggatatcag

SEQ ID NO: 17985 - DNA, 15 bp, Homo sapiens
ttcacaaggatatca

SEQ ID NO: 17986 - DNA, 15 bp, Homo sapiens
tttcacaaggatatc

SEQ ID NO: 17987 - DNA, 15 bp, Homo sapiens
gtttcacaaggatat

SEQ ID NO: 17988 - DNA, 15 bp, Homo sapiens
cgtttcacaaggata

SEQ ID NO: 17989 - DNA, 15 bp, Homo sapiens
gcgtttcacaaggat

SEQ ID NO: 17990 - DNA, 15 bp, Homo sapiens
agcgtttcacaagga

SEQ ID NO: 17991 - DNA, 15 bp, Homo sapiens
tagcgtttcacaagg

SEQ ID NO: 17992 - DNA, 15 bp, Homo sapiens
gtagcgtttcacaag

SEQ ID NO: 17993 - DNA, 15 bp, Homo sapiens
tgtagcgtttcacaa

SEQ ID NO: 17994 - DNA, 15 bp, Homo sapiens
atgtagcgtttcaca

SEQ ID NO: 17995 - DNA, 15 bp, Homo sapiens
tatgtagcgtttcac

SEQ ID NO: 17996 - DNA, 15 bp, Homo sapiens
atatgtagcgtttca

SEQ ID NO: 17997 - DNA, 15 bp, Homo sapiens
aatatgtagcgtttc

SEQ ID NO: 17998 - DNA, 15 bp, Homo sapiens
aaatatgtagcgttt

SEQ ID NO: 17999 - DNA, 15 bp, Homo sapiens
gaaatatgtagcgtt

SEQ ID NO: 18000 - DNA, 15 bp, Homo sapiens
tgaaatatgtagcgt

SEQ ID NO: 18001 - DNA, 15 bp, Homo sapiens
atgaaatatgtagcg

SEQ ID NO: 18002 - DNA, 15 bp, Homo sapiens
catgaaatatgtagc

SEQ ID NO: 18003 - DNA, 15 bp, Homo sapiens
ccatgaaatatgtag

SEQ ID NO: 18004 - DNA, 15 bp, Homo sapiens
cccatgaaatatgta

SEQ ID NO: 18005 - DNA, 15 bp, Homo sapiens
acccatgaaatatgt

SEQ ID NO: 18006 - DNA, 15 bp, Homo sapiens
gacccatgaaatatg

SEQ ID NO: 18007 - DNA, 15 bp, Homo sapiens
agacccatgaaatat

SEQ ID NO: 18008 - DNA, 15 bp, Homo sapiens
cagacccatgaaata

SEQ ID NO: 18009 - DNA, 15 bp, Homo sapiens
acagacccatgaaat

SEQ ID NO: 18010 - DNA, 15 bp, Homo sapiens
aacagacccatgaaa

SEQ ID NO: 18011 - DNA, 15 bp, Homo sapiens
aaacagacccatgaa

SEQ ID NO: 18012 - DNA, 15 bp, Homo sapiens
caaacagacccatga

SEQ ID NO: 18013 - DNA, 15 bp, Homo sapiens
acaaacagacccatg

SEQ ID NO: 18014 - DNA, 15 bp, Homo sapiens
aacaaacagacccat

SEQ ID NO: 18015 - DNA, 15 bp, Homo sapiens
taacaaacagaccca

SEQ ID NO: 18016 - DNA, 15 bp, Homo sapiens
ataacaaacagaccc

SEQ ID NO: 18017 - DNA, 15 bp, Homo sapiens
tataacaaacagacc

SEQ ID NO: 18018 - DNA, 15 bp, Homo sapiens
gtataacaaacagac

SEQ ID NO: 18019 - DNA, 15 bp, Homo sapiens
ggtataacaaacaga

SEQ ID NO: 18020 - DNA, 15 bp, Homo sapiens
tggtataacaaacag

SEQ ID NO: 18021 - DNA, 15 bp, Homo sapiens
ttggtataacaaaca

SEQ ID NO: 18022 - DNA, 15 bp, Homo sapiens
gttggtataacaaac

SEQ ID NO: 18023 - DNA, 15 bp, Homo sapiens
tgttggtataacaaa

SEQ ID NO: 18024 - DNA, 15 bp, Homo sapiens
gtgttggtataacaa

SEQ ID NO: 18025 - DNA, 15 bp, Homo sapiens
agtgttggtataaca

SEQ ID NO: 18026 - DNA, 15 bp, Homo sapiens
gagtgttggtataac

SEQ ID NO: 18027 - DNA, 15 bp, Homo sapiens
tgagtgttggtataa

SEQ ID NO: 18028 - DNA, 15 bp, Homo sapiens
ttgagtgttggtata

SEQ ID NO: 18029 - DNA, 15 bp, Homo sapiens
attgagtgttggtat

SEQ ID NO: 18030 - DNA, 15 bp, Homo sapiens
aattgagtgttggta

SEQ ID NO: 18031 - DNA, 15 bp, Homo sapiens
gaattgagtgttggt

SEQ ID NO: 18032 - DNA, 15 bp, Homo sapiens
agaattgagtgttgg

SEQ ID NO: 18033 - DNA, 15 bp, Homo sapiens
cagaattgagtgttg

SEQ ID NO: 18034 - DNA, 15 bp, Homo sapiens
tcagaattgagtgtt

SEQ ID NO: 18035 - DNA, 15 bp, Homo sapiens
ttcagaattgagtgt

SEQ ID NO: 18036 - DNA, 15 bp, Homo sapiens
attcagaattgagtg

SEQ ID NO: 18037 - DNA, 15 bp, Homo sapiens
cattcagaattgagt

SEQ ID NO: 18038 - DNA, 15 bp, Homo sapiens
tcattcagaattgag

SEQ ID NO: 18039 - DNA, 15 bp, Homo sapiens
atcattcagaattga

SEQ ID NO: 18040 - DNA, 15 bp, Homo sapiens
catcattcagaattg

SEQ ID NO: 18041 - DNA, 15 bp, Homo sapiens
ccatcattcagaatt

SEQ ID NO: 18042 - DNA, 15 bp, Homo sapiens
tccatcattcagaat

SEQ ID NO: 18043 - DNA, 15 bp, Homo sapiens
ttccatcattcagaa

SEQ ID NO: 18044 - DNA, 15 bp, Homo sapiens
attccatcattcaga

SEQ ID NO: 18045 - DNA, 15 bp, Homo sapiens
aattccatcattcag

SEQ ID NO: 18046 - DNA, 15 bp, Homo sapiens
taattccatcattca

SEQ ID NO: 18047 - DNA, 15 bp, Homo sapiens
ataattccatcattc

SEQ ID NO: 18048 - DNA, 15 bp, Homo sapiens
aataattccatcatt

SEQ ID NO: 18049 - DNA, 15 bp, Homo sapiens
aaataattccatcat

SEQ ID NO: 18050 - DNA, 15 bp, Homo sapiens
gaaataattccatca

SEQ ID NO: 18051 - DNA, 15 bp, Homo sapiens
tgaaataattccatc

SEQ ID NO: 18052 - DNA, 15 bp, Homo sapiens
gtgaaataattccat

SEQ ID NO: 18053 - DNA, 15 bp, Homo sapiens
tgtgaaataattcca

SEQ ID NO: 18054 - DNA, 15 bp, Homo sapiens
atgtgaaataattcc

SEQ ID NO: 18055 - DNA, 15 bp, Homo sapiens
aatgtgaaataattc

SEQ ID NO: 18056 - DNA, 15 bp, Homo sapiens
aaatgtgaaataatt

SEQ ID NO: 18057 - DNA, 15 bp, Homo sapiens
taaatgtgaaataat

SEQ ID NO: 18058 - DNA, 15 bp, Homo sapiens
ctaaatgtgaaataa

SEQ ID NO: 18059 - DNA, 15 bp, Homo sapiens
actaaatgtgaaata

SEQ ID NO: 18060 - DNA, 15 bp, Homo sapiens
gactaaatgtgaaat

SEQ ID NO: 18061 - DNA, 15 bp, Homo sapiens
agactaaatgtgaaa

SEQ ID NO: 18062 - DNA, 15 bp, Homo sapiens
gagactaaatgtgaa

SEQ ID NO: 18063 - DNA, 15 bp, Homo sapiens
agagactaaatgtga

SEQ ID NO: 18064 - DNA, 15 bp, Homo sapiens
aagagactaaatgtg

SEQ ID NO: 18065 - DNA, 15 bp, Homo sapiens
aaagagactaaatgt

SEQ ID NO: 18066 - DNA, 15 bp, Homo sapiens
aaaagagactaaatg

SEQ ID NO: 18067 - DNA, 15 bp, Homo sapiens
aaaaagagactaaat

SEQ ID NO: 18068 - DNA, 15 bp, Homo sapiens
gaaaaagagactaaa

SEQ ID NO: 18069 - DNA, 15 bp, Homo sapiens
tgaaaaagagactaa

SEQ ID NO: 18070 - DNA, 15 bp, Homo sapiens
atgaaaaagagacta

SEQ ID NO: 18071 - DNA, 15 bp, Homo sapiens
gatgaaaaagagact

SEQ ID NO: 18072 - DNA, 15 bp, Homo sapiens
agatgaaaaagagac

SEQ ID NO: 18073 - DNA, 15 bp, Homo sapiens
tagatgaaaaagaga

SEQ ID NO: 18074 - DNA, 15 bp, Homo sapiens
ctagatgaaaaagag

SEQ ID NO: 18075 - DNA, 15 bp, Homo sapiens
gctagatgaaaaaga

SEQ ID NO: 18076 - DNA, 15 bp, Homo sapiens
ggctagatgaaaaag

SEQ ID NO: 18077 - DNA, 15 bp, Homo sapiens
tggctagatgaaaaa

SEQ ID NO: 18078 - DNA, 15 bp, Homo sapiens
atggctagatgaaaa

SEQ ID NO: 18079 - DNA, 15 bp, Homo sapiens
aatggctagatgaaa

SEQ ID NO: 18080 - DNA, 15 bp, Homo sapiens
taatggctagatgaa

SEQ ID NO: 18081 - DNA, 15 bp, Homo sapiens
ataatggctagatga

SEQ ID NO: 18082 - DNA, 15 bp, Homo sapiens
tataatggctagatg

SEQ ID NO: 18083 - DNA, 15 bp, Homo sapiens
ctataatggctagat

SEQ ID NO: 18084 - DNA, 15 bp, Homo sapiens
actataatggctaga

SEQ ID NO: 18085 - DNA, 15 bp, Homo sapiens
aactataatggctag

SEQ ID NO: 18086 - DNA, 15 bp, Homo sapiens
aaactataatggcta

SEQ ID NO: 18087 - DNA, 15 bp, Homo sapiens
taaactataatggct

SEQ ID NO: 18088 - DNA, 15 bp, Homo sapiens
ctaaactataatggc

SEQ ID NO: 18089 - DNA, 15 bp, Homo sapiens
actaaactataatgg

SEQ ID NO: 18090 - DNA, 15 bp, Homo sapiens
aactaaactataatg

SEQ ID NO: 18091 - DNA, 15 bp, Homo sapiens
aaactaaactataat

SEQ ID NO: 18092 - DNA, 15 bp, Homo sapiens
taaactaaactataa

SEQ ID NO: 18093 - DNA, 15 bp, Homo sapiens
ttaaactaaactata

SEQ ID NO: 18094 - DNA, 15 bp, Homo sapiens
tttaaactaaactat

SEQ ID NO: 18095 - DNA, 15 bp, Homo sapiens
gtttaaactaaacta

SEQ ID NO: 18096 - DNA, 15 bp, Homo sapiens
tgtttaaactaaact

SEQ ID NO: 18097 - DNA, 15 bp, Homo sapiens
gtgtttaaactaaac

SEQ ID NO: 18098 - DNA, 15 bp, Homo sapiens
ggtgtttaaactaaa

SEQ ID NO: 18099 - DNA, 15 bp, Homo sapiens
tggtgtttaaactaa

SEQ ID NO: 18100 - DNA, 15 bp, Homo sapiens
ttggtgtttaaacta

SEQ ID NO: 18101 - DNA, 15 bp, Homo sapiens
cttggtgtttaaact

SEQ ID NO: 18102 - DNA, 15 bp, Homo sapiens
acttggtgtttaaac

SEQ ID NO: 18103 - DNA, 15 bp, Homo sapiens
aacttggtgtttaaa

SEQ ID NO: 18104 - DNA, 15 bp, Homo sapiens
gaacttggtgtttaa

SEQ ID NO: 18105 - DNA, 15 bp, Homo sapiens
ggaacttggtgttta

SEQ ID NO: 18106 - DNA, 15 bp, Homo sapiens
tggaacttggtgttt

SEQ ID NO: 18107 - DNA, 15 bp, Homo sapiens
atggaacttggtgtt

SEQ ID NO: 18108 - DNA, 15 bp, Homo sapiens
aatggaacttggtgt

SEQ ID NO: 18109 - DNA, 15 bp, Homo sapiens
gaatggaacttggtg

SEQ ID NO: 18110 - DNA, 15 bp, Homo sapiens
ggaatggaacttggt

SEQ ID NO: 18111 - DNA, 15 bp, Homo sapiens
aggaatggaacttgg

SEQ ID NO: 18112 - DNA, 15 bp, Homo sapiens
caggaatggaacttg

SEQ ID NO: 18113 - DNA, 15 bp, Homo sapiens
gcaggaatggaactt

SEQ ID NO: 18114 - DNA, 15 bp, Homo sapiens
agcaggaatggaact

SEQ ID NO: 18115 - DNA, 15 bp, Homo sapiens
cagcaggaatggaac

SEQ ID NO: 18116 - DNA, 15 bp, Homo sapiens
gcagcaggaatggaa

SEQ ID NO: 18117 - DNA, 15 bp, Homo sapiens
tgcagcaggaatgga

SEQ ID NO: 18118 - DNA, 15 bp, Homo sapiens
atgcagcaggaatgg

SEQ ID NO: 18119 - DNA, 15 bp, Homo sapiens
catgcagcaggaatg

SEQ ID NO: 18120 - DNA, 15 bp, Homo sapiens
gcatgcagcaggaat

SEQ ID NO: 18121 - DNA, 15 bp, Homo sapiens
agcatgcagcaggaa

SEQ ID NO: 18122 - DNA, 15 bp, Homo sapiens
cagcatgcagcagga

SEQ ID NO: 18123 - DNA, 15 bp, Homo sapiens
tcagcatgcagcagg

SEQ ID NO: 18124 - DNA, 15 bp, Homo sapiens
ttcagcatgcagcag

SEQ ID NO: 18125 - DNA, 15 bp, Homo sapiens
cttcagcatgcagca

SEQ ID NO: 18126 - DNA, 15 bp, Homo sapiens
ccttcagcatgcagc

SEQ ID NO: 18127 - DNA, 15 bp, Homo sapiens
tccttcagcatgcag

SEQ ID NO: 18128 - DNA, 15 bp, Homo sapiens
atccttcagcatgca

SEQ ID NO: 18129 - DNA, 15 bp, Homo sapiens
aatccttcagcatgc

SEQ ID NO: 18130 - DNA, 15 bp, Homo sapiens
aaatccttcagcatg

SEQ ID NO: 18131 - DNA, 15 bp, Homo sapiens
caaatccttcagcat

SEQ ID NO: 18132 - DNA, 15 bp, Homo sapiens
gcaaatccttcagca

SEQ ID NO: 18133 - DNA, 15 bp, Homo sapiens
tgcaaatccttcagc

SEQ ID NO: 18134 - DNA, 15 bp, Homo sapiens
ctgcaaatccttcag

SEQ ID NO: 18135 - DNA, 15 bp, Homo sapiens
actgcaaatccttca

SEQ ID NO: 18136 - DNA, 15 bp, Homo sapiens
tactgcaaatccttc

SEQ ID NO: 18137 - DNA, 15 bp, Homo sapiens
gtactgcaaatcctt

SEQ ID NO: 18138 - DNA, 15 bp, Homo sapiens
tgtactgcaaatcct

SEQ ID NO: 18139 - DNA, 15 bp, Homo sapiens
atgtactgcaaatcc

SEQ ID NO: 18140 - DNA, 15 bp, Homo sapiens
gatgtactgcaaatc

SEQ ID NO: 18141 - DNA, 15 bp, Homo sapiens
tgatgtactgcaaat

SEQ ID NO: 18142 - DNA, 15 bp, Homo sapiens
ctgatgtactgcaaa

SEQ ID NO: 18143 - DNA, 15 bp, Homo sapiens
cctgatgtactgcaa

SEQ ID NO: 18144 - DNA, 15 bp, Homo sapiens
gcctgatgtactgca

SEQ ID NO: 18145 - DNA, 15 bp, Homo sapiens
agcctgatgtactgc

SEQ ID NO: 18146 - DNA, 15 bp, Homo sapiens
tagcctgatgtactg

SEQ ID NO: 18147 - DNA, 15 bp, Homo sapiens
atagcctgatgtact

SEQ ID NO: 18148 - DNA, 15 bp, Homo sapiens
tatagcctgatgtac

SEQ ID NO: 18149 - DNA, 15 bp, Homo sapiens
ctatagcctgatgta

SEQ ID NO: 18150 - DNA, 15 bp, Homo sapiens
actatagcctgatgt

SEQ ID NO: 18151 - DNA, 15 bp, Homo sapiens
gactatagcctgatg

SEQ ID NO: 18152 - DNA, 15 bp, Homo sapiens
ggactatagcctgat

SEQ ID NO: 18153 - DNA, 15 bp, Homo sapiens
tggactatagcctga

SEQ ID NO: 18154 - DNA, 15 bp, Homo sapiens
atggactatagcctg

SEQ ID NO: 18155 - DNA, 15 bp, Homo sapiens
gatggactatagcct

SEQ ID NO: 18156 - DNA, 15 bp, Homo sapiens
tgatggactatagcc

SEQ ID NO: 18157 - DNA, 15 bp, Homo sapiens
ttgatggactatagc

SEQ ID NO: 18158 - DNA, 15 bp, Homo sapiens
attgatggactatag

SEQ ID NO: 18159 - DNA, 15 bp, Homo sapiens
aattgatggactata

SEQ ID NO: 18160 - DNA, 15 bp, Homo sapiens
gaattgatggactat

SEQ ID NO: 18161 - DNA, 15 bp, Homo sapiens
tgaattgatggacta

SEQ ID NO: 18162 - DNA, 15 bp, Homo sapiens
atgaattgatggact

SEQ ID NO: 18163 - DNA, 15 bp, Homo sapiens
aatgaattgatggac

SEQ ID NO: 18164 - DNA, 15 bp, Homo sapiens
gaatgaattgatgga

SEQ ID NO: 18165 - DNA, 15 bp, Homo sapiens
ggaatgaattgatgg

SEQ ID NO: 18166 - DNA, 15 bp, Homo sapiens
tggaatgaattgatg

SEQ ID NO: 18167 - DNA, 15 bp, Homo sapiens
gtggaatgaattgat

SEQ ID NO: 18168 - DNA, 15 bp, Homo sapiens
tgtggaatgaattga

SEQ ID NO: 18169 - DNA, 15 bp, Homo sapiens
ttgtggaatgaattg

SEQ ID NO: 18170 - DNA, 15 bp, Homo sapiens
attgtggaatgaatt

SEQ ID NO: 18171 - DNA, 15 bp, Homo sapiens
aattgtggaatgaat

SEQ ID NO: 18172 - DNA, 15 bp, Homo sapiens
caattgtggaatgaa

SEQ ID NO: 18173 - DNA, 15 bp, Homo sapiens
tcaattgtggaatga

SEQ ID NO: 18174 - DNA, 15 bp, Homo sapiens
ctcaattgtggaatg

SEQ ID NO: 18175 - DNA, 15 bp, Homo sapiens
actcaattgtggaat

SEQ ID NO: 18176 - DNA, 15 bp, Homo sapiens
tactcaattgtggaa

SEQ ID NO: 18177 - DNA, 15 bp, Homo sapiens
ttactcaattgtgga

SEQ ID NO: 18178 - DNA, 15 bp, Homo sapiens
cttactcaattgtgg

SEQ ID NO: 18179 - DNA, 15 bp, Homo sapiens
acttactcaattgtg

SEQ ID NO: 18180 - DNA, 15 bp, Homo sapiens
tacttactcaattgt

SEQ ID NO: 18181 - DNA, 15 bp, Homo sapiens
ttacttactcaattg

SEQ ID NO: 18182 - DNA, 15 bp, Homo sapiens
cttacttactcaatt

SEQ ID NO: 18183 - DNA, 15 bp, Homo sapiens
ccttacttactcaat

SEQ ID NO: 18184 - DNA, 15 bp, Homo sapiens
accttacttactcaa

SEQ ID NO: 18185 - DNA, 15 bp, Homo sapiens
taccttacttactca

SEQ ID NO: 18186 - DNA, 15 bp, Homo sapiens
ataccttacttactc

SEQ ID NO: 18187 - DNA, 15 bp, Homo sapiens
gataccttacttact

SEQ ID NO: 18188 - DNA, 15 bp, Homo sapiens
agataccttacttac

SEQ ID NO: 18189 - DNA, 15 bp, Homo sapiens
tagataccttactta

SEQ ID NO: 18190 - DNA, 15 bp, Homo sapiens
atagataccttactt

SEQ ID NO: 18191 - DNA, 15 bp, Homo sapiens
tatagataccttact

SEQ ID NO: 18192 - DNA, 15 bp, Homo sapiens
ctatagataccttac

SEQ ID NO: 18193 - DNA, 15 bp, Homo sapiens
actatagatacctta

SEQ ID NO: 18194 - DNA, 15 bp, Homo sapiens
tactatagatacctt

SEQ ID NO: 18195 - DNA, 15 bp, Homo sapiens
gtactatagatacct

SEQ ID NO: 18196 - DNA, 15 bp, Homo sapiens
ggtactatagatacc

SEQ ID NO: 18197 - DNA, 15 bp, Homo sapiens
aggtactatagatac

SEQ ID NO: 18198 - DNA, 15 bp, Homo sapiens
gaggtactatagata

SEQ ID NO: 18199 - DNA, 15 bp, Homo sapiens
tgaggtactatagat

SEQ ID NO: 18200 - DNA, 15 bp, Homo sapiens
ctgaggtactataga

SEQ ID NO: 18201 - DNA, 15 bp, Homo sapiens
cctgaggtactatag

SEQ ID NO: 18202 - DNA, 15 bp, Homo sapiens
gcctgaggtactata

SEQ ID NO: 18203 - DNA, 15 bp, Homo sapiens
ggcctgaggtactat

SEQ ID NO: 18204 - DNA, 15 bp, Homo sapiens
gggcctgaggtacta

SEQ ID NO: 18205 - DNA, 15 bp, Homo sapiens
agggcctgaggtact

SEQ ID NO: 18206 - DNA, 15 bp, Homo sapiens
cagggcctgaggtac

SEQ ID NO: 18207 - DNA, 15 bp, Homo sapiens
acagggcctgaggta

SEQ ID NO: 18208 - DNA, 15 bp, Homo sapiens
cacagggcctgaggt

SEQ ID NO: 18209 - DNA, 15 bp, Homo sapiens
acacagggcctgagg

SEQ ID NO: 18210 - DNA, 15 bp, Homo sapiens
aacacagggcctgag

SEQ ID NO: 18211 - DNA, 15 bp, Homo sapiens
taacacagggcctga

SEQ ID NO: 18212 - DNA, 15 bp, Homo sapiens
ctaacacagggcctg

SEQ ID NO: 18213 - DNA, 15 bp, Homo sapiens
cctaacacagggcct

SEQ ID NO: 18214 - DNA, 15 bp, Homo sapiens
gcctaacacagggcc

SEQ ID NO: 18215 - DNA, 15 bp, Homo sapiens
tgcctaacacagggc

SEQ ID NO: 18216 - DNA, 15 bp, Homo sapiens
ctgcctaacacaggg

SEQ ID NO: 18217 - DNA, 15 bp, Homo sapiens
cctgcctaacacagg

SEQ ID NO: 18218 - DNA, 15 bp, Homo sapiens
ccctgcctaacacag

SEQ ID NO: 18219 - DNA, 15 bp, Homo sapiens
tccctgcctaacaca

SEQ ID NO: 18220 - DNA, 15 bp, Homo sapiens
atccctgcctaacac

SEQ ID NO: 18221 - DNA, 15 bp, Homo sapiens
catccctgcctaaca

SEQ ID NO: 18222 - DNA, 15 bp, Homo sapiens
ccatccctgcctaac

SEQ ID NO: 18223 - DNA, 15 bp, Homo sapiens
cccatccctgcctaa

SEQ ID NO: 18224 - DNA, 15 bp, Homo sapiens
ccccatccctgccta

SEQ ID NO: 18225 - DNA, 15 bp, Homo sapiens
accccatccctgcct

SEQ ID NO: 18226 - DNA, 15 bp, Homo sapiens
taccccatccctgcc

SEQ ID NO: 18227 - DNA, 15 bp, Homo sapiens
ttaccccatccctgc

SEQ ID NO: 18228 - DNA, 15 bp, Homo sapiens
gttaccccatccctg

SEQ ID NO: 18229 - DNA, 15 bp, Homo sapiens
ggttaccccatccct

SEQ ID NO: 18230 - DNA, 15 bp, Homo sapiens
aggttaccccatccc

SEQ ID NO: 18231 - DNA, 15 bp, Homo sapiens
taggttaccccatcc

SEQ ID NO: 18232 - DNA, 15 bp, Homo sapiens
ctaggttaccccatc

SEQ ID NO: 18233 - DNA, 15 bp, Homo sapiens
tctaggttaccccat

SEQ ID NO: 18234 - DNA, 15 bp, Homo sapiens
gtctaggttacccca

SEQ ID NO: 18235 - DNA, 15 bp, Homo sapiens
tgtctaggttacccc

SEQ ID NO: 18236 - DNA, 15 bp, Homo sapiens
ctgtctaggttaccc

SEQ ID NO: 18237 - DNA, 15 bp, Homo sapiens
tctgtctaggttacc

SEQ ID NO: 18238 - DNA, 15 bp, Homo sapiens
atctgtctaggttac

SEQ ID NO: 18239 - DNA, 15 bp, Homo sapiens
aatctgtctaggtta

SEQ ID NO: 18240 - DNA, 15 bp, Homo sapiens
aaatctgtctaggtt

SEQ ID NO: 18241 - DNA, 15 bp, Homo sapiens
caaatctgtctaggt

SEQ ID NO: 18242 - DNA, 15 bp, Homo sapiens
ccaaatctgtctagg

SEQ ID NO: 18243 - DNA, 15 bp, Homo sapiens
accaaatctgtctag

SEQ ID NO: 18244 - DNA, 15 bp, Homo sapiens
taccaaatctgtcta

SEQ ID NO: 18245 - DNA, 15 bp, Homo sapiens
gtaccaaatctgtct

SEQ ID NO: 18246 - DNA, 15 bp, Homo sapiens
ggtaccaaatctgtc

SEQ ID NO: 18247 - DNA, 15 bp, Homo sapiens
aggtaccaaatctgt

SEQ ID NO: 18248 - DNA, 15 bp, Homo sapiens
caggtaccaaatctg

SEQ ID NO: 18249 - DNA, 15 bp, Homo sapiens
acaggtaccaaatct

SEQ ID NO: 18250 - DNA, 15 bp, Homo sapiens
gacaggtaccaaatc

SEQ ID NO: 18251 - DNA, 15 bp, Homo sapiens
ggacaggtaccaaat

SEQ ID NO: 18252 - DNA, 15 bp, Homo sapiens
aggacaggtaccaaa

SEQ ID NO: 18253 - DNA, 15 bp, Homo sapiens
gaggacaggtaccaa

SEQ ID NO: 18254 - DNA, 15 bp, Homo sapiens
tgaggacaggtacca

SEQ ID NO: 18255 - DNA, 15 bp, Homo sapiens
atgaggacaggtacc

SEQ ID NO: 18256 - DNA, 15 bp, Homo sapiens
catgaggacaggtac

SEQ ID NO: 18257 - DNA, 15 bp, Homo sapiens
ccatgaggacaggta

SEQ ID NO: 18258 - DNA, 15 bp, Homo sapiens
tccatgaggacaggt

SEQ ID NO: 18259 - DNA, 15 bp, Homo sapiens
ctccatgaggacagg

SEQ ID NO: 18260 - DNA, 15 bp, Homo sapiens
gctccatgaggacag

SEQ ID NO: 18261 - DNA, 15 bp, Homo sapiens
agctccatgaggaca

SEQ ID NO: 18262 - DNA, 15 bp, Homo sapiens
aagctccatgaggac

SEQ ID NO: 18263 - DNA, 15 bp, Homo sapiens
caagctccatgagga

SEQ ID NO: 18264 - DNA, 15 bp, Homo sapiens
tcaagctccatgagg

SEQ ID NO: 18265 - DNA, 15 bp, Homo sapiens
gtcaagctccatgag

SEQ ID NO: 18266 - DNA, 15 bp, Homo sapiens
agtcaagctccatga

SEQ ID NO: 18267 - DNA, 15 bp, Homo sapiens
aagtcaagctccatg

SEQ ID NO: 18268 - DNA, 15 bp, Homo sapiens
aaagtcaagctccat

SEQ ID NO: 18269 - DNA, 15 bp, Homo sapiens
taaagtcaagctcca

SEQ ID NO: 18270 - DNA, 15 bp, Homo sapiens
ctaaagtcaagctcc

SEQ ID NO: 18271 - DNA, 15 bp, Homo sapiens
gctaaagtcaagctc

SEQ ID NO: 18272 - DNA, 15 bp, Homo sapiens
cgctaaagtcaagct

SEQ ID NO: 18273 - DNA, 15 bp, Homo sapiens
ccgctaaagtcaagc

SEQ ID NO: 18274 - DNA, 15 bp, Homo sapiens
gccgctaaagtcaag

SEQ ID NO: 18275 - DNA, 15 bp, Homo sapiens
tgccgctaaagtcaa

SEQ ID NO: 18276 - DNA, 15 bp, Homo sapiens
ctgccgctaaagtca

SEQ ID NO: 18277 - DNA, 15 bp, Homo sapiens
tctgccgctaaagtc

SEQ ID NO: 18278 - DNA, 15 bp, Homo sapiens
ctctgccgctaaagt

SEQ ID NO: 18279 - DNA, 15 bp, Homo sapiens
tctctgccgctaaag

SEQ ID NO: 18280 - DNA, 15 bp, Homo sapiens
gtctctgccgctaaa

SEQ ID NO: 18281 - DNA, 15 bp, Homo sapiens
tgtctctgccgctaa

SEQ ID NO: 18282 - DNA, 15 bp, Homo sapiens
ctgtctctgccgcta

SEQ ID NO: 18283 - DNA, 15 bp, Homo sapiens
tctgtctctgccgct

SEQ ID NO: 18284 - DNA, 15 bp, Homo sapiens
atctgtctctgccgc

SEQ ID NO: 18285 - DNA, 15 bp, Homo sapiens
gatctgtctctgccg

SEQ ID NO: 18286 - DNA, 15 bp, Homo sapiens
agatctgtctctgcc

SEQ ID NO: 18287 - DNA, 15 bp, Homo sapiens
aagatctgtctctgc

SEQ ID NO: 18288 - DNA, 15 bp, Homo sapiens
taagatctgtctctg

SEQ ID NO: 18289 - DNA, 15 bp, Homo sapiens
ctaagatctgtctct

SEQ ID NO: 18290 - DNA, 15 bp, Homo sapiens
tctaagatctgtctc

SEQ ID NO: 18291 - DNA, 15 bp, Homo sapiens
atctaagatctgtct

SEQ ID NO: 18292 - DNA, 15 bp, Homo sapiens
tatctaagatctgtc

SEQ ID NO: 18293 - DNA, 15 bp, Homo sapiens
ttatctaagatctgt

SEQ ID NO: 18294 - DNA, 15 bp, Homo sapiens
attatctaagatctg

SEQ ID NO: 18295 - DNA, 15 bp, Homo sapiens
aattatctaagatct

SEQ ID NO: 18296 - DNA, 15 bp, Homo sapiens
caattatctaagatc

SEQ ID NO: 18297 - DNA, 15 bp, Homo sapiens
acaattatctaagat

SEQ ID NO: 18298 - DNA, 15 bp, Homo sapiens
tacaattatctaaga

SEQ ID NO: 18299 - DNA, 15 bp, Homo sapiens
gtacaattatctaag

SEQ ID NO: 18300 - DNA, 15 bp, Homo sapiens
ggtacaattatctaa

SEQ ID NO: 18301 - DNA, 15 bp, Homo sapiens
tggtacaattatcta

SEQ ID NO: 18302 - DNA, 15 bp, Homo sapiens
ctggtacaattatct

SEQ ID NO: 18303 - DNA, 15 bp, Homo sapiens
actggtacaattatc

SEQ ID NO: 18304 - DNA, 15 bp, Homo sapiens
tactggtacaattat

SEQ ID NO: 18305 - DNA, 15 bp, Homo sapiens
gtactggtacaatta

SEQ ID NO: 18306 - DNA, 15 bp, Homo sapiens
agtactggtacaatt

SEQ ID NO: 18307 - DNA, 15 bp, Homo sapiens
aagtactggtacaat

SEQ ID NO: 18308 - DNA, 15 bp, Homo sapiens
taagtactggtacaa

SEQ ID NO: 18309 - DNA, 15 bp, Homo sapiens
ttaagtactggtaca

SEQ ID NO: 18310 - DNA, 15 bp, Homo sapiens
cttaagtactggtac

SEQ ID NO: 18311 - DNA, 15 bp, Homo sapiens
acttaagtactggta

SEQ ID NO: 18312 - DNA, 15 bp, Homo sapiens
cacttaagtactggt

SEQ ID NO: 18313 - DNA, 15 bp, Homo sapiens
acacttaagtactgg

SEQ ID NO: 18314 - DNA, 15 bp, Homo sapiens
aacacttaagtactg

SEQ ID NO: 18315 - DNA, 15 bp, Homo sapiens
gaacacttaagtact

SEQ ID NO: 18316 - DNA, 15 bp, Homo sapiens
tgaacacttaagtac

SEQ ID NO: 18317 - DNA, 15 bp, Homo sapiens
ctgaacacttaagta

SEQ ID NO: 18318 - DNA, 15 bp, Homo sapiens
tctgaacacttaagt

SEQ ID NO: 18319 - DNA, 15 bp, Homo sapiens
ttctgaacacttaag

SEQ ID NO: 18320 - DNA, 15 bp, Homo sapiens
cttctgaacacttaa

SEQ ID NO: 18321 - DNA, 15 bp, Homo sapiens
ccttctgaacactta

SEQ ID NO: 18322 - DNA, 15 bp, Homo sapiens
tccttctgaacactt

SEQ ID NO: 18323 - DNA, 15 bp, Homo sapiens
gtccttctgaacact

SEQ ID NO: 18324 - DNA, 15 bp, Homo sapiens
tgtccttctgaacac

SEQ ID NO: 18325 - DNA, 15 bp, Homo sapiens
ttgtccttctgaaca

SEQ ID NO: 18326 - DNA, 15 bp, Homo sapiens
cttgtccttctgaac

SEQ ID NO: 18327 - DNA, 15 bp, Homo sapiens
acttgtccttctgaa

SEQ ID NO: 18328 - DNA, 15 bp, Homo sapiens
tacttgtccttctga

SEQ ID NO: 18329 - DNA, 15 bp, Homo sapiens
atacttgtccttctg

SEQ ID NO: 18330 - DNA, 15 bp, Homo sapiens
catacttgtccttct

SEQ ID NO: 18331 - DNA, 15 bp, Homo sapiens
ccatacttgtccttc

SEQ ID NO: 18332 - DNA, 15 bp, Homo sapiens
tccatacttgtcctt

SEQ ID NO: 18333 - DNA, 15 bp, Homo sapiens
ctccatacttgtcct

SEQ ID NO: 18334 - DNA, 15 bp, Homo sapiens
cctccatacttgtcc

SEQ ID NO: 18335 - DNA, 15 bp, Homo sapiens
acctccatacttgtc

SEQ ID NO: 18336 - DNA, 15 bp, Homo sapiens
cacctccatacttgt

SEQ ID NO: 18337 - DNA, 15 bp, Homo sapiens
ccacctccatacttg

SEQ ID NO: 18338 - DNA, 15 bp, Homo sapiens
cccacctccatactt

SEQ ID NO: 18339 - DNA, 15 bp, Homo sapiens
tcccacctccatact

SEQ ID NO: 18340 - DNA, 15 bp, Homo sapiens
ctcccacctccatac

SEQ ID NO: 18341 - DNA, 15 bp, Homo sapiens
gctcccacctccata

SEQ ID NO: 18342 - DNA, 15 bp, Homo sapiens
ggctcccacctccat

SEQ ID NO: 18343 - DNA, 15 bp, Homo sapiens
tggctcccacctcca

SEQ ID NO: 18344 - DNA, 15 bp, Homo sapiens
gtggctcccacctcc

SEQ ID NO: 18345 - DNA, 15 bp, Homo sapiens
agtggctcccacctc

SEQ ID NO: 18346 - DNA, 15 bp, Homo sapiens
gagtggctcccacct

SEQ ID NO: 18347 - DNA, 15 bp, Homo sapiens
ggagtggctcccacc

SEQ ID NO: 18348 - DNA, 15 bp, Homo sapiens
tggagtggctcccac

SEQ ID NO: 18349 - DNA, 15 bp, Homo sapiens
ctggagtggctccca

SEQ ID NO: 18350 - DNA, 15 bp, Homo sapiens
actggagtggctccc

SEQ ID NO: 18351 - DNA, 15 bp, Homo sapiens
gactggagtggctcc

SEQ ID NO: 18352 - DNA, 15 bp, Homo sapiens
ggactggagtggctc

SEQ ID NO: 18353 - DNA, 15 bp, Homo sapiens
aggactggagtggct

SEQ ID NO: 18354 - DNA, 15 bp, Homo sapiens
gaggactggagtggc

SEQ ID NO: 18355 - DNA, 15 bp, Homo sapiens
agaggactggagtgg

SEQ ID NO: 18356 - DNA, 15 bp, Homo sapiens
tagaggactggagtg

SEQ ID NO: 18357 - DNA, 15 bp, Homo sapiens
gtagaggactggagt

SEQ ID NO: 18358 - DNA, 15 bp, Homo sapiens
tgtagaggactggag

SEQ ID NO: 18359 - DNA, 15 bp, Homo sapiens
ctgtagaggactgga

SEQ ID NO: 18360 - DNA, 15 bp, Homo sapiens
actgtagaggactgg

SEQ ID NO: 18361 - DNA, 15 bp, Homo sapiens
gactgtagaggactg

SEQ ID NO: 18362 - DNA, 15 bp, Homo sapiens
tgactgtagaggact

SEQ ID NO: 18363 - DNA, 15 bp, Homo sapiens
gtgactgtagaggac

SEQ ID NO: 18364 - DNA, 15 bp, Homo sapiens
cgtgactgtagagga

SEQ ID NO: 18365 - DNA, 15 bp, Homo sapiens
acgtgactgtagagg

SEQ ID NO: 18366 - DNA, 15 bp, Homo sapiens
cacgtgactgtagag

SEQ ID NO: 18367 - DNA, 15 bp, Homo sapiens
gcacgtgactgtaga

SEQ ID NO: 18368 - DNA, 15 bp, Homo sapiens
agcacgtgactgtag

SEQ ID NO: 18369 - DNA, 15 bp, Homo sapiens
cagcacgtgactgta

SEQ ID NO: 18370 - DNA, 15 bp, Homo sapiens
gcagcacgtgactgt

SEQ ID NO: 18371 - DNA, 15 bp, Homo sapiens
tgcagcacgtgactg

SEQ ID NO: 18372 - DNA, 15 bp, Homo sapiens
gtgcagcacgtgact

SEQ ID NO: 18373 - DNA, 15 bp, Homo sapiens
tgtgcagcacgtgac

SEQ ID NO: 18374 - DNA, 15 bp, Homo sapiens
ttgtgcagcacgtga

SEQ ID NO: 18375 - DNA, 15 bp, Homo sapiens
gttgtgcagcacgtg

SEQ ID NO: 18376 - DNA, 15 bp, Homo sapiens
tgttgtgcagcacgt

SEQ ID NO: 18377 - DNA, 15 bp, Homo sapiens
ttgttgtgcagcacg

SEQ ID NO: 18378 - DNA, 15 bp, Homo sapiens
gttgttgtgcagcac

SEQ ID NO: 18379 - DNA, 15 bp, Homo sapiens
cgttgttgtgcagca

SEQ ID NO: 18380 - DNA, 15 bp, Homo sapiens
acgttgttgtgcagc

SEQ ID NO: 18381 - DNA, 15 bp, Homo sapiens
aacgttgttgtgcag

SEQ ID NO: 18382 - DNA, 15 bp, Homo sapiens
aaacgttgttgtgca

SEQ ID NO: 18383 - DNA, 15 bp, Homo sapiens
gaaacgttgttgtgc

SEQ ID NO: 18384 - DNA, 15 bp, Homo sapiens
tgaaacgttgttgtg

SEQ ID NO: 18385 - DNA, 15 bp, Homo sapiens
ttgaaacgttgttgt

SEQ ID NO: 18386 - DNA, 15 bp, Homo sapiens
gttgaaacgttgttg

SEQ ID NO: 18387 - DNA, 15 bp, Homo sapiens
ggttgaaacgttgtt

SEQ ID NO: 18388 - DNA, 15 bp, Homo sapiens
cggttgaaacgttgt

SEQ ID NO: 18389 - DNA, 15 bp, Homo sapiens
tcggttgaaacgttg

SEQ ID NO: 18390 - DNA, 15 bp, Homo sapiens
gtcggttgaaacgtt

SEQ ID NO: 18391 - DNA, 15 bp, Homo sapiens
tgtcggttgaaacgt

SEQ ID NO: 18392 - DNA, 15 bp, Homo sapiens
ttgtcggttgaaacg

SEQ ID NO: 18393 - DNA, 15 bp, Homo sapiens
gttgtcggttgaaac

SEQ ID NO: 18394 - DNA, 15 bp, Homo sapiens
tgttgtcggttgaaa

SEQ ID NO: 18395 - DNA, 15 bp, Homo sapiens
ctgttgtcggttgaa

SEQ ID NO: 18396 - DNA, 15 bp, Homo sapiens
tctgttgtcggttga

SEQ ID NO: 18397 - DNA, 15 bp, Homo sapiens
ctctgttgtcggttg

SEQ ID NO: 18398 - DNA, 15 bp, Homo sapiens
gctctgttgtcggtt

SEQ ID NO: 18399 - DNA, 15 bp, Homo sapiens
tgctctgttgtcggt

SEQ ID NO: 18400 - DNA, 15 bp, Homo sapiens
gtgctctgttgtcgg

SEQ ID NO: 18401 - DNA, 15 bp, Homo sapiens
tgtgctctgttgtcg

SEQ ID NO: 18402 - DNA, 15 bp, Homo sapiens
gtgtgctctgttgtc

SEQ ID NO: 18403 - DNA, 15 bp, Homo sapiens
tgtgtgctctgttgt

SEQ ID NO: 18404 - DNA, 15 bp, Homo sapiens
atgtgtgctctgttg

SEQ ID NO: 18405 - DNA, 15 bp, Homo sapiens
tatgtgtgctctgtt

SEQ ID NO: 18406 - DNA, 15 bp, Homo sapiens
gtatgtgtgctctgt

SEQ ID NO: 18407 - DNA, 15 bp, Homo sapiens
tgtatgtgtgctctg

SEQ ID NO: 18408 - DNA, 15 bp, Homo sapiens
ctgtatgtgtgctct

SEQ ID NO: 18409 - DNA, 15 bp, Homo sapiens
actgtatgtgtgctc

SEQ ID NO: 18410 - DNA, 15 bp, Homo sapiens
cactgtatgtgtgct

SEQ ID NO: 18411 - DNA, 15 bp, Homo sapiens
ccactgtatgtgtgc

SEQ ID NO: 18412 - DNA, 15 bp, Homo sapiens
accactgtatgtgtg

SEQ ID NO: 18413 - DNA, 15 bp, Homo sapiens
caccactgtatgtgt

SEQ ID NO: 18414 - DNA, 15 bp, Homo sapiens
acaccactgtatgtg

SEQ ID NO: 18415 - DNA, 15 bp, Homo sapiens
aacaccactgtatgt

SEQ ID NO: 18416 - DNA, 15 bp, Homo sapiens
gaacaccactgtatg

SEQ ID NO: 18417 - DNA, 15 bp, Homo sapiens
ggaacaccactgtat

SEQ ID NO: 18418 - DNA, 15 bp, Homo sapiens
gggaacaccactgta

SEQ ID NO: 18419 - DNA, 15 bp, Homo sapiens
tgggaacaccactgt

SEQ ID NO: 18420 - DNA, 15 bp, Homo sapiens
atgggaacaccactg

SEQ ID NO: 18421 - DNA, 15 bp, Homo sapiens
tatgggaacaccact

SEQ ID NO: 18422 - DNA, 15 bp, Homo sapiens
ttatgggaacaccac

SEQ ID NO: 18423 - DNA, 15 bp, Homo sapiens
cttatgggaacacca

SEQ ID NO: 18424 - DNA, 15 bp, Homo sapiens
tcttatgggaacacc

SEQ ID NO: 18425 - DNA, 15 bp, Homo sapiens
atcttatgggaacac

SEQ ID NO: 18426 - DNA, 15 bp, Homo sapiens
aatcttatgggaaca

SEQ ID NO: 18427 - DNA, 15 bp, Homo sapiens
taatcttatgggaac

SEQ ID NO: 18428 - DNA, 15 bp, Homo sapiens
ctaatcttatgggaa

SEQ ID NO: 18429 - DNA, 15 bp, Homo sapiens
tctaatcttatggga

SEQ ID NO: 18430 - DNA, 15 bp, Homo sapiens
ttctaatcttatggg

SEQ ID NO: 18431 - DNA, 15 bp, Homo sapiens
attctaatcttatgg

SEQ ID NO: 18432 - DNA, 15 bp, Homo sapiens
cattctaatcttatg

SEQ ID NO: 18433 - DNA, 15 bp, Homo sapiens
gcattctaatcttat

SEQ ID NO: 18434 - DNA, 15 bp, Homo sapiens
ggcattctaatctta

SEQ ID NO: 18435 - DNA, 15 bp, Homo sapiens
tggcattctaatctt

SEQ ID NO: 18436 - DNA, 15 bp, Homo sapiens
atggcattctaatct

SEQ ID NO: 18437 - DNA, 15 bp, Homo sapiens
tatggcattctaatc

SEQ ID NO: 18438 - DNA, 15 bp, Homo sapiens
atatggcattctaat

SEQ ID NO: 18439 - DNA, 15 bp, Homo sapiens
aatatggcattctaa

SEQ ID NO: 18440 - DNA, 15 bp, Homo sapiens
aaatatggcattcta

SEQ ID NO: 18441 - DNA, 15 bp, Homo sapiens
aaaatatggcattct

SEQ ID NO: 18442 - DNA, 15 bp, Homo sapiens
aaaaatatggcattc

SEQ ID NO: 18443 - DNA, 15 bp, Homo sapiens
taaaaatatggcatt

SEQ ID NO: 18444 - DNA, 15 bp, Homo sapiens
gtaaaaatatggcat

SEQ ID NO: 18445 - DNA, 15 bp, Homo sapiens
agtaaaaatatggca

SEQ ID NO: 18446 - DNA, 15 bp, Homo sapiens
cagtaaaaatatggc

SEQ ID NO: 18447 - DNA, 15 bp, Homo sapiens
acagtaaaaatatgg

SEQ ID NO: 18448 - DNA, 15 bp, Homo sapiens
tacagtaaaaatatg

SEQ ID NO: 18449 - DNA, 15 bp, Homo sapiens
gtacagtaaaaatat

SEQ ID NO: 18450 - DNA, 15 bp, Homo sapiens
ggtacagtaaaaata

SEQ ID NO: 18451 - DNA, 15 bp, Homo sapiens
aggtacagtaaaaat

SEQ ID NO: 18452 - DNA, 15 bp, Homo sapiens
aaggtacagtaaaaa

SEQ ID NO: 18453 - DNA, 15 bp, Homo sapiens
aaaggtacagtaaaa

SEQ ID NO: 18454 - DNA, 15 bp, Homo sapiens
aaaaggtacagtaaa

SEQ ID NO: 18455 - DNA, 15 bp, Homo sapiens
gaaaaggtacagtaa

SEQ ID NO: 18456 - DNA, 15 bp, Homo sapiens
agaaaaggtacagta

SEQ ID NO: 18457 - DNA, 15 bp, Homo sapiens
tagaaaaggtacagt

SEQ ID NO: 18458 - DNA, 15 bp, Homo sapiens
atagaaaaggtacag

SEQ ID NO: 18459 - DNA, 15 bp, Homo sapiens
catagaaaaggtaca

SEQ ID NO: 18460 - DNA, 15 bp, Homo sapiens
acatagaaaaggtac

SEQ ID NO: 18461 - DNA, 15 bp, Homo sapiens
aacatagaaaaggta

SEQ ID NO: 18462 - DNA, 15 bp, Homo sapiens
aaacatagaaaaggt

SEQ ID NO: 18463 - DNA, 15 bp, Homo sapiens
taaacatagaaaagg

SEQ ID NO: 18464 - DNA, 15 bp, Homo sapiens
ctaaacatagaaaag

SEQ ID NO: 18465 - DNA, 15 bp, Homo sapiens
tctaaacatagaaaa

SEQ ID NO: 18466 - DNA, 15 bp, Homo sapiens
atctaaacatagaaa

SEQ ID NO: 18467 - DNA, 15 bp, Homo sapiens
tatctaaacatagaa

SEQ ID NO: 18468 - DNA, 15 bp, Homo sapiens
atatctaaacataga

SEQ ID NO: 18469 - DNA, 15 bp, Homo sapiens
tatatctaaacatag

SEQ ID NO: 18470 - DNA, 15 bp, Homo sapiens
gtatatctaaacata

SEQ ID NO: 18471 - DNA, 15 bp, Homo sapiens
tgtatatctaaacat

SEQ ID NO: 18472 - DNA, 15 bp, Homo sapiens
ttgtatatctaaaca

SEQ ID NO: 18473 - DNA, 15 bp, Homo sapiens
tttgtatatctaaac

SEQ ID NO: 18474 - DNA, 15 bp, Homo sapiens
atttgtatatctaaa

SEQ ID NO: 18475 - DNA, 15 bp, Homo sapiens
tatttgtatatctaa

SEQ ID NO: 18476 - DNA, 15 bp, Homo sapiens
gtatttgtatatcta

SEQ ID NO: 18477 - DNA, 15 bp, Homo sapiens
agtatttgtatatct

SEQ ID NO: 18478 - DNA, 15 bp, Homo sapiens
aagtatttgtatatc

SEQ ID NO: 18479 - DNA, 15 bp, Homo sapiens
taagtatttgtatat

SEQ ID NO: 18480 - DNA, 15 bp, Homo sapiens
gtaagtatttgtata

SEQ ID NO: 18481 - DNA, 15 bp, Homo sapiens
ggtaagtatttgtat

SEQ ID NO: 18482 - DNA, 15 bp, Homo sapiens
tggtaagtatttgta

SEQ ID NO: 18483 - DNA, 15 bp, Homo sapiens
atggtaagtatttgt

SEQ ID NO: 18484 - DNA, 15 bp, Homo sapiens
aatggtaagtatttg

SEQ ID NO: 18485 - DNA, 15 bp, Homo sapiens
caatggtaagtattt

SEQ ID NO: 18486 - DNA, 15 bp, Homo sapiens
acaatggtaagtatt

SEQ ID NO: 18487 - DNA, 15 bp, Homo sapiens
cacaatggtaagtat

SEQ ID NO: 18488 - DNA, 15 bp, Homo sapiens
acacaatggtaagta

SEQ ID NO: 18489 - DNA, 15 bp, Homo sapiens
aacacaatggtaagt

SEQ ID NO: 18490 - DNA, 15 bp, Homo sapiens
gaacacaatggtaag

SEQ ID NO: 18491 - DNA, 15 bp, Homo sapiens
ggaacacaatggtaa

SEQ ID NO: 18492 - DNA, 15 bp, Homo sapiens
tggaacacaatggta

SEQ ID NO: 18493 - DNA, 15 bp, Homo sapiens
ctggaacacaatggt

SEQ ID NO: 18494 - DNA, 15 bp, Homo sapiens
actggaacacaatgg

SEQ ID NO: 18495 - DNA, 15 bp, Homo sapiens
cactggaacacaatg

SEQ ID NO: 18496 - DNA, 15 bp, Homo sapiens
tcactggaacacaat

SEQ ID NO: 18497 - DNA, 15 bp, Homo sapiens
atcactggaacacaa

SEQ ID NO: 18498 - DNA, 15 bp, Homo sapiens
gatcactggaacaca

SEQ ID NO: 18499 - DNA, 15 bp, Homo sapiens
agatcactggaacac

SEQ ID NO: 18500 - DNA, 15 bp, Homo sapiens
tagatcactggaaca

SEQ ID NO: 18501 - DNA, 15 bp, Homo sapiens
gtagatcactggaac

SEQ ID NO: 18502 - DNA, 15 bp, Homo sapiens
tgtagatcactggaa

SEQ ID NO: 18503 - DNA, 15 bp, Homo sapiens
ctgtagatcactgga

SEQ ID NO: 18504 - DNA, 15 bp, Homo sapiens
actgtagatcactgg

SEQ ID NO: 18505 - DNA, 15 bp, Homo sapiens
tactgtagatcactg

SEQ ID NO: 18506 - DNA, 15 bp, Homo sapiens
atactgtagatcact

SEQ ID NO: 18507 - DNA, 15 bp, Homo sapiens
aatactgtagatcac

SEQ ID NO: 18508 - DNA, 15 bp, Homo sapiens
gaatactgtagatca

SEQ ID NO: 18509 - DNA, 15 bp, Homo sapiens
tgaatactgtagatc

SEQ ID NO: 18510 - DNA, 15 bp, Homo sapiens
ctgaatactgtagat

SEQ ID NO: 18511 - DNA, 15 bp, Homo sapiens
actgaatactgtaga

SEQ ID NO: 18512 - DNA, 15 bp, Homo sapiens
tactgaatactgtag

SEQ ID NO: 18513 - DNA, 15 bp, Homo sapiens
atactgaatactgta

SEQ ID NO: 18514 - DNA, 15 bp, Homo sapiens
tatactgaatactgt

SEQ ID NO: 18515 - DNA, 15 bp, Homo sapiens
ctatactgaatactg

SEQ ID NO: 18516 - DNA, 15 bp, Homo sapiens
actatactgaatact

SEQ ID NO: 18517 - DNA, 15 bp, Homo sapiens
tactatactgaatac

SEQ ID NO: 18518 - DNA, 15 bp, Homo sapiens
gtactatactgaata

SEQ ID NO: 18519 - DNA, 15 bp, Homo sapiens
ggtactatactgaat

SEQ ID NO: 18520 - DNA, 15 bp, Homo sapiens
tggtactatactgaa

SEQ ID NO: 18521 - DNA, 15 bp, Homo sapiens
atggtactatactga

SEQ ID NO: 18522 - DNA, 15 bp, Homo sapiens
catggtactatactg

SEQ ID NO: 18523 - DNA, 15 bp, Homo sapiens
gcatggtactatact

SEQ ID NO: 18524 - DNA, 15 bp, Homo sapiens
agcatggtactatac

SEQ ID NO: 18525 - DNA, 15 bp, Homo sapiens
cagcatggtactata

SEQ ID NO: 18526 - DNA, 15 bp, Homo sapiens
acagcatggtactat

SEQ ID NO: 18527 - DNA, 15 bp, Homo sapiens
tacagcatggtacta

SEQ ID NO: 18528 - DNA, 15 bp, Homo sapiens
gtacagcatggtact

SEQ ID NO: 18529 - DNA, 15 bp, Homo sapiens
tgtacagcatggtac

SEQ ID NO: 18530 - DNA, 15 bp, Homo sapiens
ctgtacagcatggta

SEQ ID NO: 18531 - DNA, 15 bp, Homo sapiens
actgtacagcatggt

SEQ ID NO: 18532 - DNA, 15 bp, Homo sapiens
aactgtacagcatgg

SEQ ID NO: 18533 - DNA, 15 bp, Homo sapiens
aaactgtacagcatg

SEQ ID NO: 18534 - DNA, 15 bp, Homo sapiens
aaaactgtacagcat

SEQ ID NO: 18535 - DNA, 15 bp, Homo sapiens
taaaactgtacagca

SEQ ID NO: 18536 - DNA, 15 bp, Homo sapiens
ataaaactgtacagc

SEQ ID NO: 18537 - DNA, 15 bp, Homo sapiens
tataaaactgtacag

SEQ ID NO: 18538 - DNA, 15 bp, Homo sapiens
ctataaaactgtaca

SEQ ID NO: 18539 - DNA, 15 bp, Homo sapiens
gctataaaactgtac

SEQ ID NO: 18540 - DNA, 15 bp, Homo sapiens
ggctataaaactgta

SEQ ID NO: 18541 - DNA, 15 bp, Homo sapiens
gggctataaaactgt

SEQ ID NO: 18542 - DNA, 15 bp, Homo sapiens
tgggctataaaactg

SEQ ID NO: 18543 - DNA, 15 bp, Homo sapiens
ctgggctataaaact

SEQ ID NO: 18544 - DNA, 15 bp, Homo sapiens
cctgggctataaaac

SEQ ID NO: 18545 - DNA, 15 bp, Homo sapiens
tcctgggctataaaa

SEQ ID NO: 18546 - DNA, 15 bp, Homo sapiens
ctcctgggctataaa

SEQ ID NO: 18547 - DNA, 15 bp, Homo sapiens
gctcctgggctataa

SEQ ID NO: 18548 - DNA, 15 bp, Homo sapiens
tgctcctgggctata

SEQ ID NO: 18549 - DNA, 15 bp, Homo sapiens
ttgctcctgggctat

SEQ ID NO: 18550 - DNA, 15 bp, Homo sapiens
attgctcctgggcta

SEQ ID NO: 18551 - DNA, 15 bp, Homo sapiens
tattgctcctgggct

SEQ ID NO: 18552 - DNA, 15 bp, Homo sapiens
ctattgctcctgggc

SEQ ID NO: 18553 - DNA, 15 bp, Homo sapiens
cctattgctcctggg

SEQ ID NO: 18554 - DNA, 15 bp, Homo sapiens
gcctattgctcctgg

SEQ ID NO: 18555 - DNA, 15 bp, Homo sapiens
agcctattgctcctg

SEQ ID NO: 18556 - DNA, 15 bp, Homo sapiens
tagcctattgctcct

SEQ ID NO: 18557 - DNA, 15 bp, Homo sapiens
atagcctattgctcc

SEQ ID NO: 18558 - DNA, 15 bp, Homo sapiens
tatagcctattgctc

SEQ ID NO: 18559 - DNA, 15 bp, Homo sapiens
atatagcctattgct

SEQ ID NO: 18560 - DNA, 15 bp, Homo sapiens
tatatagcctattgc

SEQ ID NO: 18561 - DNA, 15 bp, Homo sapiens
gtatatagcctattg

SEQ ID NO: 18562 - DNA, 15 bp, Homo sapiens
ggtatatagcctatt

SEQ ID NO: 18563 - DNA, 15 bp, Homo sapiens
cggtatatagcctat

SEQ ID NO: 18564 - DNA, 15 bp, Homo sapiens
acggtatatagccta

SEQ ID NO: 18565 - DNA, 15 bp, Homo sapiens
tacggtatatagcct

SEQ ID NO: 18566 - DNA, 15 bp, Homo sapiens
atacggtatatagcc

SEQ ID NO: 18567 - DNA, 15 bp, Homo sapiens
tatacggtatatagc

SEQ ID NO: 18568 - DNA, 15 bp, Homo sapiens
ctatacggtatatag

SEQ ID NO: 18569 - DNA, 15 bp, Homo sapiens
gctatacggtatata

SEQ ID NO: 18570 - DNA, 15 bp, Homo sapiens
ggctatacggtatat

SEQ ID NO: 18571 - DNA, 15 bp, Homo sapiens
aggctatacggtata

SEQ ID NO: 18572 - DNA, 15 bp, Homo sapiens
taggctatacggtat

SEQ ID NO: 18573 - DNA, 15 bp, Homo sapiens
ctaggctatacggta

SEQ ID NO: 18574 - DNA, 15 bp, Homo sapiens
cctaggctatacggt

SEQ ID NO: 18575 - DNA, 15 bp, Homo sapiens
acctaggctatacgg

SEQ ID NO: 18576 - DNA, 15 bp, Homo sapiens
cacctaggctatacg

SEQ ID NO: 18577 - DNA, 15 bp, Homo sapiens
acacctaggctatac

SEQ ID NO: 18578 - DNA, 15 bp, Homo sapiens
cacacctaggctata

SEQ ID NO: 18579 - DNA, 15 bp, Homo sapiens
acacacctaggctat

SEQ ID NO: 18580 - DNA, 15 bp, Homo sapiens
tacacacctaggcta

SEQ ID NO: 18581 - DNA, 15 bp, Homo sapiens
ctacacacctaggct

SEQ ID NO: 18582 - DNA, 15 bp, Homo sapiens
actacacacctaggc

SEQ ID NO: 18583 - DNA, 15 bp, Homo sapiens
tactacacacctagg

SEQ ID NO: 18584 - DNA, 15 bp, Homo sapiens
atactacacacctag

SEQ ID NO: 18585 - DNA, 15 bp, Homo sapiens
catactacacaccta

SEQ ID NO: 18586 - DNA, 15 bp, Homo sapiens
gcatactacacacct

SEQ ID NO: 18587 - DNA, 15 bp, Homo sapiens
agcatactacacacc

SEQ ID NO: 18588 - DNA, 15 bp, Homo sapiens
tagcatactacacac

SEQ ID NO: 18589 - DNA, 15 bp, Homo sapiens
gtagcatactacaca

SEQ ID NO: 18590 - DNA, 15 bp, Homo sapiens
tgtagcatactacac

SEQ ID NO: 18591 - DNA, 15 bp, Homo sapiens
gtgtagcatactaca

SEQ ID NO: 18592 - DNA, 15 bp, Homo sapiens
ggtgtagcatactac

SEQ ID NO: 18593 - DNA, 15 bp, Homo sapiens
tggtgtagcatacta

SEQ ID NO: 18594 - DNA, 15 bp, Homo sapiens
atggtgtagcatact

SEQ ID NO: 18595 - DNA, 15 bp, Homo sapiens
gatggtgtagcatac

SEQ ID NO: 18596 - DNA, 15 bp, Homo sapiens
agatggtgtagcata

SEQ ID NO: 18597 - DNA, 15 bp, Homo sapiens
tagatggtgtagcat

SEQ ID NO: 18598 - DNA, 15 bp, Homo sapiens
ctagatggtgtagca

SEQ ID NO: 18599 - DNA, 15 bp, Homo sapiens
tctagatggtgtagc

SEQ ID NO: 18600 - DNA, 15 bp, Homo sapiens
atctagatggtgtag

SEQ ID NO: 18601 - DNA, 15 bp, Homo sapiens
aatctagatggtgta

SEQ ID NO: 18602 - DNA, 15 bp, Homo sapiens
aaatctagatggtgt

SEQ ID NO: 18603 - DNA, 15 bp, Homo sapiens
caaatctagatggtg

SEQ ID NO: 18604 - DNA, 15 bp, Homo sapiens
acaaatctagatggt

SEQ ID NO: 18605 - DNA, 15 bp, Homo sapiens
cacaaatctagatgg

SEQ ID NO: 18606 - DNA, 15 bp, Homo sapiens
acacaaatctagatg

SEQ ID NO: 18607 - DNA, 15 bp, Homo sapiens
tacacaaatctagat

SEQ ID NO: 18608 - DNA, 15 bp, Homo sapiens
ttacacaaatctaga

SEQ ID NO: 18609 - DNA, 15 bp, Homo sapiens
cttacacaaatctag

SEQ ID NO: 18610 - DNA, 15 bp, Homo sapiens
tcttacacaaatcta

SEQ ID NO: 18611 - DNA, 15 bp, Homo sapiens
ttcttacacaaatct

SEQ ID NO: 18612 - DNA, 15 bp, Homo sapiens
gttcttacacaaatc

SEQ ID NO: 18613 - DNA, 15 bp, Homo sapiens
tgttcttacacaaat

SEQ ID NO: 18614 - DNA, 15 bp, Homo sapiens
gtgttcttacacaaa

SEQ ID NO: 18615 - DNA, 15 bp, Homo sapiens
agtgttcttacacaa

SEQ ID NO: 18616 - DNA, 15 bp, Homo sapiens
gagtgttcttacaca

SEQ ID NO: 18617 - DNA, 15 bp, Homo sapiens
agagtgttcttacac

SEQ ID NO: 18618 - DNA, 15 bp, Homo sapiens
gagagtgttcttaca

SEQ ID NO: 18619 - DNA, 15 bp, Homo sapiens
agagagtgttcttac

SEQ ID NO: 18620 - DNA, 15 bp, Homo sapiens
cagagagtgttctta

SEQ ID NO: 18621 - DNA, 15 bp, Homo sapiens
tcagagagtgttctt

SEQ ID NO: 18622 - DNA, 15 bp, Homo sapiens
atcagagagtgttct

SEQ ID NO: 18623 - DNA, 15 bp, Homo sapiens
catcagagagtgttc

SEQ ID NO: 18624 - DNA, 15 bp, Homo sapiens
acatcagagagtgtt

SEQ ID NO: 18625 - DNA, 15 bp, Homo sapiens
aacatcagagagtgt

SEQ ID NO: 18626 - DNA, 15 bp, Homo sapiens
taacatcagagagtg

SEQ ID NO: 18627 - DNA, 15 bp, Homo sapiens
ctaacatcagagagt

SEQ ID NO: 18628 - DNA, 15 bp, Homo sapiens
gctaacatcagagag

SEQ ID NO: 18629 - DNA, 15 bp, Homo sapiens
tgctaacatcagaga

SEQ ID NO: 18630 - DNA, 15 bp, Homo sapiens
gtgctaacatcagag

SEQ ID NO: 18631 - DNA, 15 bp, Homo sapiens
tgtgctaacatcaga

SEQ ID NO: 18632 - DNA, 15 bp, Homo sapiens
ttgtgctaacatcag

SEQ ID NO: 18633 - DNA, 15 bp, Homo sapiens
tttgtgctaacatca

SEQ ID NO: 18634 - DNA, 15 bp, Homo sapiens
atttgtgctaacatc

SEQ ID NO: 18635 - DNA, 15 bp, Homo sapiens
tatttgtgctaacat

SEQ ID NO: 18636 - DNA, 15 bp, Homo sapiens
ttatttgtgctaaca

SEQ ID NO: 18637 - DNA, 15 bp, Homo sapiens
tttatttgtgctaac

SEQ ID NO: 18638 - DNA, 15 bp, Homo sapiens
atttatttgtgctaa

SEQ ID NO: 18639 - DNA, 15 bp, Homo sapiens
gatttatttgtgcta

SEQ ID NO: 18640 - DNA, 15 bp, Homo sapiens
cgatttatttgtgct

SEQ ID NO: 18641 - DNA, 15 bp, Homo sapiens
gcgatttatttgtgc

SEQ ID NO: 18642 - DNA, 15 bp, Homo sapiens
ggcgatttatttgtg

SEQ ID NO: 18643 - DNA, 15 bp, Homo sapiens
gggcgatttatttgt

SEQ ID NO: 18644 - DNA, 15 bp, Homo sapiens
tgggcgatttatttg

SEQ ID NO: 18645 - DNA, 15 bp, Homo sapiens
ttgggcgatttattt

SEQ ID NO: 18646 - DNA, 15 bp, Homo sapiens
attgggcgatttatt

SEQ ID NO: 18647 - DNA, 15 bp, Homo sapiens
cattgggcgatttat

SEQ ID NO: 18648 - DNA, 15 bp, Homo sapiens
tcattgggcgattta

SEQ ID NO: 18649 - DNA, 15 bp, Homo sapiens
gtcattgggcgattt

SEQ ID NO: 18650 - DNA, 15 bp, Homo sapiens
tgtcattgggcgatt

SEQ ID NO: 18651 - DNA, 15 bp, Homo sapiens
gtgtcattgggcgat

SEQ ID NO: 18652 - DNA, 15 bp, Homo sapiens
tgtgtcattgggcga

SEQ ID NO: 18653 - DNA, 15 bp, Homo sapiens
atgtgtcattgggcg

SEQ ID NO: 18654 - DNA, 15 bp, Homo sapiens
aatgtgtcattgggc

SEQ ID NO: 18655 - DNA, 15 bp, Homo sapiens
aaatgtgtcattggg

SEQ ID NO: 18656 - DNA, 15 bp, Homo sapiens
gaaatgtgtcattgg

SEQ ID NO: 18657 - DNA, 15 bp, Homo sapiens
agaaatgtgtcattg

SEQ ID NO: 18658 - DNA, 15 bp, Homo sapiens
gagaaatgtgtcatt

SEQ ID NO: 18659 - DNA, 15 bp, Homo sapiens
tgagaaatgtgtcat

SEQ ID NO: 18660 - DNA, 15 bp, Homo sapiens
ctgagaaatgtgtca

SEQ ID NO: 18661 - DNA, 15 bp, Homo sapiens
tctgagaaatgtgtc

SEQ ID NO: 18662 - DNA, 15 bp, Homo sapiens
ttctgagaaatgtgt

SEQ ID NO: 18663 - DNA, 15 bp, Homo sapiens
gttctgagaaatgtg

SEQ ID NO: 18664 - DNA, 15 bp, Homo sapiens
tgttctgagaaatgt

SEQ ID NO: 18665 - DNA, 15 bp, Homo sapiens
atgttctgagaaatg

SEQ ID NO: 18666 - DNA, 15 bp, Homo sapiens
tatgttctgagaaat

SEQ ID NO: 18667 - DNA, 15 bp, Homo sapiens
atatgttctgagaaa

SEQ ID NO: 18668 - DNA, 15 bp, Homo sapiens
gatatgttctgagaa

SEQ ID NO: 18669 - DNA, 15 bp, Homo sapiens
ggatatgttctgaga

SEQ ID NO: 18670 - DNA, 15 bp, Homo sapiens
gggatatgttctgag

SEQ ID NO: 18671 - DNA, 15 bp, Homo sapiens
agggatatgttctga

SEQ ID NO: 18672 - DNA, 15 bp, Homo sapiens
cagggatatgttctg

SEQ ID NO: 18673 - DNA, 15 bp, Homo sapiens
acagggatatgttct

SEQ ID NO: 18674 - DNA, 15 bp, Homo sapiens
aacagggatatgttc

SEQ ID NO: 18675 - DNA, 15 bp, Homo sapiens
caacagggatatgtt

SEQ ID NO: 18676 - DNA, 15 bp, Homo sapiens
acaacagggatatgt

SEQ ID NO: 18677 - DNA, 15 bp, Homo sapiens
aacaacagggatatg

SEQ ID NO: 18678 - DNA, 15 bp, Homo sapiens
caacaacagggatat

SEQ ID NO: 18679 - DNA, 15 bp, Homo sapiens
tcaacaacagggata

SEQ ID NO: 18680 - DNA, 15 bp, Homo sapiens
ctcaacaacagggat

SEQ ID NO: 18681 - DNA, 15 bp, Homo sapiens
gctcaacaacaggga

SEQ ID NO: 18682 - DNA, 15 bp, Homo sapiens
cgctcaacaacaggg

SEQ ID NO: 18683 - DNA, 15 bp, Homo sapiens
tcgctcaacaacagg

SEQ ID NO: 18684 - DNA, 15 bp, Homo sapiens
gtcgctcaacaacag

SEQ ID NO: 18685 - DNA, 15 bp, Homo sapiens
agtcgctcaacaaca

SEQ ID NO: 18686 - DNA, 15 bp, Homo sapiens
gagtcgctcaacaac

SEQ ID NO: 18687 - DNA, 15 bp, Homo sapiens
tgagtcgctcaacaa

SEQ ID NO: 18688 - DNA, 15 bp, Homo sapiens
atgagtcgctcaaca

SEQ ID NO: 18689 - DNA, 15 bp, Homo sapiens
catgagtcgctcaac

SEQ ID NO: 18690 - DNA, 15 bp, Homo sapiens
tcatgagtcgctcaa

SEQ ID NO: 18691 - DNA, 15 bp, Homo sapiens
gtcatgagtcgctca

SEQ ID NO: 18692 - DNA, 15 bp, Homo sapiens
agtcatgagtcgctc

SEQ ID NO: 18693 - DNA, 15 bp, Homo sapiens
cagtcatgagtcgct

SEQ ID NO: 18694 - DNA, 15 bp, Homo sapiens
acagtcatgagtcgc

SEQ ID NO: 18695 - DNA, 15 bp, Homo sapiens
tacagtcatgagtcg

SEQ ID NO: 18696 - DNA, 15 bp, Homo sapiens
gtacagtcatgagtc

SEQ ID NO: 18697 - DNA, 15 bp, Homo sapiens
tgtacagtcatgagt

SEQ ID NO: 18698 - DNA, 15 bp, Homo sapiens
ttgtacagtcatgag

SEQ ID NO: 18699 - DNA, 15 bp, Homo sapiens
attgtacagtcatga

SEQ ID NO: 18700 - DNA, 15 bp, Homo sapiens
cattgtacagtcatg

SEQ ID NO: 18701 - DNA, 15 bp, Homo sapiens
ccattgtacagtcat

SEQ ID NO: 18702 - DNA, 15 bp, Homo sapiens
cccattgtacagtca

SEQ ID NO: 18703 - DNA, 15 bp, Homo sapiens
ccccattgtacagtc

SEQ ID NO: 18704 - DNA, 15 bp, Homo sapiens
cccccattgtacagt

SEQ ID NO: 18705 - DNA, 15 bp, Homo sapiens
tcccccattgtacag

SEQ ID NO: 18706 - DNA, 15 bp, Homo sapiens
ttcccccattgtaca

SEQ ID NO: 18707 - DNA, 15 bp, Homo sapiens
gttcccccattgtac

SEQ ID NO: 18708 - DNA, 15 bp, Homo sapiens
tgttcccccattgta

SEQ ID NO: 18709 - DNA, 15 bp, Homo sapiens
ctgttcccccattgt

SEQ ID NO: 18710 - DNA, 15 bp, Homo sapiens
gctgttcccccattg

SEQ ID NO: 18711 - DNA, 15 bp, Homo sapiens
agctgttcccccatt

SEQ ID NO: 18712 - DNA, 15 bp, Homo sapiens
gagctgttcccccat

SEQ ID NO: 18713 - DNA, 15 bp, Homo sapiens
tgagctgttccccca

SEQ ID NO: 18714 - DNA, 15 bp, Homo sapiens
ctgagctgttccccc

SEQ ID NO: 18715 - DNA, 15 bp, Homo sapiens
gctgagctgttcccc

SEQ ID NO: 18716 - DNA, 15 bp, Homo sapiens
ggctgagctgttccc

SEQ ID NO: 18717 - DNA, 15 bp, Homo sapiens
aggctgagctgttcc

SEQ ID NO: 18718 - DNA, 15 bp, Homo sapiens
caggctgagctgttc

SEQ ID NO: 18719 - DNA, 15 bp, Homo sapiens
gcaggctgagctgtt

SEQ ID NO: 18720 - DNA, 15 bp, Homo sapiens
ggcaggctgagctgt

SEQ ID NO: 18721 - DNA, 15 bp, Homo sapiens
aggcaggctgagctg

SEQ ID NO: 18722 - DNA, 15 bp, Homo sapiens
aaggcaggctgagct

SEQ ID NO: 18723 - DNA, 15 bp, Homo sapiens
gaaggcaggctgagc

SEQ ID NO: 18724 - DNA, 15 bp, Homo sapiens
ggaaggcaggctgag

SEQ ID NO: 18725 - DNA, 15 bp, Homo sapiens
gggaaggcaggctga

SEQ ID NO: 18726 - DNA, 15 bp, Homo sapiens
ggggaaggcaggctg

SEQ ID NO: 18727 - DNA, 15 bp, Homo sapiens
tggggaaggcaggct

SEQ ID NO: 18728 - DNA, 15 bp, Homo sapiens
ttggggaaggcaggc

SEQ ID NO: 18729 - DNA, 15 bp, Homo sapiens
cttggggaaggcagg

SEQ ID NO: 18730 - DNA, 15 bp, Homo sapiens
ccttggggaaggcag

SEQ ID NO: 18731 - DNA, 15 bp, Homo sapiens
tccttggggaaggca

SEQ ID NO: 18732 - DNA, 15 bp, Homo sapiens
ctccttggggaaggc

SEQ ID NO: 18733 - DNA, 15 bp, Homo sapiens
cctccttggggaagg

SEQ ID NO: 18734 - DNA, 15 bp, Homo sapiens
gcctccttggggaag

SEQ ID NO: 18735 - DNA, 15 bp, Homo sapiens
tgcctccttggggaa

SEQ ID NO: 18736 - DNA, 15 bp, Homo sapiens
ttgcctccttgggga

SEQ ID NO: 18737 - DNA, 15 bp, Homo sapiens
gttgcctccttgggg

SEQ ID NO: 18738 - DNA, 15 bp, Homo sapiens
cgttgcctccttggg

SEQ ID NO: 18739 - DNA, 15 bp, Homo sapiens
gcgttgcctccttgg

SEQ ID NO: 18740 - DNA, 15 bp, Homo sapiens
ggcgttgcctccttg

SEQ ID NO: 18741 - DNA, 15 bp, Homo sapiens
cggcgttgcctcctt

SEQ ID NO: 18742 - DNA, 15 bp, Homo sapiens
tcggcgttgcctcct

SEQ ID NO: 18743 - DNA, 15 bp, Homo sapiens
atcggcgttgcctcc

SEQ ID NO: 18744 - DNA, 15 bp, Homo sapiens
catcggcgttgcctc

SEQ ID NO: 18745 - DNA, 15 bp, Homo sapiens
gcatcggcgttgcct

SEQ ID NO: 18746 - DNA, 15 bp, Homo sapiens
tgcatcggcgttgcc

SEQ ID NO: 18747 - DNA, 15 bp, Homo sapiens
ctgcatcggcgttgc

SEQ ID NO: 18748 - DNA, 15 bp, Homo sapiens
cctgcatcggcgttg

SEQ ID NO: 18749 - DNA, 15 bp, Homo sapiens
ccctgcatcggcgtt

SEQ ID NO: 18750 - DNA, 15 bp, Homo sapiens
tccctgcatcggcgt

SEQ ID NO: 18751 - DNA, 15 bp, Homo sapiens
ttccctgcatcggcg

SEQ ID NO: 18752 - DNA, 15 bp, Homo sapiens
gttccctgcatcggc

SEQ ID NO: 18753 - DNA, 15 bp, Homo sapiens
ggttccctgcatcgg

SEQ ID NO: 18754 - DNA, 15 bp, Homo sapiens
cggttccctgcatcg

SEQ ID NO: 18755 - DNA, 15 bp, Homo sapiens
tcggttccctgcatc

SEQ ID NO: 18756 - DNA, 15 bp, Homo sapiens
ctcggttccctgcat

SEQ ID NO: 18757 - DNA, 15 bp, Homo sapiens
cctcggttccctgca

SEQ ID NO: 18758 - DNA, 15 bp, Homo sapiens
ccctcggttccctgc

SEQ ID NO: 18759 - DNA, 15 bp, Homo sapiens
accctcggttccctg

SEQ ID NO: 18760 - DNA, 15 bp, Homo sapiens
aaccctcggttccct

SEQ ID NO: 18761 - DNA, 15 bp, Homo sapiens
caaccctcggttccc

SEQ ID NO: 18762 - DNA, 15 bp, Homo sapiens
tcaaccctcggttcc

SEQ ID NO: 18763 - DNA, 15 bp, Homo sapiens
ttcaaccctcggttc

SEQ ID NO: 18764 - DNA, 15 bp, Homo sapiens
gttcaaccctcggtt

SEQ ID NO: 18765 - DNA, 15 bp, Homo sapiens
tgttcaaccctcggt

SEQ ID NO: 18766 - DNA, 15 bp, Homo sapiens
ctgttcaaccctcgg

SEQ ID NO: 18767 - DNA, 15 bp, Homo sapiens
tctgttcaaccctcg

SEQ ID NO: 18768 - DNA, 15 bp, Homo sapiens
ttctgttcaaccctc

SEQ ID NO: 18769 - DNA, 15 bp, Homo sapiens
cttctgttcaaccct

SEQ ID NO: 18770 - DNA, 15 bp, Homo sapiens
acttctgttcaaccc

SEQ ID NO: 18771 - DNA, 15 bp, Homo sapiens
cacttctgttcaacc

SEQ ID NO: 18772 - DNA, 15 bp, Homo sapiens
ccacttctgttcaac

SEQ ID NO: 18773 - DNA, 15 bp, Homo sapiens
cccacttctgttcaa

SEQ ID NO: 18774 - DNA, 15 bp, Homo sapiens
gcccacttctgttca

SEQ ID NO: 18775 - DNA, 15 bp, Homo sapiens
tgcccacttctgttc

SEQ ID NO: 18776 - DNA, 15 bp, Homo sapiens
ttgcccacttctgtt

SEQ ID NO: 18777 - DNA, 15 bp, Homo sapiens
cttgcccacttctgt

SEQ ID NO: 18778 - DNA, 15 bp, Homo sapiens
ccttgcccacttctg

SEQ ID NO: 18779 - DNA, 15 bp, Homo sapiens
accttgcccacttct

SEQ ID NO: 18780 - DNA, 15 bp, Homo sapiens
caccttgcccacttc

SEQ ID NO: 18781 - DNA, 15 bp, Homo sapiens
gcaccttgcccactt

SEQ ID NO: 18782 - DNA, 15 bp, Homo sapiens
tgcaccttgcccact

SEQ ID NO: 18783 - DNA, 15 bp, Homo sapiens
ctgcaccttgcccac

SEQ ID NO: 18784 - DNA, 15 bp, Homo sapiens
tctgcaccttgccca

SEQ ID NO: 18785 - DNA, 15 bp, Homo sapiens
ctctgcaccttgccc

SEQ ID NO: 18786 - DNA, 15 bp, Homo sapiens
tctctgcaccttgcc

SEQ ID NO: 18787 - DNA, 15 bp, Homo sapiens
ctctctgcaccttgc

SEQ ID NO: 18788 - DNA, 15 bp, Homo sapiens
cctctctgcaccttg

SEQ ID NO: 18789 - DNA, 15 bp, Homo sapiens
tcctctctgcacctt

SEQ ID NO: 18790 - DNA, 15 bp, Homo sapiens
ttcctctctgcacct

SEQ ID NO: 18791 - DNA, 15 bp, Homo sapiens
tttcctctctgcacc

SEQ ID NO: 18792 - DNA, 15 bp, Homo sapiens
ttttcctctctgcac

SEQ ID NO: 18793 - DNA, 15 bp, Homo sapiens
tttttcctctctgca

SEQ ID NO: 18794 - DNA, 15 bp, Homo sapiens
ctttttcctctctgc

SEQ ID NO: 18795 - DNA, 15 bp, Homo sapiens
cctttttcctctctg

SEQ ID NO: 18796 - DNA, 15 bp, Homo sapiens
gcctttttcctctct

SEQ ID NO: 18797 - DNA, 15 bp, Homo sapiens
agcctttttcctctc

SEQ ID NO: 18798 - DNA, 15 bp, Homo sapiens
aagcctttttcctct

SEQ ID NO: 18799 - DNA, 15 bp, Homo sapiens
aaagcctttttcctc

SEQ ID NO: 18800 - DNA, 15 bp, Homo sapiens
gaaagcctttttcct

SEQ ID NO: 18801 - DNA, 15 bp, Homo sapiens
ggaaagcctttttcc

SEQ ID NO: 18802 - DNA, 15 bp, Homo sapiens
tggaaagcctttttc

SEQ ID NO: 18803 - DNA, 15 bp, Homo sapiens
ctggaaagccttttt

SEQ ID NO: 18804 - DNA, 15 bp, Homo sapiens
tctggaaagcctttt

SEQ ID NO: 18805 - DNA, 15 bp, Homo sapiens
atctggaaagccttt

SEQ ID NO: 18806 - DNA, 15 bp, Homo sapiens
catctggaaagcctt

SEQ ID NO: 18807 - DNA, 15 bp, Homo sapiens
ccatctggaaagcct

SEQ ID NO: 18808 - DNA, 15 bp, Homo sapiens
tccatctggaaagcc

SEQ ID NO: 18809 - DNA, 15 bp, Homo sapiens
ctccatctggaaagc

SEQ ID NO: 18810 - DNA, 15 bp, Homo sapiens
tctccatctggaaag

SEQ ID NO: 18811 - DNA, 15 bp, Homo sapiens
ttctccatctggaaa

SEQ ID NO: 18812 - DNA, 15 bp, Homo sapiens
cttctccatctggaa

SEQ ID NO: 18813 - DNA, 15 bp, Homo sapiens
tcttctccatctgga

SEQ ID NO: 18814 - DNA, 15 bp, Homo sapiens
ctcttctccatctgg

SEQ ID NO: 18815 - DNA, 15 bp, Homo sapiens
gctcttctccatctg

SEQ ID NO: 18816 - DNA, 15 bp, Homo sapiens
tgctcttctccatct

SEQ ID NO: 18817 - DNA, 15 bp, Homo sapiens
atgctcttctccatc

SEQ ID NO: 18818 - DNA, 15 bp, Homo sapiens
catgctcttctccat

SEQ ID NO: 18819 - DNA, 15 bp, Homo sapiens
acatgctcttctcca

SEQ ID NO: 18820 - DNA, 15 bp, Homo sapiens
cacatgctcttctcc

SEQ ID NO: 18821 - DNA, 15 bp, Homo sapiens
acacatgctcttctc

SEQ ID NO: 18822 - DNA, 15 bp, Homo sapiens
cacacatgctcttct

SEQ ID NO: 18823 - DNA, 15 bp, Homo sapiens
tcacacatgctcttc

SEQ ID NO: 18824 - DNA, 15 bp, Homo sapiens
ttcacacatgctctt

SEQ ID NO: 18825 - DNA, 15 bp, Homo sapiens
cttcacacatgctct

SEQ ID NO: 18826 - DNA, 15 bp, Homo sapiens
ccttcacacatgctc

SEQ ID NO: 18827 - DNA, 15 bp, Homo sapiens
gccttcacacatgct

SEQ ID NO: 18828 - DNA, 15 bp, Homo sapiens
ggccttcacacatgc

SEQ ID NO: 18829 - DNA, 15 bp, Homo sapiens
gggccttcacacatg

SEQ ID NO: 18830 - DNA, 15 bp, Homo sapiens
agggccttcacacat

SEQ ID NO: 18831 - DNA, 15 bp, Homo sapiens
gagggccttcacaca

SEQ ID NO: 18832 - DNA, 15 bp, Homo sapiens
tgagggccttcacac

SEQ ID NO: 18833 - DNA, 15 bp, Homo sapiens
ctgagggccttcaca

SEQ ID NO: 18834 - DNA, 15 bp, Homo sapiens
actgagggccttcac

SEQ ID NO: 18835 - DNA, 15 bp, Homo sapiens
gactgagggccttca

SEQ ID NO: 18836 - DNA, 15 bp, Homo sapiens
agactgagggccttc

SEQ ID NO: 18837 - DNA, 15 bp, Homo sapiens
cagactgagggcctt

SEQ ID NO: 18838 - DNA, 15 bp, Homo sapiens
ccagactgagggcct

SEQ ID NO: 18839 - DNA, 15 bp, Homo sapiens
gccagactgagggcc

SEQ ID NO: 18840 - DNA, 15 bp, Homo sapiens
tgccagactgagggc

SEQ ID NO: 18841 - DNA, 15 bp, Homo sapiens
ttgccagactgaggg

SEQ ID NO: 18842 - DNA, 15 bp, Homo sapiens
cttgccagactgagg

SEQ ID NO: 18843 - DNA, 15 bp, Homo sapiens
tcttgccagactgag

SEQ ID NO: 18844 - DNA, 15 bp, Homo sapiens
ctcttgccagactga

SEQ ID NO: 18845 - DNA, 15 bp, Homo sapiens
gctcttgccagactg

SEQ ID NO: 18846 - DNA, 15 bp, Homo sapiens
agctcttgccagact

SEQ ID NO: 18847 - DNA, 15 bp, Homo sapiens
aagctcttgccagac

SEQ ID NO: 18848 - DNA, 15 bp, Homo sapiens
taagctcttgccaga

SEQ ID NO: 18849 - DNA, 15 bp, Homo sapiens
ctaagctcttgccag

SEQ ID NO: 18850 - DNA, 15 bp, Homo sapiens
actaagctcttgcca

SEQ ID NO: 18851 - DNA, 15 bp, Homo sapiens
gactaagctcttgcc

SEQ ID NO: 18852 - DNA, 15 bp, Homo sapiens
ggactaagctcttgc

SEQ ID NO: 18853 - DNA, 15 bp, Homo sapiens
aggactaagctcttg

SEQ ID NO: 18854 - DNA, 15 bp, Homo sapiens
caggactaagctctt

SEQ ID NO: 18855 - DNA, 15 bp, Homo sapiens
acaggactaagctct

SEQ ID NO: 18856 - DNA, 15 bp, Homo sapiens
cacaggactaagctc

SEQ ID NO: 18857 - DNA, 15 bp, Homo sapiens
acacaggactaagct

SEQ ID NO: 18858 - DNA, 15 bp, Homo sapiens
cacacaggactaagc

SEQ ID NO: 18859 - DNA, 15 bp, Homo sapiens
ccacacaggactaag

SEQ ID NO: 18860 - DNA, 15 bp, Homo sapiens
gccacacaggactaa

SEQ ID NO: 18861 - DNA, 15 bp, Homo sapiens
tgccacacaggacta

SEQ ID NO: 18862 - DNA, 15 bp, Homo sapiens
ctgccacacaggact

SEQ ID NO: 18863 - DNA, 15 bp, Homo sapiens
cctgccacacaggac

SEQ ID NO: 18864 - DNA, 15 bp, Homo sapiens
tcctgccacacagga

SEQ ID NO: 18865 - DNA, 15 bp, Homo sapiens
ctcctgccacacagg

SEQ ID NO: 18866 - DNA, 15 bp, Homo sapiens
gctcctgccacacag

SEQ ID NO: 18867 - DNA, 15 bp, Homo sapiens
agctcctgccacaca

SEQ ID NO: 18868 - DNA, 15 bp, Homo sapiens
cagctcctgccacac

SEQ ID NO: 18869 - DNA, 15 bp, Homo sapiens
tcagctcctgccaca

SEQ ID NO: 18870 - DNA, 15 bp, Homo sapiens
ttcagctcctgccac

SEQ ID NO: 18871 - DNA, 15 bp, Homo sapiens
gttcagctcctgcca

SEQ ID NO: 18872 - DNA, 15 bp, Homo sapiens
cgttcagctcctgcc

SEQ ID NO: 18873 - DNA, 15 bp, Homo sapiens
tcgttcagctcctgc

SEQ ID NO: 18874 - DNA, 15 bp, Homo sapiens
ctcgttcagctcctg

SEQ ID NO: 18875 - DNA, 15 bp, Homo sapiens
cctcgttcagctcct

SEQ ID NO: 18876 - DNA, 15 bp, Homo sapiens
ccctcgttcagctcc

SEQ ID NO: 18877 - DNA, 15 bp, Homo sapiens
cccctcgttcagctc

SEQ ID NO: 18878 - DNA, 15 bp, Homo sapiens
acccctcgttcagct

SEQ ID NO: 18879 - DNA, 15 bp, Homo sapiens
aacccctcgttcagc

SEQ ID NO: 18880 - DNA, 15 bp, Homo sapiens
taacccctcgttcag

SEQ ID NO: 18881 - DNA, 15 bp, Homo sapiens
ctaacccctcgttca

SEQ ID NO: 18882 - DNA, 15 bp, Homo sapiens
cctaacccctcgttc

SEQ ID NO: 18883 - DNA, 15 bp, Homo sapiens
ccctaacccctcgtt

SEQ ID NO: 18884 - DNA, 15 bp, Homo sapiens
cccctaacccctcgt

SEQ ID NO: 18885 - DNA, 15 bp, Homo sapiens
tcccctaacccctcg

SEQ ID NO: 18886 - DNA, 15 bp, Homo sapiens
ctcccctaacccctc

SEQ ID NO: 18887 - DNA, 15 bp, Homo sapiens
tctcccctaacccct

SEQ ID NO: 18888 - DNA, 15 bp, Homo sapiens
ctctcccctaacccc

SEQ ID NO: 18889 - DNA, 15 bp, Homo sapiens
actctcccctaaccc

SEQ ID NO: 18890 - DNA, 15 bp, Homo sapiens
cactctcccctaacc

SEQ ID NO: 18891 - DNA, 15 bp, Homo sapiens
ccactctcccctaac

SEQ ID NO: 18892 - DNA, 15 bp, Homo sapiens
gccactctcccctaa

SEQ ID NO: 18893 - DNA, 15 bp, Homo sapiens
tgccactctccccta

SEQ ID NO: 18894 - DNA, 15 bp, Homo sapiens
ttgccactctcccct

SEQ ID NO: 18895 - DNA, 15 bp, Homo sapiens
tttgccactctcccc

SEQ ID NO: 18896 - DNA, 15 bp, Homo sapiens
ctttgccactctccc

SEQ ID NO: 18897 - DNA, 15 bp, Homo sapiens
cctttgccactctcc

SEQ ID NO: 18898 - DNA, 15 bp, Homo sapiens
ccctttgccactctc

SEQ ID NO: 18899 - DNA, 15 bp, Homo sapiens
accctttgccactct

SEQ ID NO: 18900 - DNA, 15 bp, Homo sapiens
gaccctttgccactc

SEQ ID NO: 18901 - DNA, 15 bp, Homo sapiens
ggaccctttgccact

SEQ ID NO: 18902 - DNA, 15 bp, Homo sapiens
cggaccctttgccac

SEQ ID NO: 18903 - DNA, 15 bp, Homo sapiens
ccggaccctttgcca

SEQ ID NO: 18904 - DNA, 15 bp, Homo sapiens
cccggaccctttgcc

SEQ ID NO: 18905 - DNA, 15 bp, Homo sapiens
gcccggaccctttgc

SEQ ID NO: 18906 - DNA, 15 bp, Homo sapiens
ggcccggaccctttg

SEQ ID NO: 18907 - DNA, 15 bp, Homo sapiens
tggcccggacccttt

SEQ ID NO: 18908 - DNA, 15 bp, Homo sapiens
atggcccggaccctt

SEQ ID NO: 18909 - DNA, 15 bp, Homo sapiens
gatggcccggaccct

SEQ ID NO: 18910 - DNA, 15 bp, Homo sapiens
tgatggcccggaccc

SEQ ID NO: 18911 - DNA, 15 bp, Homo sapiens
ctgatggcccggacc

SEQ ID NO: 18912 - DNA, 15 bp, Homo sapiens
tctgatggcccggac

SEQ ID NO: 18913 - DNA, 15 bp, Homo sapiens
ctctgatggcccgga

SEQ ID NO: 18914 - DNA, 15 bp, Homo sapiens
tctctgatggcccgg

SEQ ID NO: 18915 - DNA, 15 bp, Homo sapiens
ctctctgatggcccg

SEQ ID NO: 18916 - DNA, 15 bp, Homo sapiens
cctctctgatggccc

SEQ ID NO: 18917 - DNA, 15 bp, Homo sapiens
acctctctgatggcc

SEQ ID NO: 18918 - DNA, 15 bp, Homo sapiens
gacctctctgatggc

SEQ ID NO: 18919 - DNA, 15 bp, Homo sapiens
tgacctctctgatgg

SEQ ID NO: 18920 - DNA, 15 bp, Homo sapiens
ttgacctctctgatg

SEQ ID NO: 18921 - DNA, 15 bp, Homo sapiens
gttgacctctctgat

SEQ ID NO: 18922 - DNA, 15 bp, Homo sapiens
tgttgacctctctga

SEQ ID NO: 18923 - DNA, 15 bp, Homo sapiens
ctgttgacctctctg

SEQ ID NO: 18924 - DNA, 15 bp, Homo sapiens
cctgttgacctctct

SEQ ID NO: 18925 - DNA, 15 bp, Homo sapiens
ccctgttgacctctc

SEQ ID NO: 18926 - DNA, 15 bp, Homo sapiens
cccctgttgacctct

SEQ ID NO: 18927 - DNA, 15 bp, Homo sapiens
gcccctgttgacctc

SEQ ID NO: 18928 - DNA, 15 bp, Homo sapiens
agcccctgttgacct

SEQ ID NO: 18929 - DNA, 15 bp, Homo sapiens
cagcccctgttgacc

SEQ ID NO: 18930 - DNA, 15 bp, Homo sapiens
ccagcccctgttgac

SEQ ID NO: 18931 - DNA, 15 bp, Homo sapiens
tccagcccctgttga

SEQ ID NO: 18932 - DNA, 15 bp, Homo sapiens
atccagcccctgttg

SEQ ID NO: 18933 - DNA, 15 bp, Homo sapiens
gatccagcccctgtt

SEQ ID NO: 18934 - DNA, 15 bp, Homo sapiens
tgatccagcccctgt

SEQ ID NO: 18935 - DNA, 15 bp, Homo sapiens
atgatccagcccctg

SEQ ID NO: 18936 - DNA, 15 bp, Homo sapiens
catgatccagcccct

SEQ ID NO: 18937 - DNA, 15 bp, Homo sapiens
gcatgatccagcccc

SEQ ID NO: 18938 - DNA, 15 bp, Homo sapiens
tgcatgatccagccc

SEQ ID NO: 18939 - DNA, 15 bp, Homo sapiens
ctgcatgatccagcc

SEQ ID NO: 18940 - DNA, 15 bp, Homo sapiens
cctgcatgatccagc

SEQ ID NO: 18941 - DNA, 15 bp, Homo sapiens
tcctgcatgatccag

SEQ ID NO: 18942 - DNA, 15 bp, Homo sapiens
atcctgcatgatcca

SEQ ID NO: 18943 - DNA, 15 bp, Homo sapiens
aatcctgcatgatcc

SEQ ID NO: 18944 - DNA, 15 bp, Homo sapiens
aaatcctgcatgatc

SEQ ID NO: 18945 - DNA, 15 bp, Homo sapiens
aaaatcctgcatgat

SEQ ID NO: 18946 - DNA, 15 bp, Homo sapiens
caaaatcctgcatga

SEQ ID NO: 18947 - DNA, 15 bp, Homo sapiens
tcaaaatcctgcatg

SEQ ID NO: 18948 - DNA, 15 bp, Homo sapiens
ttcaaaatcctgcat

SEQ ID NO: 18949 - DNA, 15 bp, Homo sapiens
attcaaaatcctgca

SEQ ID NO: 18950 - DNA, 15 bp, Homo sapiens
cattcaaaatcctgc

SEQ ID NO: 18951 - DNA, 15 bp, Homo sapiens
acattcaaaatcctg

SEQ ID NO: 18952 - DNA, 15 bp, Homo sapiens
aacattcaaaatcct

SEQ ID NO: 18953 - DNA, 15 bp, Homo sapiens
taacattcaaaatcc

SEQ ID NO: 18954 - DNA, 15 bp, Homo sapiens
ttaacattcaaaatc

SEQ ID NO: 18955 - DNA, 15 bp, Homo sapiens
gttaacattcaaaat

SEQ ID NO: 18956 - DNA, 15 bp, Homo sapiens
tgttaacattcaaaa

SEQ ID NO: 18957 - DNA, 15 bp, Homo sapiens
atgttaacattcaaa

SEQ ID NO: 18958 - DNA, 15 bp, Homo sapiens
gatgttaacattcaa

SEQ ID NO: 18959 - DNA, 15 bp, Homo sapiens
tgatgttaacattca

SEQ ID NO: 18960 - DNA, 15 bp, Homo sapiens
ctgatgttaacattc

SEQ ID NO: 18961 - DNA, 15 bp, Homo sapiens
tctgatgttaacatt

SEQ ID NO: 18962 - DNA, 15 bp, Homo sapiens
ctctgatgttaacat

SEQ ID NO: 18963 - DNA, 15 bp, Homo sapiens
gctctgatgttaaca

SEQ ID NO: 18964 - DNA, 15 bp, Homo sapiens
cgctctgatgttaac

SEQ ID NO: 18965 - DNA, 15 bp, Homo sapiens
tcgctctgatgttaa

SEQ ID NO: 18966 - DNA, 15 bp, Homo sapiens
atcgctctgatgtta

SEQ ID NO: 18967 - DNA, 15 bp, Homo sapiens
tatcgctctgatgtt

SEQ ID NO: 18968 - DNA, 15 bp, Homo sapiens
ctatcgctctgatgt

SEQ ID NO: 18969 - DNA, 15 bp, Homo sapiens
tctatcgctctgatg

SEQ ID NO: 18970 - DNA, 15 bp, Homo sapiens
ttctatcgctctgat

SEQ ID NO: 18971 - DNA, 15 bp, Homo sapiens
tttctatcgctctga

SEQ ID NO: 18972 - DNA, 15 bp, Homo sapiens
ttttctatcgctctg

SEQ ID NO: 18973 - DNA, 15 bp, Homo sapiens
gttttctatcgctct

SEQ ID NO: 18974 - DNA, 15 bp, Homo sapiens
tgttttctatcgctc

SEQ ID NO: 18975 - DNA, 15 bp, Homo sapiens
atgttttctatcgct

SEQ ID NO: 18976 - DNA, 15 bp, Homo sapiens
catgttttctatcgc

SEQ ID NO: 18977 - DNA, 15 bp, Homo sapiens
tcatgttttctatcg

SEQ ID NO: 18978 - DNA, 15 bp, Homo sapiens
ttcatgttttctatc

SEQ ID NO: 18979 - DNA, 15 bp, Homo sapiens
cttcatgttttctat

SEQ ID NO: 18980 - DNA, 15 bp, Homo sapiens
ccttcatgttttcta

SEQ ID NO: 18981 - DNA, 15 bp, Homo sapiens
cccttcatgttttct

SEQ ID NO: 18982 - DNA, 15 bp, Homo sapiens
acccttcatgttttc

SEQ ID NO: 18983 - DNA, 15 bp, Homo sapiens
tacccttcatgtttt

SEQ ID NO: 18984 - DNA, 15 bp, Homo sapiens
ttacccttcatgttt

SEQ ID NO: 18985 - DNA, 15 bp, Homo sapiens
cttacccttcatgtt

SEQ ID NO: 18986 - DNA, 15 bp, Homo sapiens
ccttacccttcatgt

SEQ ID NO: 18987 - DNA, 15 bp, Homo sapiens
accttacccttcatg

SEQ ID NO: 18988 - DNA, 15 bp, Homo sapiens
caccttacccttcat

SEQ ID NO: 18989 - DNA, 15 bp, Homo sapiens
ccaccttacccttca

SEQ ID NO: 18990 - DNA, 15 bp, Homo sapiens
accaccttacccttc

SEQ ID NO: 18991 - DNA, 15 bp, Homo sapiens
aaccaccttaccctt

SEQ ID NO: 18992 - DNA, 15 bp, Homo sapiens
aaaccaccttaccct

SEQ ID NO: 18993 - DNA, 15 bp, Homo sapiens
caaaccaccttaccc

SEQ ID NO: 18994 - DNA, 15 bp, Homo sapiens
ccaaaccaccttacc

SEQ ID NO: 18995 - DNA, 15 bp, Homo sapiens
cccaaaccaccttac

SEQ ID NO: 18996 - DNA, 15 bp, Homo sapiens
acccaaaccacctta

SEQ ID NO: 18997 - DNA, 15 bp, Homo sapiens
aacccaaaccacctt

SEQ ID NO: 18998 - DNA, 15 bp, Homo sapiens
aaacccaaaccacct

SEQ ID NO: 18999 - DNA, 15 bp, Homo sapiens
caaaacccaaaccac

SEQ ID NO: 19000 - DNA, 15 bp, Homo sapiens
tcaaaacccaaacca

SEQ ID NO: 19001 - DNA, 15 bp, Homo sapiens
ttcaaaacccaaacc

SEQ ID NO: 19002 - DNA, 15 bp, Homo sapiens
attcaaaacccaaac

SEQ ID NO: 19003 - DNA, 15 bp, Homo sapiens
aattcaaaacccaaa

SEQ ID NO: 19004 - DNA, 15 bp, Homo sapiens
aaattcaaaacccaa

SEQ ID NO: 19005 - DNA, 15 bp, Homo sapiens
aaaattcaaaaccca

SEQ ID NO: 19006 - DNA, 15 bp, Homo sapiens
aaaaattcaaaaccc

SEQ ID NO: 19007 - DNA, 15 bp, Homo sapiens
taaaaattcaaaacc

SEQ ID NO: 19008 - DNA, 15 bp, Homo sapiens
ataaaaattcaaaac

SEQ ID NO: 19009 - DNA, 15 bp, Homo sapiens
gataaaaattcaaaa

SEQ ID NO: 19010 - DNA, 15 bp, Homo sapiens
tgataaaaattcaaa

SEQ ID NO: 19011 - DNA, 15 bp, Homo sapiens
ttgataaaaattcaa

SEQ ID NO: 19012 - DNA, 15 bp, Homo sapiens
tttgataaaaattca

SEQ ID NO: 19013 - DNA, 15 bp, Homo sapiens
ttttgataaaaattc

SEQ ID NO: 19014 - DNA, 15 bp, Homo sapiens
attttgataaaaatt

SEQ ID NO: 19015 - DNA, 15 bp, Homo sapiens
tattttgataaaaat

SEQ ID NO: 19016 - DNA, 15 bp, Homo sapiens
atattttgataaaaa

SEQ ID NO: 19017 - DNA, 15 bp, Homo sapiens
aatattttgataaaa

SEQ ID NO: 19018 - DNA, 15 bp, Homo sapiens
caatattttgataaa

SEQ ID NO: 19019 - DNA, 15 bp, Homo sapiens
gcaatattttgataa

SEQ ID NO: 19020 - DNA, 15 bp, Homo sapiens
tgcaatattttgata

SEQ ID NO: 19021 - DNA, 15 bp, Homo sapiens
ttgcaatattttgat

SEQ ID NO: 19022 - DNA, 15 bp, Homo sapiens
gttgcaatattttga

SEQ ID NO: 19023 - DNA, 15 bp, Homo sapiens
agttgcaatattttg

SEQ ID NO: 19024 - DNA, 15 bp, Homo sapiens
tagttgcaatatttt

SEQ ID NO: 19025 - DNA, 15 bp, Homo sapiens
gtagttgcaatattt

SEQ ID NO: 19026 - DNA, 15 bp, Homo sapiens
agtagttgcaatatt

SEQ ID NO: 19027 - DNA, 15 bp, Homo sapiens
gagtagttgcaatat

SEQ ID NO: 19028 - DNA, 15 bp, Homo sapiens
cgagtagttgcaata

SEQ ID NO: 19029 - DNA, 15 bp, Homo sapiens
ccgagtagttgcaat

SEQ ID NO: 19030 - DNA, 15 bp, Homo sapiens
gccgagtagttgcaa

SEQ ID NO: 19031 - DNA, 15 bp, Homo sapiens
tgccgagtagttgca

SEQ ID NO: 19032 - DNA, 15 bp, Homo sapiens
ttgccgagtagttgc

SEQ ID NO: 19033 - DNA, 15 bp, Homo sapiens
gttgccgagtagttg

SEQ ID NO: 19034 - DNA, 15 bp, Homo sapiens
tgttgccgagtagtt

SEQ ID NO: 19035 - DNA, 15 bp, Homo sapiens
ttgttgccgagtagt

SEQ ID NO: 19036 - DNA, 15 bp, Homo sapiens
cttgttgccgagtag

SEQ ID NO: 19037 - DNA, 15 bp, Homo sapiens
acttgttgccgagta

SEQ ID NO: 19038 - DNA, 15 bp, Homo sapiens
aacttgttgccgagt

SEQ ID NO: 19039 - DNA, 15 bp, Homo sapiens
taacttgttgccgag

SEQ ID NO: 19040 - DNA, 15 bp, Homo sapiens
ctaacttgttgccga

SEQ ID NO: 19041 - DNA, 15 bp, Homo sapiens
tctaacttgttgccg

SEQ ID NO: 19042 - DNA, 15 bp, Homo sapiens
atctaacttgttgcc

SEQ ID NO: 19043 - DNA, 15 bp, Homo sapiens
tatctaacttgttgc

SEQ ID NO: 19044 - DNA, 15 bp, Homo sapiens
atatctaacttgttg

SEQ ID NO: 19045 - DNA, 15 bp, Homo sapiens
tatatctaacttgtt

SEQ ID NO: 19046 - DNA, 15 bp, Homo sapiens
ttatatctaacttgt

SEQ ID NO: 19047 - DNA, 15 bp, Homo sapiens
gttatatctaacttg

SEQ ID NO: 19048 - DNA, 15 bp, Homo sapiens
tgttatatctaactt

SEQ ID NO: 19049 - DNA, 15 bp, Homo sapiens
ttgttatatctaact

SEQ ID NO: 19050 - DNA, 15 bp, Homo sapiens
tttgttatatctaac

SEQ ID NO: 19051 - DNA, 15 bp, Homo sapiens
ttttgttatatctaa

SEQ ID NO: 19052 - DNA, 15 bp, Homo sapiens
cttttgttatatcta

SEQ ID NO: 19053 - DNA, 15 bp, Homo sapiens
tcttttgttatatct

SEQ ID NO: 19054 - DNA, 15 bp, Homo sapiens
ctcttttgttatatc

SEQ ID NO: 19055 - DNA, 15 bp, Homo sapiens
cctcttttgttatat

SEQ ID NO: 19056 - DNA, 15 bp, Homo sapiens
acctcttttgttata

SEQ ID NO: 19057 - DNA, 15 bp, Homo sapiens
gacctcttttgttat

SEQ ID NO: 19058 - DNA, 15 bp, Homo sapiens
tgacctcttttgtta

SEQ ID NO: 19059 - DNA, 15 bp, Homo sapiens
atgacctcttttgtt

SEQ ID NO: 19060 - DNA, 15 bp, Homo sapiens
gatgacctcttttgt

SEQ ID NO: 19061 - DNA, 15 bp, Homo sapiens
cgatgacctcttttg

SEQ ID NO: 19062 - DNA, 15 bp, Homo sapiens
acgatgacctctttt

SEQ ID NO: 19063 - DNA, 15 bp, Homo sapiens
tacgatgacctcttt

SEQ ID NO: 19064 - DNA, 15 bp, Homo sapiens
ttacgatgacctctt

SEQ ID NO: 19065 - DNA, 15 bp, Homo sapiens
tttacgatgacctct

SEQ ID NO: 19066 - DNA, 15 bp, Homo sapiens
ttttacgatgacctc

SEQ ID NO: 19067 - DNA, 15 bp, Homo sapiens
tttttacgatgacct

SEQ ID NO: 19068 - DNA, 15 bp, Homo sapiens
gtttttacgatgacc

SEQ ID NO: 19069 - DNA, 15 bp, Homo sapiens
tgtttttacgatgac

SEQ ID NO: 19070 - DNA, 15 bp, Homo sapiens
ctgtttttacgatga

SEQ ID NO: 19071 - DNA, 15 bp, Homo sapiens
gctgtttttacgatg

SEQ ID NO: 19072 - DNA, 15 bp, Homo sapiens
tgctgtttttacgat

SEQ ID NO: 19073 - DNA, 15 bp, Homo sapiens
ctgctgtttttacga

SEQ ID NO: 19074 - DNA, 15 bp, Homo sapiens
actgctgtttttacg

SEQ ID NO: 19075 - DNA, 15 bp, Homo sapiens
gactgctgtttttac

SEQ ID NO: 19076 - DNA, 15 bp, Homo sapiens
agactgctgttttta

SEQ ID NO: 19077 - DNA, 15 bp, Homo sapiens
tagactgctgttttt

SEQ ID NO: 19078 - DNA, 15 bp, Homo sapiens
gtagactgctgtttt

SEQ ID NO: 19079 - DNA, 15 bp, Homo sapiens
ggtagactgctgttt

SEQ ID NO: 19080 - DNA, 15 bp, Homo sapiens
gggtagactgctgtt

SEQ ID NO: 19081 - DNA, 15 bp, Homo sapiens
ggggtagactgctgt

SEQ ID NO: 19082 - DNA, 15 bp, Homo sapiens
aggggtagactgctg

SEQ ID NO: 19083 - DNA, 15 bp, Homo sapiens
aaggggtagactgct

SEQ ID NO: 19084 - DNA, 15 bp, Homo sapiens
gaaggggtagactgc

SEQ ID NO: 19085 - DNA, 15 bp, Homo sapiens
ggaaggggtagactg

SEQ ID NO: 19086 - DNA, 15 bp, Homo sapiens
gggaaggggtagact

SEQ ID NO: 19087 - DNA, 15 bp, Homo sapiens
ggggaaggggtagac

SEQ ID NO: 19088 - DNA, 15 bp, Homo sapiens
aggggaaggggtaga

SEQ ID NO: 19089 - DNA, 15 bp, Homo sapiens
aaggggaaggggtag

SEQ ID NO: 19090 - DNA, 15 bp, Homo sapiens
gaaggggaaggggta

SEQ ID NO: 19091 - DNA, 15 bp, Homo sapiens
ggaaggggaaggggt

SEQ ID NO: 19092 - DNA, 15 bp, Homo sapiens
gggaaggggaagggg

SEQ ID NO: 19093 - DNA, 15 bp, Homo sapiens
agggaaggggaaggg

SEQ ID NO: 19094 - DNA, 15 bp, Homo sapiens
aagggaaggggaagg

SEQ ID NO: 19095 - DNA, 15 bp, Homo sapiens
gaagggaaggggaag

SEQ ID NO: 19096 - DNA, 15 bp, Homo sapiens
ggaagggaaggggaa

SEQ ID NO: 19097 - DNA, 15 bp, Homo sapiens
gggaagggaagggga

SEQ ID NO: 19098 - DNA, 15 bp, Homo sapiens
agggaagggaagggg

SEQ ID NO: 19099 - DNA, 15 bp, Homo sapiens
cagggaagggaaggg

SEQ ID NO: 19100 - DNA, 15 bp, Homo sapiens
tcagggaagggaagg

SEQ ID NO: 19101 - DNA, 15 bp, Homo sapiens
gtcagggaagggaag

SEQ ID NO: 19102 - DNA, 15 bp, Homo sapiens
agtcagggaagggaa

SEQ ID NO: 19103 - DNA, 15 bp, Homo sapiens
gagtcagggaaggga

SEQ ID NO: 19104 - DNA, 15 bp, Homo sapiens
tgagtcagggaaggg

SEQ ID NO: 19105 - DNA, 15 bp, Homo sapiens
ctgagtcagggaagg

SEQ ID NO: 19106 - DNA, 15 bp, Homo sapiens
tctgagtcagggaag

SEQ ID NO: 19107 - DNA, 15 bp, Homo sapiens
gtctgagtcagggaa

SEQ ID NO: 19108 - DNA, 15 bp, Homo sapiens
tgtctgagtcaggga

SEQ ID NO: 19109 - DNA, 15 bp, Homo sapiens
atgtctgagtcaggg

SEQ ID NO: 19110 - DNA, 15 bp, Homo sapiens
catgtctgagtcagg

SEQ ID NO: 19111 - DNA, 15 bp, Homo sapiens
tcatgtctgagtcag

SEQ ID NO: 19112 - DNA, 15 bp, Homo sapiens
gtcatgtctgagtca

SEQ ID NO: 19113 - DNA, 15 bp, Homo sapiens
tgtcatgtctgagtc

SEQ ID NO: 19114 - DNA, 15 bp, Homo sapiens
ctgtcatgtctgagt

SEQ ID NO: 19115 - DNA, 15 bp, Homo sapiens
gctgtcatgtctgag

SEQ ID NO: 19116 - DNA, 15 bp, Homo sapiens
agctgtcatgtctga

SEQ ID NO: 19117 - DNA, 15 bp, Homo sapiens
aagctgtcatgtctg

SEQ ID NO: 19118 - DNA, 15 bp, Homo sapiens
aaagctgtcatgtct

SEQ ID NO: 19119 - DNA, 15 bp, Homo sapiens
aaaagctgtcatgtc

SEQ ID NO: 19120 - DNA, 15 bp, Homo sapiens
taaaagctgtcatgt

SEQ ID NO: 19121 - DNA, 15 bp, Homo sapiens
ttaaaagctgtcatg

SEQ ID NO: 19122 - DNA, 15 bp, Homo sapiens
gttaaaagctgtcat

SEQ ID NO: 19123 - DNA, 15 bp, Homo sapiens
agttaaaagctgtca

SEQ ID NO: 19124 - DNA, 15 bp, Homo sapiens
cagttaaaagctgtc

SEQ ID NO: 19125 - DNA, 15 bp, Homo sapiens
acagttaaaagctgt

SEQ ID NO: 19126 - DNA, 15 bp, Homo sapiens
aacagttaaaagctg

SEQ ID NO: 19127 - DNA, 15 bp, Homo sapiens
aaacagttaaaagct

SEQ ID NO: 19128 - DNA, 15 bp, Homo sapiens
gaaacagttaaaagc

SEQ ID NO: 19129 - DNA, 15 bp, Homo sapiens
agaaacagttaaaag

SEQ ID NO: 19130 - DNA, 15 bp, Homo sapiens
cagaaacagttaaaa

SEQ ID NO: 19131 - DNA, 15 bp, Homo sapiens
tcagaaacagttaaa

SEQ ID NO: 19132 - DNA, 15 bp, Homo sapiens
atcagaaacagttaa

SEQ ID NO: 19133 - DNA, 15 bp, Homo sapiens
aatcagaaacagtta

SEQ ID NO: 19134 - DNA, 15 bp, Homo sapiens
aaatcagaaacagtt

SEQ ID NO: 19135 - DNA, 15 bp, Homo sapiens
aaaatcagaaacagt

SEQ ID NO: 19136 - DNA, 15 bp, Homo sapiens
taaaatcagaaacag

SEQ ID NO: 19137 - DNA, 15 bp, Homo sapiens
ctaaaatcagaaaca

SEQ ID NO: 19138 - DNA, 15 bp, Homo sapiens
actaaaatcagaaac

SEQ ID NO: 19139 - DNA, 15 bp, Homo sapiens
aactaaaatcagaaa

SEQ ID NO: 19140 - DNA, 15 bp, Homo sapiens
gaactaaaatcagaa

SEQ ID NO: 19141 - DNA, 15 bp, Homo sapiens
ggaactaaaatcaga

SEQ ID NO: 19142 - DNA, 15 bp, Homo sapiens
aggaactaaaatcag

SEQ ID NO: 19143 - DNA, 15 bp, Homo sapiens
aaggaactaaaatca

SEQ ID NO: 19144 - DNA, 15 bp, Homo sapiens
aaaggaactaaaatc

SEQ ID NO: 19145 - DNA, 15 bp, Homo sapiens
caaaggaactaaaat

SEQ ID NO: 19146 - DNA, 15 bp, Homo sapiens
tcaaaggaactaaaa

SEQ ID NO: 19147 - DNA, 15 bp, Homo sapiens
atcaaaggaactaaa

SEQ ID NO: 19148 - DNA, 15 bp, Homo sapiens
catcaaaggaactaa

SEQ ID NO: 19149 - DNA, 15 bp, Homo sapiens
ccatcaaaggaacta

SEQ ID NO: 19150 - DNA, 15 bp, Homo sapiens
accatcaaaggaact

SEQ ID NO: 19151 - DNA, 15 bp, Homo sapiens
aaccatcaaaggaac

SEQ ID NO: 19152 - DNA, 15 bp, Homo sapiens
taaccatcaaaggaa

SEQ ID NO: 19153 - DNA, 15 bp, Homo sapiens
gtaaccatcaaagga

SEQ ID NO: 19154 - DNA, 15 bp, Homo sapiens
ggtaaccatcaaagg

SEQ ID NO: 19155 - DNA, 15 bp, Homo sapiens
aggtaaccatcaaag

SEQ ID NO: 19156 - DNA, 15 bp, Homo sapiens
gaggtaaccatcaaa

SEQ ID NO: 19157 - DNA, 15 bp, Homo sapiens
ggaggtaaccatcaa

SEQ ID NO: 19158 - DNA, 15 bp, Homo sapiens
tggaggtaaccatca

SEQ ID NO: 19159 - DNA, 15 bp, Homo sapiens
ttggaggtaaccatc

SEQ ID NO: 19160 - DNA, 15 bp, Homo sapiens
tttggaggtaaccat

SEQ ID NO: 19161 - DNA, 15 bp, Homo sapiens
ttttggaggtaacca

SEQ ID NO: 19162 - DNA, 15 bp, Homo sapiens
attttggaggtaacc

SEQ ID NO: 19163 - DNA, 15 bp, Homo sapiens
aattttggaggtaac

SEQ ID NO: 19164 - DNA, 15 bp, Homo sapiens
taattttggaggtaa

SEQ ID NO: 19165 - DNA, 15 bp, Homo sapiens
ttaattttggaggta

SEQ ID NO: 19166 - DNA, 15 bp, Homo sapiens
tttaattttggaggt

SEQ ID NO: 19167 - DNA, 15 bp, Homo sapiens
atttaattttggagg

SEQ ID NO: 19168 - DNA, 15 bp, Homo sapiens
gatttaattttggag

SEQ ID NO: 19169 - DNA, 15 bp, Homo sapiens
tgatttaattttgga

SEQ ID NO: 19170 - DNA, 15 bp, Homo sapiens
atgatttaattttgg

SEQ ID NO: 19171 - DNA, 15 bp, Homo sapiens
tatgatttaattttg

SEQ ID NO: 19172 - DNA, 15 bp, Homo sapiens
atatgatttaatttt

SEQ ID NO: 19173 - DNA, 15 bp, Homo sapiens
catatgatttaattt

SEQ ID NO: 19174 - DNA, 15 bp, Homo sapiens
gcatatgatttaatt

SEQ ID NO: 19175 - DNA, 15 bp, Homo sapiens
agcatatgatttaat

SEQ ID NO: 19176 - DNA, 15 bp, Homo sapiens
aagcatatgatttaa

SEQ ID NO: 19177 - DNA, 15 bp, Homo sapiens
taagcatatgattta

SEQ ID NO: 19178 - DNA, 15 bp, Homo sapiens
ataagcatatgattt

SEQ ID NO: 19179 - DNA, 15 bp, Homo sapiens
tataagcatatgatt

SEQ ID NO: 19180 - DNA, 15 bp, Homo sapiens
gtataagcatatgat

SEQ ID NO: 19181 - DNA, 15 bp, Homo sapiens
tgtataagcatatga

SEQ ID NO: 19182 - DNA, 15 bp, Homo sapiens
atgtataagcatatg

SEQ ID NO: 19183 - DNA, 15 bp, Homo sapiens
gatgtataagcatat

SEQ ID NO: 19184 - DNA, 15 bp, Homo sapiens
agatgtataagcata

SEQ ID NO: 19185 - DNA, 15 bp, Homo sapiens
aagatgtataagcat

SEQ ID NO: 19186 - DNA, 15 bp, Homo sapiens
aaagatgtataagca

SEQ ID NO: 19187 - DNA, 15 bp, Homo sapiens
gaaagatgtataagc

SEQ ID NO: 19188 - DNA, 15 bp, Homo sapiens
agaaagatgtataag

SEQ ID NO: 19189 - DNA, 15 bp, Homo sapiens
aagaaagatgtataa

SEQ ID NO: 19190 - DNA, 15 bp, Homo sapiens
caagaaagatgtata

SEQ ID NO: 19191 - DNA, 15 bp, Homo sapiens
tcaagaaagatgtat

SEQ ID NO: 19192 - DNA, 15 bp, Homo sapiens
atcaagaaagatgta

SEQ ID NO: 19193 - DNA, 15 bp, Homo sapiens
aatcaagaaagatgt

SEQ ID NO: 19194 - DNA, 15 bp, Homo sapiens
aaatcaagaaagatg

SEQ ID NO: 19195 - DNA, 15 bp, Homo sapiens
caaatcaagaaagat

SEQ ID NO: 19196 - DNA, 15 bp, Homo sapiens
gcaaatcaagaaaga

SEQ ID NO: 19197 - DNA, 15 bp, Homo sapiens
ggcaaatcaagaaag

SEQ ID NO: 19198 - DNA, 15 bp, Homo sapiens
tggcaaatcaagaaa

SEQ ID NO: 19199 - DNA, 15 bp, Homo sapiens
ttggcaaatcaagaa

SEQ ID NO: 19200 - DNA, 15 bp, Homo sapiens
gttggcaaatcaaga

SEQ ID NO: 19201 - DNA, 15 bp, Homo sapiens
agttggcaaatcaag

SEQ ID NO: 19202 - DNA, 15 bp, Homo sapiens
aagttggcaaatcaa

SEQ ID NO: 19203 - DNA, 15 bp, Homo sapiens
aaagttggcaaatca

SEQ ID NO: 19204 - DNA, 15 bp, Homo sapiens
taaagttggcaaatc

SEQ ID NO: 19205 - DNA, 15 bp, Homo sapiens
ctaaagttggcaaat

SEQ ID NO: 19206 - DNA, 15 bp, Homo sapiens
cctaaagttggcaaa

SEQ ID NO: 19207 - DNA, 15 bp, Homo sapiens
ccctaaagttggcaa

SEQ ID NO: 19208 - DNA, 15 bp, Homo sapiens
tccctaaagttggca

SEQ ID NO: 19209 - DNA, 15 bp, Homo sapiens
ttccctaaagttggc

SEQ ID NO: 19210 - DNA, 15 bp, Homo sapiens
gttccctaaagttgg

SEQ ID NO: 19211 - DNA, 15 bp, Homo sapiens
agttccctaaagttg

SEQ ID NO: 19212 - DNA, 15 bp, Homo sapiens
cagttccctaaagtt

SEQ ID NO: 19213 - DNA, 15 bp, Homo sapiens
acagttccctaaagt

SEQ ID NO: 19214 - DNA, 15 bp, Homo sapiens
cacagttccctaaag

SEQ ID NO: 19215 - DNA, 15 bp, Homo sapiens
acacagttccctaaa

SEQ ID NO: 19216 - DNA, 15 bp, Homo sapiens
aacacagttccctaa

SEQ ID NO: 19217 - DNA, 15 bp, Homo sapiens
taacacagttcccta

SEQ ID NO: 19218 - DNA, 15 bp, Homo sapiens
ttaacacagttccct

SEQ ID NO: 19219 - DNA, 15 bp, Homo sapiens
gttaacacagttccc

SEQ ID NO: 19220 - DNA, 15 bp, Homo sapiens
agttaacacagttcc

SEQ ID NO: 19221 - DNA, 15 bp, Homo sapiens
gagttaacacagttc

SEQ ID NO: 19222 - DNA, 15 bp, Homo sapiens
ggagttaacacagtt

SEQ ID NO: 19223 - DNA, 15 bp, Homo sapiens
gggagttaacacagt

SEQ ID NO: 19224 - DNA, 15 bp, Homo sapiens
agggagttaacacag

SEQ ID NO: 19225 - DNA, 15 bp, Homo sapiens
cagggagttaacaca

SEQ ID NO: 19226 - DNA, 15 bp, Homo sapiens
tcagggagttaacac

SEQ ID NO: 19227 - DNA, 15 bp, Homo sapiens
ttcagggagttaaca

SEQ ID NO: 19228 - DNA, 15 bp, Homo sapiens
tttcagggagttaac

SEQ ID NO: 19229 - DNA, 15 bp, Homo sapiens
atttcagggagttaa

SEQ ID NO: 19230 - DNA, 15 bp, Homo sapiens
catttcagggagtta

SEQ ID NO: 19231 - DNA, 15 bp, Homo sapiens
tcatttcagggagtt

SEQ ID NO: 19232 - DNA, 15 bp, Homo sapiens
ttcatttcagggagt

SEQ ID NO: 19233 - DNA, 15 bp, Homo sapiens
tttcatttcagggag

SEQ ID NO: 19234 - DNA, 15 bp, Homo sapiens
ctttcatttcaggga

SEQ ID NO: 19235 - DNA, 15 bp, Homo sapiens
tctttcatttcaggg

SEQ ID NO: 19236 - DNA, 15 bp, Homo sapiens
ctctttcatttcagg

SEQ ID NO: 19237 - DNA, 15 bp, Homo sapiens
tctctttcatttcag

SEQ ID NO: 19238 - DNA, 15 bp, Homo sapiens
ttctctttcatttca

SEQ ID NO: 19239 - DNA, 15 bp, Homo sapiens
attctctttcatttc

SEQ ID NO: 19240 - DNA, 15 bp, Homo sapiens
cattctctttcattt

SEQ ID NO: 19241 - DNA, 15 bp, Homo sapiens
tcattctctttcatt

SEQ ID NO: 19242 - DNA, 15 bp, Homo sapiens
gtcattctctttcat

SEQ ID NO: 19243 - DNA, 15 bp, Homo sapiens
agtcattctctttca

SEQ ID NO: 19244 - DNA, 15 bp, Homo sapiens
aagtcattctctttc

SEQ ID NO: 19245 - DNA, 15 bp, Homo sapiens
taagtcattctcttt

SEQ ID NO: 19246 - DNA, 15 bp, Homo sapiens
ctaagtcattctctt

SEQ ID NO: 19247 - DNA, 15 bp, Homo sapiens
gctaagtcattctct

SEQ ID NO: 19248 - DNA, 15 bp, Homo sapiens
agctaagtcattctc

SEQ ID NO: 19249 - DNA, 15 bp, Homo sapiens
aagctaagtcattct

SEQ ID NO: 19250 - DNA, 15 bp, Homo sapiens
taagctaagtcattc

SEQ ID NO: 19251 - DNA, 15 bp, Homo sapiens
gtaagctaagtcatt

SEQ ID NO: 19252 - DNA, 15 bp, Homo sapiens
cgtaagctaagtcat

SEQ ID NO: 19253 - DNA, 15 bp, Homo sapiens
acgtaagctaagtca

SEQ ID NO: 19254 - DNA, 15 bp, Homo sapiens
aacgtaagctaagtc

SEQ ID NO: 19255 - DNA, 15 bp, Homo sapiens
taacgtaagctaagt

SEQ ID NO: 19256 - DNA, 15 bp, Homo sapiens
gtaacgtaagctaag

SEQ ID NO: 19257 - DNA, 15 bp, Homo sapiens
ggtaacgtaagctaa

SEQ ID NO: 19258 - DNA, 15 bp, Homo sapiens
aggtaacgtaagcta

SEQ ID NO: 19259 - DNA, 15 bp, Homo sapiens
gaggtaacgtaagct

SEQ ID NO: 19260 - DNA, 15 bp, Homo sapiens
ggaggtaacgtaagc

SEQ ID NO: 19261 - DNA, 15 bp, Homo sapiens
gggaggtaacgtaag

SEQ ID NO: 19262 - DNA, 15 bp, Homo sapiens
ggggaggtaacgtaa

SEQ ID NO: 19263 - DNA, 15 bp, Homo sapiens
tggggaggtaacgta

SEQ ID NO: 19264 - DNA, 15 bp, Homo sapiens
atggggaggtaacgt

SEQ ID NO: 19265 - DNA, 15 bp, Homo sapiens
catggggaggtaacg

SEQ ID NO: 19266 - DNA, 15 bp, Homo sapiens
acatggggaggtaac

SEQ ID NO: 19267 - DNA, 15 bp, Homo sapiens
aacatggggaggtaa

SEQ ID NO: 19268 - DNA, 15 bp, Homo sapiens
caacatggggaggta

SEQ ID NO: 19269 - DNA, 15 bp, Homo sapiens
tcaacatggggaggt

SEQ ID NO: 19270 - DNA, 15 bp, Homo sapiens
ttcaacatggggagg

SEQ ID NO: 19271 - DNA, 15 bp, Homo sapiens
tttcaacatggggag

SEQ ID NO: 19272 - DNA, 15 bp, Homo sapiens
atttcaacatgggga

SEQ ID NO: 19273 - DNA, 15 bp, Homo sapiens
aatttcaacatgggg

SEQ ID NO: 19274 - DNA, 15 bp, Homo sapiens
gaatttcaacatggg

SEQ ID NO: 19275 - DNA, 15 bp, Homo sapiens
tgaatttcaacatgg

SEQ ID NO: 19276 - DNA, 15 bp, Homo sapiens
atgaatttcaacatg

SEQ ID NO: 19277 - DNA, 15 bp, Homo sapiens
tatgaatttcaacat

SEQ ID NO: 19278 - DNA, 15 bp, Homo sapiens
atatgaatttcaaca

SEQ ID NO: 19279 - DNA, 15 bp, Homo sapiens
aatatgaatttcaac

SEQ ID NO: 19280 - DNA, 15 bp, Homo sapiens
gaatatgaatttcaa

SEQ ID NO: 19281 - DNA, 15 bp, Homo sapiens
tgaatatgaatttca

SEQ ID NO: 19282 - DNA, 15 bp, Homo sapiens
gtgaatatgaatttc

SEQ ID NO: 19283 - DNA, 15 bp, Homo sapiens
tgtgaatatgaattt

SEQ ID NO: 19284 - DNA, 15 bp, Homo sapiens
atgtgaatatgaatt

SEQ ID NO: 19285 - DNA, 15 bp, Homo sapiens
aatgtgaatatgaat

SEQ ID NO: 19286 - DNA, 15 bp, Homo sapiens
aaatgtgaatatgaa

SEQ ID NO: 19287 - DNA, 15 bp, Homo sapiens
gaaatgtgaatatga

SEQ ID NO: 19288 - DNA, 15 bp, Homo sapiens
agaaatgtgaatatg

SEQ ID NO: 19289 - DNA, 15 bp, Homo sapiens
gagaaatgtgaatat

SEQ ID NO: 19290 - DNA, 15 bp, Homo sapiens
agagaaatgtgaata

SEQ ID NO: 19291 - DNA, 15 bp, Homo sapiens
cagagaaatgtgaat

SEQ ID NO: 19292 - DNA, 15 bp, Homo sapiens
acagagaaatgtgaa

SEQ ID NO: 19293 - DNA, 15 bp, Homo sapiens
tacagagaaatgtga

SEQ ID NO: 19294 - DNA, 15 bp, Homo sapiens
ttacagagaaatgtg

SEQ ID NO: 19295 - DNA, 15 bp, Homo sapiens
attacagagaaatgt

SEQ ID NO: 19296 - DNA, 15 bp, Homo sapiens
aattacagagaaatg

SEQ ID NO: 19297 - DNA, 15 bp, Homo sapiens
aaattacagagaaat

SEQ ID NO: 19298 - DNA, 15 bp, Homo sapiens
aaaattacagagaaa

SEQ ID NO: 19299 - DNA, 15 bp, Homo sapiens
aaaaattacagagaa

SEQ ID NO: 19300 - DNA, 15 bp, Homo sapiens
aaaaaattacagaga

SEQ ID NO: 19301 - DNA, 15 bp, Homo sapiens
aaaaaaattacagag

SEQ ID NO: 19302 - DNA, 15 bp, Homo sapiens
aaaaaaaattacaga

SEQ ID NO: 19303 - DNA, 15 bp, Homo sapiens
aaaaaaaaattacag

SEQ ID NO: 19304 - DNA, 15 bp, Homo sapiens
aaaaaaaaaattaca

SEQ ID NO: 19305 - DNA, 15 bp, Homo sapiens
caaaaaaaaaattac

SEQ ID NO: 19306 - DNA, 15 bp, Homo sapiens
tcaaaaaaaaaatta

SEQ ID NO: 19307 - DNA, 15 bp, Homo sapiens
ctcaaaaaaaaaatt

SEQ ID NO: 19308 - DNA, 15 bp, Homo sapiens
tctcaaaaaaaaaat

SEQ ID NO: 19309 - DNA, 15 bp, Homo sapiens
cacctggtttaactc

SEQ ID NO: 19310 - DNA, 15 bp, Homo sapiens
acacctggtttaact

SEQ ID NO: 19311 - DNA, 15 bp, Homo sapiens
cacacctggtttaac

SEQ ID NO: 19312 - DNA, 15 bp, Homo sapiens
ccacacctggtttaa

SEQ ID NO: 19313 - DNA, 15 bp, Homo sapiens
accacacctggttta

SEQ ID NO: 19314 - DNA, 15 bp, Homo sapiens
gaccacacctggttt

SEQ ID NO: 19315 - DNA, 15 bp, Homo sapiens
ggaccacacctggtt

SEQ ID NO: 19316 - DNA, 15 bp, Homo sapiens
aggaccacacctggt

SEQ ID NO: 19317 - DNA, 15 bp, Homo sapiens
aaggaccacacctgg

SEQ ID NO: 19318 - DNA, 15 bp, Homo sapiens
caaggaccacacctg

SEQ ID NO: 19319 - DNA, 15 bp, Homo sapiens
tcaaggaccacacct

SEQ ID NO: 19320 - DNA, 15 bp, Homo sapiens
gtcaaggaccacacc

SEQ ID NO: 19321 - DNA, 15 bp, Homo sapiens
ggtcaaggaccacac

SEQ ID NO: 19322 - DNA, 15 bp, Homo sapiens
gggtcaaggaccaca

SEQ ID NO: 19323 - DNA, 15 bp, Homo sapiens
agggtcaaggaccac

SEQ ID NO: 19324 - DNA, 15 bp, Homo sapiens
gagggtcaaggacca

SEQ ID NO: 19325 - DNA, 15 bp, Homo sapiens
tgagggtcaaggacc

SEQ ID NO: 19326 - DNA, 15 bp, Homo sapiens
atgagggtcaaggac

SEQ ID NO: 19327 - DNA, 15 bp, Homo sapiens
gatgagggtcaagga

SEQ ID NO: 19328 - DNA, 15 bp, Homo sapiens
tgatgagggtcaagg

SEQ ID NO: 19329 - DNA, 15 bp, Homo sapiens
atgatgagggtcaag

SEQ ID NO: 19330 - DNA, 15 bp, Homo sapiens
aatgatgagggtcaa

SEQ ID NO: 19331 - DNA, 15 bp, Homo sapiens
aaatgatgagggtca

SEQ ID NO: 19332 - DNA, 15 bp, Homo sapiens
aaaatgatgagggtc

SEQ ID NO: 19333 - DNA, 15 bp, Homo sapiens
caaaatgatgagggt

SEQ ID NO: 19334 - DNA, 15 bp, Homo sapiens
acaaaatgatgaggg

SEQ ID NO: 19335 - DNA, 15 bp, Homo sapiens
gacaaaatgatgagg

SEQ ID NO: 19336 - DNA, 15 bp, Homo sapiens
ggacaaaatgatgag

SEQ ID NO: 19337 - DNA, 15 bp, Homo sapiens
gggacaaaatgatga

SEQ ID NO: 19338 - DNA, 15 bp, Homo sapiens
tgggacaaaatgatg

SEQ ID NO: 19339 - DNA, 15 bp, Homo sapiens
atgggacaaaatgat

SEQ ID NO: 19340 - DNA, 15 bp, Homo sapiens
gatgggacaaaatga

SEQ ID NO: 19341 - DNA, 15 bp, Homo sapiens
agatgggacaaaatg

SEQ ID NO: 19342 - DNA, 15 bp, Homo sapiens
gagatgggacaaaat

SEQ ID NO: 19343 - DNA, 15 bp, Homo sapiens
ggagatgggacaaaa

SEQ ID NO: 19344 - DNA, 15 bp, Homo sapiens
aggagatgggacaaa

SEQ ID NO: 19345 - DNA, 15 bp, Homo sapiens
taggagatgggacaa

SEQ ID NO: 19346 - DNA, 15 bp, Homo sapiens
ataggagatgggaca

SEQ ID NO: 19347 - DNA, 15 bp, Homo sapiens
cataggagatgggac

SEQ ID NO: 19348 - DNA, 15 bp, Homo sapiens
gcataggagatggga

SEQ ID NO: 19349 - DNA, 15 bp, Homo sapiens
agcataggagatggg

SEQ ID NO: 19350 - DNA, 15 bp, Homo sapiens
cagcataggagatgg

SEQ ID NO: 19351 - DNA, 15 bp, Homo sapiens
ccagcataggagatg

SEQ ID NO: 19352 - DNA, 15 bp, Homo sapiens
cccagcataggagat

SEQ ID NO: 19353 - DNA, 15 bp, Homo sapiens
gcccagcataggaga

SEQ ID NO: 19354 - DNA, 15 bp, Homo sapiens
agcccagcataggag

SEQ ID NO: 19355 - DNA, 15 bp, Homo sapiens
gagcccagcatagga

SEQ ID NO: 19356 - DNA, 15 bp, Homo sapiens
agagcccagcatagg

SEQ ID NO: 19357 - DNA, 15 bp, Homo sapiens
cagagcccagcatag

SEQ ID NO: 19358 - DNA, 15 bp, Homo sapiens
acagagcccagcata

SEQ ID NO: 19359 - DNA, 15 bp, Homo sapiens
tacagagcccagcat

SEQ ID NO: 19360 - DNA, 15 bp, Homo sapiens
atacagagcccagca

SEQ ID NO: 19361 - DNA, 15 bp, Homo sapiens
gatacagagcccagc

SEQ ID NO: 19362 - DNA, 15 bp, Homo sapiens
ggatacagagcccag

SEQ ID NO: 19363 - DNA, 15 bp, Homo sapiens
aggatacagagccca

SEQ ID NO: 19364 - DNA, 15 bp, Homo sapiens
aaggatacagagccc

SEQ ID NO: 19365 - DNA, 15 bp, Homo sapiens
caaggatacagagcc

SEQ ID NO: 19366 - DNA, 15 bp, Homo sapiens
acaaggatacagagc

SEQ ID NO: 19367 - DNA, 15 bp, Homo sapiens
gacaaggatacagag

SEQ ID NO: 19368 - DNA, 15 bp, Homo sapiens
agacaaggatacaga

SEQ ID NO: 19369 - DNA, 15 bp, Homo sapiens
gagacaaggatacag

SEQ ID NO: 19370 - DNA, 15 bp, Homo sapiens
ggagacaaggataca

SEQ ID NO: 19371 - DNA, 15 bp, Homo sapiens
tggagacaaggatac

SEQ ID NO: 19372 - DNA, 15 bp, Homo sapiens
ttggagacaaggata

SEQ ID NO: 19373 - DNA, 15 bp, Homo sapiens
cttggagacaaggat

SEQ ID NO: 19374 - DNA, 15 bp, Homo sapiens
gcttggagacaagga

SEQ ID NO: 19375 - DNA, 15 bp, Homo sapiens
tgcttggagacaagg

SEQ ID NO: 19376 - DNA, 15 bp, Homo sapiens
ctgcttggagacaag

SEQ ID NO: 19377 - DNA, 15 bp, Homo sapiens
actgcttggagacaa

SEQ ID NO: 19378 - DNA, 15 bp, Homo sapiens
gactgcttggagaca

SEQ ID NO: 19379 - DNA, 15 bp, Homo sapiens
agactgcttggagac

SEQ ID NO: 19380 - DNA, 15 bp, Homo sapiens
gagactgcttggaga

SEQ ID NO: 19381 - DNA, 15 bp, Homo sapiens
cgagactgcttggag

SEQ ID NO: 19382 - DNA, 15 bp, Homo sapiens
acgagactgcttgga

SEQ ID NO: 19383 - DNA, 15 bp, Homo sapiens
cacgagactgcttgg

SEQ ID NO: 19384 - DNA, 15 bp, Homo sapiens
acacgagactgcttg

SEQ ID NO: 19385 - DNA, 15 bp, Homo sapiens
cacacgagactgctt

SEQ ID NO: 19386 - DNA, 15 bp, Homo sapiens
tcacacgagactgct

SEQ ID NO: 19387 - DNA, 15 bp, Homo sapiens
gtcacacgagactgc

SEQ ID NO: 19388 - DNA, 15 bp, Homo sapiens
tgtcacacgagactg

SEQ ID NO: 19389 - DNA, 15 bp, Homo sapiens
ctgtcacacgagact

SEQ ID NO: 19390 - DNA, 15 bp, Homo sapiens
cctgtcacacgagac

SEQ ID NO: 19391 - DNA, 15 bp, Homo sapiens
ccctgtcacacgaga

SEQ ID NO: 19392 - DNA, 15 bp, Homo sapiens
tccctgtcacacgag

SEQ ID NO: 19393 - DNA, 15 bp, Homo sapiens
ttccctgtcacacga

SEQ ID NO: 19394 - DNA, 15 bp, Homo sapiens
cttccctgtcacacg

SEQ ID NO: 19395 - DNA, 15 bp, Homo sapiens
acttccctgtcacac

SEQ ID NO: 19396 - DNA, 15 bp, Homo sapiens
aacttccctgtcaca

SEQ ID NO: 19397 - DNA, 15 bp, Homo sapiens
taacttccctgtcac

SEQ ID NO: 19398 - DNA, 15 bp, Homo sapiens
gtaacttccctgtca

SEQ ID NO: 19399 - DNA, 15 bp, Homo sapiens
ggtaacttccctgtc

SEQ ID NO: 19400 - DNA, 15 bp, Homo sapiens
aggtaacttccctgt

SEQ ID NO: 19401 - DNA, 15 bp, Homo sapiens
taggtaacttccctg

SEQ ID NO: 19402 - DNA, 15 bp, Homo sapiens
ataggtaacttccct

SEQ ID NO: 19403 - DNA, 15 bp, Homo sapiens
aataggtaacttccc

SEQ ID NO: 19404 - DNA, 15 bp, Homo sapiens
taataggtaacttcc

SEQ ID NO: 19405 - DNA, 15 bp, Homo sapiens
ataataggtaacttc

SEQ ID NO: 19406 - DNA, 15 bp, Homo sapiens
aataataggtaactt

SEQ ID NO: 19407 - DNA, 15 bp, Homo sapiens
caataataggtaact

SEQ ID NO: 19408 - DNA, 15 bp, Homo sapiens
acaataataggtaac

SEQ ID NO: 19409 - DNA, 15 bp, Homo sapiens
tacaataataggtaa

SEQ ID NO: 19410 - DNA, 15 bp, Homo sapiens
atacaataataggta

SEQ ID NO: 19411 - DNA, 15 bp, Homo sapiens
catacaataataggt

SEQ ID NO: 19412 - DNA, 15 bp, Homo sapiens
ccatacaataatagg

SEQ ID NO: 19413 - DNA, 15 bp, Homo sapiens
accatacaataatag

SEQ ID NO: 19414 - DNA, 15 bp, Homo sapiens
gaccatacaataata

SEQ ID NO: 19415 - DNA, 15 bp, Homo sapiens
ggaccatacaataat

SEQ ID NO: 19416 - DNA, 15 bp, Homo sapiens
gggaccatacaataa

SEQ ID NO: 19417 - DNA, 15 bp, Homo sapiens
ggggaccatacaata

SEQ ID NO: 19418 - DNA, 15 bp, Homo sapiens
aggggaccatacaat

SEQ ID NO: 19419 - DNA, 15 bp, Homo sapiens
gaggggaccatacaa

SEQ ID NO: 19420 - DNA, 15 bp, Homo sapiens
agaggggaccataca

SEQ ID NO: 19421 - DNA, 15 bp, Homo sapiens
aagaggggaccatac

SEQ ID NO: 19422 - DNA, 15 bp, Homo sapiens
gaagaggggaccata

SEQ ID NO: 19423 - DNA, 15 bp, Homo sapiens
agaagaggggaccat

SEQ ID NO: 19424 - DNA, 15 bp, Homo sapiens
aagaagaggggacca

SEQ ID NO: 19425 - DNA, 15 bp, Homo sapiens
caagaagaggggacc

SEQ ID NO: 19426 - DNA, 15 bp, Homo sapiens
acaagaagaggggac

SEQ ID NO: 19427 - DNA, 15 bp, Homo sapiens
gacaagaagagggga

SEQ ID NO: 19428 - DNA, 15 bp, Homo sapiens
tgacaagaagagggg

SEQ ID NO: 19429 - DNA, 15 bp, Homo sapiens
gtgacaagaagaggg

SEQ ID NO: 19430 - DNA, 15 bp, Homo sapiens
ggtgacaagaagagg

SEQ ID NO: 19431 - DNA, 15 bp, Homo sapiens
aggtgacaagaagag

SEQ ID NO: 19432 - DNA, 15 bp, Homo sapiens
gaggtgacaagaaga

SEQ ID NO: 19433 - DNA, 15 bp, Homo sapiens
agaggtgacaagaag

SEQ ID NO: 19434 - DNA, 15 bp, Homo sapiens
cagaggtgacaagaa

SEQ ID NO: 19435 - DNA, 15 bp, Homo sapiens
ccagaggtgacaaga

SEQ ID NO: 19436 - DNA, 15 bp, Homo sapiens
accagaggtgacaag

SEQ ID NO: 19437 - DNA, 15 bp, Homo sapiens
caccagaggtgacaa

SEQ ID NO: 19438 - DNA, 15 bp, Homo sapiens
acaccagaggtgaca

SEQ ID NO: 19439 - DNA, 15 bp, Homo sapiens
cacaccagaggtgac

SEQ ID NO: 19440 - DNA, 15 bp, Homo sapiens
ccacaccagaggtga

SEQ ID NO: 19441 - DNA, 15 bp, Homo sapiens
gccacaccagaggtg

SEQ ID NO: 19442 - DNA, 15 bp, Homo sapiens
tgccacaccagaggt

SEQ ID NO: 19443 - DNA, 15 bp, Homo sapiens
gtgccacaccagagg

SEQ ID NO: 19444 - DNA, 15 bp, Homo sapiens
agtgccacaccagag

SEQ ID NO: 19445 - DNA, 15 bp, Homo sapiens
aagtgccacaccaga

SEQ ID NO: 19446 - DNA, 15 bp, Homo sapiens
caagtgccacaccag

SEQ ID NO: 19447 - DNA, 15 bp, Homo sapiens
acaagtgccacacca

SEQ ID NO: 19448 - DNA, 15 bp, Homo sapiens
aacaagtgccacacc

SEQ ID NO: 19449 - DNA, 15 bp, Homo sapiens
gaacaagtgccacac

SEQ ID NO: 19450 - DNA, 15 bp, Homo sapiens
ggaacaagtgccaca

SEQ ID NO: 19451 - DNA, 15 bp, Homo sapiens
tggaacaagtgccac

SEQ ID NO: 19452 - DNA, 15 bp, Homo sapiens
atggaacaagtgcca

SEQ ID NO: 19453 - DNA, 15 bp, Homo sapiens
aatggaacaagtgcc

SEQ ID NO: 19454 - DNA, 15 bp, Homo sapiens
aaatggaacaagtgc

SEQ ID NO: 19455 - DNA, 15 bp, Homo sapiens
gaaatggaacaagtg

SEQ ID NO: 19456 - DNA, 15 bp, Homo sapiens
agaaatggaacaagt

SEQ ID NO: 19457 - DNA, 15 bp, Homo sapiens
aagaaatggaacaag

SEQ ID NO: 19458 - DNA, 15 bp, Homo sapiens
caagaaatggaacaa

SEQ ID NO: 19459 - DNA, 15 bp, Homo sapiens
acaagaaatggaaca

SEQ ID NO: 19460 - DNA, 15 bp, Homo sapiens
aacaagaaatggaac

SEQ ID NO: 19461 - DNA, 15 bp, Homo sapiens
gaacaagaaatggaa

SEQ ID NO: 19462 - DNA, 15 bp, Homo sapiens
tgaacaagaaatgga

SEQ ID NO: 19463 - DNA, 15 bp, Homo sapiens
ttgaacaagaaatgg

SEQ ID NO: 19464 - DNA, 15 bp, Homo sapiens
attgaacaagaaatg

SEQ ID NO: 19465 - DNA, 15 bp, Homo sapiens
cattgaacaagaaat

SEQ ID NO: 19466 - DNA, 15 bp, Homo sapiens
tcattgaacaagaaa

SEQ ID NO: 19467 - DNA, 15 bp, Homo sapiens
ttcattgaacaagaa

SEQ ID NO: 19468 - DNA, 15 bp, Homo sapiens
attcattgaacaaga

SEQ ID NO: 19469 - DNA, 15 bp, Homo sapiens
cattcattgaacaag

SEQ ID NO: 19470 - DNA, 15 bp, Homo sapiens
acattcattgaacaa

SEQ ID NO: 19471 - DNA, 15 bp, Homo sapiens
cacattcattgaaca

SEQ ID NO: 19472 - DNA, 15 bp, Homo sapiens
tcacattcattgaac

SEQ ID NO: 19473 - DNA, 15 bp, Homo sapiens
atcacattcattgaa

SEQ ID NO: 19474 - DNA, 15 bp, Homo sapiens
aatcacattcattga

SEQ ID NO: 19475 - DNA, 15 bp, Homo sapiens
aaatcacattcattg

SEQ ID NO: 19476 - DNA, 15 bp, Homo sapiens
caaatcacattcatt

SEQ ID NO: 19477 - DNA, 15 bp, Homo sapiens
acaaatcacattcat

SEQ ID NO: 19478 - DNA, 15 bp, Homo sapiens
cacaaatcacattca

SEQ ID NO: 19479 - DNA, 15 bp, Homo sapiens
tcacaaatcacattc

SEQ ID NO: 19480 - DNA, 15 bp, Homo sapiens
ttcacaaatcacatt

SEQ ID NO: 19481 - DNA, 15 bp, Homo sapiens
attcacaaatcacat

SEQ ID NO: 19482 - DNA, 15 bp, Homo sapiens
cattcacaaatcaca

SEQ ID NO: 19483 - DNA, 15 bp, Homo sapiens
acattcacaaatcac

SEQ ID NO: 19484 - DNA, 15 bp, Homo sapiens
cacattcacaaatca

SEQ ID NO: 19485 - DNA, 15 bp, Homo sapiens
gcacattcacaaatc

SEQ ID NO: 19486 - DNA, 15 bp, Homo sapiens
ggcacattcacaaat

SEQ ID NO: 19487 - DNA, 15 bp, Homo sapiens
tggcacattcacaaa

SEQ ID NO: 19488 - DNA, 15 bp, Homo sapiens
gtggcacattcacaa

SEQ ID NO: 19489 - DNA, 15 bp, Homo sapiens
tgtggcacattcaca

SEQ ID NO: 19490 - DNA, 15 bp, Homo sapiens
atgtggcacattcac

SEQ ID NO: 19491 - DNA, 15 bp, Homo sapiens
gatgtggcacattca

SEQ ID NO: 19492 - DNA, 15 bp, Homo sapiens
agatgtggcacattc

SEQ ID NO: 19493 - DNA, 15 bp, Homo sapiens
cagatgtggcacatt

SEQ ID NO: 19494 - DNA, 15 bp, Homo sapiens
acagatgtggcacat

SEQ ID NO: 19495 - DNA, 15 bp, Homo sapiens
cacagatgtggcaca

SEQ ID NO: 19496 - DNA, 15 bp, Homo sapiens
ccacagatgtggcac

SEQ ID NO: 19497 - DNA, 15 bp, Homo sapiens
cccacagatgtggca

SEQ ID NO: 19498 - DNA, 15 bp, Homo sapiens
tcccacagatgtggc

SEQ ID NO: 19499 - DNA, 15 bp, Homo sapiens
ctcccacagatgtgg

SEQ ID NO: 19500 - DNA, 15 bp, Homo sapiens
cctcccacagatgtg

SEQ ID NO: 19501 - DNA, 15 bp, Homo sapiens
tcctcccacagatgt

SEQ ID NO: 19502 - DNA, 15 bp, Homo sapiens
ttcctcccacagatg

SEQ ID NO: 19503 - DNA, 15 bp, Homo sapiens
cttcctcccacagat

SEQ ID NO: 19504 - DNA, 15 bp, Homo sapiens
ccttcctcccacaga

SEQ ID NO: 19505 - DNA, 15 bp, Homo sapiens
gccttcctcccacag

SEQ ID NO: 19506 - DNA, 15 bp, Homo sapiens
tgccttcctcccaca

SEQ ID NO: 19507 - DNA, 15 bp, Homo sapiens
ctgccttcctcccac

SEQ ID NO: 19508 - DNA, 15 bp, Homo sapiens
actgccttcctccca

SEQ ID NO: 19509 - DNA, 15 bp, Homo sapiens
aactgccttcctccc

SEQ ID NO: 19510 - DNA, 15 bp, Homo sapiens
gaactgccttcctcc

SEQ ID NO: 19511 - DNA, 15 bp, Homo sapiens
cgaactgccttcctc

SEQ ID NO: 19512 - DNA, 15 bp, Homo sapiens
gcgaactgccttcct

SEQ ID NO: 19513 - DNA, 15 bp, Homo sapiens
tgcgaactgccttcc

SEQ ID NO: 19514 - DNA, 15 bp, Homo sapiens
ctgcgaactgccttc

SEQ ID NO: 19515 - DNA, 15 bp, Homo sapiens
gctgcgaactgcctt

SEQ ID NO: 19516 - DNA, 15 bp, Homo sapiens
tgctgcgaactgcct

SEQ ID NO: 19517 - DNA, 15 bp, Homo sapiens
ttgctgcgaactgcc

SEQ ID NO: 19518 - DNA, 15 bp, Homo sapiens
cttgctgcgaactgc

SEQ ID NO: 19519 - DNA, 15 bp, Homo sapiens
tcttgctgcgaactg

SEQ ID NO: 19520 - DNA, 15 bp, Homo sapiens
ctcttgctgcgaact

SEQ ID NO: 19521 - DNA, 15 bp, Homo sapiens
actcttgctgcgaac

SEQ ID NO: 19522 - DNA, 15 bp, Homo sapiens
aactcttgctgcgaa

SEQ ID NO: 19523 - DNA, 15 bp, Homo sapiens
caactcttgctgcga

SEQ ID NO: 19524 - DNA, 15 bp, Homo sapiens
acaactcttgctgcg

SEQ ID NO: 19525 - DNA, 15 bp, Homo sapiens
tacaactcttgctgc

SEQ ID NO: 19526 - DNA, 15 bp, Homo sapiens
ctacaactcttgctg

SEQ ID NO: 19527 - DNA, 15 bp, Homo sapiens
actacaactcttgct

SEQ ID NO: 19528 - DNA, 15 bp, Homo sapiens
aactacaactcttgc

SEQ ID NO: 19529 - DNA, 15 bp, Homo sapiens
gaactacaactcttg

SEQ ID NO: 19530 - DNA, 15 bp, Homo sapiens
ggaactacaactctt

SEQ ID NO: 19531 - DNA, 15 bp, Homo sapiens
gggaactacaactct

SEQ ID NO: 19532 - DNA, 15 bp, Homo sapiens
agggaactacaactc

SEQ ID NO: 19533 - DNA, 15 bp, Homo sapiens
aagggaactacaact

SEQ ID NO: 19534 - DNA, 15 bp, Homo sapiens
caagggaactacaac

SEQ ID NO: 19535 - DNA, 15 bp, Homo sapiens
gcaagggaactacaa

SEQ ID NO: 19536 - DNA, 15 bp, Homo sapiens
agcaagggaactaca

SEQ ID NO: 19537 - DNA, 15 bp, Homo sapiens
aagcaagggaactac

SEQ ID NO: 19538 - DNA, 15 bp, Homo sapiens
aaagcaagggaacta

SEQ ID NO: 19539 - DNA, 15 bp, Homo sapiens
caaagcaagggaact

SEQ ID NO: 19540 - DNA, 15 bp, Homo sapiens
gcaaagcaagggaac

SEQ ID NO: 19541 - DNA, 15 bp, Homo sapiens
ggcaaagcaagggaa

SEQ ID NO: 19542 - DNA, 15 bp, Homo sapiens
gggcaaagcaaggga

SEQ ID NO: 19543 - DNA, 15 bp, Homo sapiens
agggcaaagcaaggg

SEQ ID NO: 19544 - DNA, 15 bp, Homo sapiens
cagggcaaagcaagg

SEQ ID NO: 19545 - DNA, 15 bp, Homo sapiens
tcagggcaaagcaag

SEQ ID NO: 19546 - DNA, 15 bp, Homo sapiens
ctcagggcaaagcaa

SEQ ID NO: 19547 - DNA, 15 bp, Homo sapiens
cctcagggcaaagca

SEQ ID NO: 19548 - DNA, 15 bp, Homo sapiens
ccctcagggcaaagc

SEQ ID NO: 19549 - DNA, 15 bp, Homo sapiens
gccctcagggcaaag

SEQ ID NO: 19550 - DNA, 15 bp, Homo sapiens
ggccctcagggcaaa

SEQ ID NO: 19551 - DNA, 15 bp, Homo sapiens
tggccctcagggcaa

SEQ ID NO: 19552 - DNA, 15 bp, Homo sapiens
ctggccctcagggca

SEQ ID NO: 19553 - DNA, 15 bp, Homo sapiens
cctggccctcagggc

SEQ ID NO: 19554 - DNA, 15 bp, Homo sapiens
tcctggccctcaggg

SEQ ID NO: 19555 - DNA, 15 bp, Homo sapiens
gtcctggccctcagg

SEQ ID NO: 19556 - DNA, 15 bp, Homo sapiens
agtcctggccctcag

SEQ ID NO: 19557 - DNA, 15 bp, Homo sapiens
aagtcctggccctca

SEQ ID NO: 19558 - DNA, 15 bp, Homo sapiens
aaagtcctggccctc

SEQ ID NO: 19559 - DNA, 15 bp, Homo sapiens
taaagtcctggccct

SEQ ID NO: 19560 - DNA, 15 bp, Homo sapiens
gtaaagtcctggccc

SEQ ID NO: 19561 - DNA, 15 bp, Homo sapiens
tgtaaagtcctggcc

SEQ ID NO: 19562 - DNA, 15 bp, Homo sapiens
gtgtaaagtcctggc

SEQ ID NO: 19563 - DNA, 15 bp, Homo sapiens
agtgtaaagtcctgg

SEQ ID NO: 19564 - DNA, 15 bp, Homo sapiens
tagtgtaaagtcctg

SEQ ID NO: 19565 - DNA, 15 bp, Homo sapiens
ctagtgtaaagtcct

SEQ ID NO: 19566 - DNA, 15 bp, Homo sapiens
tctagtgtaaagtcc

SEQ ID NO: 19567 - DNA, 15 bp, Homo sapiens
atctagtgtaaagtc

SEQ ID NO: 19568 - DNA, 15 bp, Homo sapiens
aatctagtgtaaagt

SEQ ID NO: 19569 - DNA, 15 bp, Homo sapiens
aaatctagtgtaaag

SEQ ID NO: 19570 - DNA, 15 bp, Homo sapiens
aaaatctagtgtaaa

SEQ ID NO: 19571 - DNA, 15 bp, Homo sapiens
aaaaatctagtgtaa

SEQ ID NO: 19572 - DNA, 15 bp, Homo sapiens
aaaaaatctagtgta

SEQ ID NO: 19573 - DNA, 15 bp, Homo sapiens
aaaaaaatctagtgt

SEQ ID NO: 19574 - DNA, 15 bp, Homo sapiens
caaaaaaatctagtg

SEQ ID NO: 19575 - DNA, 15 bp, Homo sapiens
acaaaaaaatctagt

SEQ ID NO: 19576 - DNA, 15 bp, Homo sapiens
aacaaaaaaatctag

SEQ ID NO: 19577 - DNA, 15 bp, Homo sapiens
caacaaaaaaatcta

SEQ ID NO: 19578 - DNA, 15 bp, Homo sapiens
gcaacaaaaaaatct

SEQ ID NO: 19579 - DNA, 15 bp, Homo sapiens
tgcaacaaaaaaatc

SEQ ID NO: 19580 - DNA, 15 bp, Homo sapiens
atgcaacaaaaaaat

SEQ ID NO: 19581 - DNA, 15 bp, Homo sapiens
aatgcaacaaaaaaa

SEQ ID NO: 19582 - DNA, 15 bp, Homo sapiens
gaatgcaacaaaaaa

SEQ ID NO: 19583 - DNA, 15 bp, Homo sapiens
ggaatgcaacaaaaa

SEQ ID NO: 19584 - DNA, 15 bp, Homo sapiens
aggaatgcaacaaaa

SEQ ID NO: 19585 - DNA, 15 bp, Homo sapiens
caggaatgcaacaaa

SEQ ID NO: 19586 - DNA, 15 bp, Homo sapiens
gcaggaatgcaacaa

SEQ ID NO: 19587 - DNA, 15 bp, Homo sapiens
tgcaggaatgcaaca

SEQ ID NO: 19588 - DNA, 15 bp, Homo sapiens
gtgcaggaatgcaac

SEQ ID NO: 19589 - DNA, 15 bp, Homo sapiens
agtgcaggaatgcaa

SEQ ID NO: 19590 - DNA, 15 bp, Homo sapiens
gagtgcaggaatgca

SEQ ID NO: 19591 - DNA, 15 bp, Homo sapiens
tgagtgcaggaatgc

SEQ ID NO: 19592 - DNA, 15 bp, Homo sapiens
atgagtgcaggaatg

SEQ ID NO: 19593 - DNA, 15 bp, Homo sapiens
tatgagtgcaggaat

SEQ ID NO: 19594 - DNA, 15 bp, Homo sapiens
ttatgagtgcaggaa

SEQ ID NO: 19595 - DNA, 15 bp, Homo sapiens
tttatgagtgcagga

SEQ ID NO: 19596 - DNA, 15 bp, Homo sapiens
ctttatgagtgcagg

SEQ ID NO: 19597 - DNA, 15 bp, Homo sapiens
actttatgagtgcag

SEQ ID NO: 19598 - DNA, 15 bp, Homo sapiens
tactttatgagtgca

SEQ ID NO: 19599 - DNA, 15 bp, Homo sapiens
gtactttatgagtgc

SEQ ID NO: 19600 - DNA, 15 bp, Homo sapiens
tgtactttatgagtg

SEQ ID NO: 19601 - DNA, 15 bp, Homo sapiens
gtgtactttatgagt

SEQ ID NO: 19602 - DNA, 15 bp, Homo sapiens
cgtgtactttatgag

SEQ ID NO: 19603 - DNA, 15 bp, Homo sapiens
acgtgtactttatga

SEQ ID NO: 19604 - DNA, 15 bp, Homo sapiens
tacgtgtactttatg

SEQ ID NO: 19605 - DNA, 15 bp, Homo sapiens
ttacgtgtactttat

SEQ ID NO: 19606 - DNA, 15 bp, Homo sapiens
tttacgtgtacttta

SEQ ID NO: 19607 - DNA, 15 bp, Homo sapiens
gtttacgtgtacttt

SEQ ID NO: 19608 - DNA, 15 bp, Homo sapiens
agtttacgtgtactt

SEQ ID NO: 19609 - DNA, 15 bp, Homo sapiens
aagtttacgtgtact

SEQ ID NO: 19610 - DNA, 15 bp, Homo sapiens
taagtttacgtgtac

SEQ ID NO: 19611 - DNA, 15 bp, Homo sapiens
ctaagtttacgtgta

SEQ ID NO: 19612 - DNA, 15 bp, Homo sapiens
tctaagtttacgtgt

SEQ ID NO: 19613 - DNA, 15 bp, Homo sapiens
ctctaagtttacgtg

SEQ ID NO: 19614 - DNA, 15 bp, Homo sapiens
cctctaagtttacgt

SEQ ID NO: 19615 - DNA, 15 bp, Homo sapiens
acctctaagtttacg

SEQ ID NO: 19616 - DNA, 15 bp, Homo sapiens
cacctctaagtttac

SEQ ID NO: 19617 - DNA, 15 bp, Homo sapiens
ccacctctaagttta

SEQ ID NO: 19618 - DNA, 15 bp, Homo sapiens
accacctctaagttt

SEQ ID NO: 19619 - DNA, 15 bp, Homo sapiens
caccacctctaagtt

SEQ ID NO: 19620 - DNA, 15 bp, Homo sapiens
acaccacctctaagt

SEQ ID NO: 19621 - DNA, 15 bp, Homo sapiens
cacaccacctctaag

SEQ ID NO: 19622 - DNA, 15 bp, Homo sapiens
acacaccacctctaa

SEQ ID NO: 19623 - DNA, 15 bp, Homo sapiens
aacacaccacctcta

SEQ ID NO: 19624 - DNA, 15 bp, Homo sapiens
taacacaccacctct

SEQ ID NO: 19625 - DNA, 15 bp, Homo sapiens
ttaacacaccacctc

SEQ ID NO: 19626 - DNA, 15 bp, Homo sapiens
tttaacacaccacct

SEQ ID NO: 19627 - DNA, 15 bp, Homo sapiens
atttaacacaccacc

SEQ ID NO: 19628 - DNA, 15 bp, Homo sapiens
catttaacacaccac

SEQ ID NO: 19629 - DNA, 15 bp, Homo sapiens
gcatttaacacacca

SEQ ID NO: 19630 - DNA, 15 bp, Homo sapiens
agcatttaacacacc

SEQ ID NO: 19631 - DNA, 15 bp, Homo sapiens
tagcatttaacacac

SEQ ID NO: 19632 - DNA, 15 bp, Homo sapiens
ctagcatttaacaca

SEQ ID NO: 19633 - DNA, 15 bp, Homo sapiens
tctagcatttaacac

SEQ ID NO: 19634 - DNA, 15 bp, Homo sapiens
ttctagcatttaaca

SEQ ID NO: 19635 - DNA, 15 bp, Homo sapiens
gttctagcatttaac

SEQ ID NO: 19636 - DNA, 15 bp, Homo sapiens
agttctagcatttaa

SEQ ID NO: 19637 - DNA, 15 bp, Homo sapiens
aagttctagcattta

SEQ ID NO: 19638 - DNA, 15 bp, Homo sapiens
taagttctagcattt

SEQ ID NO: 19639 - DNA, 15 bp, Homo sapiens
ttaagttctagcatt

SEQ ID NO: 19640 - DNA, 15 bp, Homo sapiens
tttaagttctagcat

SEQ ID NO: 19641 - DNA, 15 bp, Homo sapiens
ttttaagttctagca

SEQ ID NO: 19642 - DNA, 15 bp, Homo sapiens
gttttaagttctagc

SEQ ID NO: 19643 - DNA, 15 bp, Homo sapiens
agttttaagttctag

SEQ ID NO: 19644 - DNA, 15 bp, Homo sapiens
cagttttaagttcta

SEQ ID NO: 19645 - DNA, 15 bp, Homo sapiens
tcagttttaagttct

SEQ ID NO: 19646 - DNA, 15 bp, Homo sapiens
ctcagttttaagttc

SEQ ID NO: 19647 - DNA, 15 bp, Homo sapiens
actcagttttaagtt

SEQ ID NO: 19648 - DNA, 15 bp, Homo sapiens
aactcagttttaagt

SEQ ID NO: 19649 - DNA, 15 bp, Homo sapiens
gaactcagttttaag

SEQ ID NO: 19650 - DNA, 15 bp, Homo sapiens
tgaactcagttttaa

SEQ ID NO: 19651 - DNA, 15 bp, Homo sapiens
ctgaactcagtttta

SEQ ID NO: 19652 - DNA, 15 bp, Homo sapiens
gctgaactcagtttt

SEQ ID NO: 19653 - DNA, 15 bp, Homo sapiens
agctgaactcagttt

SEQ ID NO: 19654 - DNA, 15 bp, Homo sapiens
tagctgaactcagtt

SEQ ID NO: 19655 - DNA, 15 bp, Homo sapiens
ctagctgaactcagt

SEQ ID NO: 19656 - DNA, 15 bp, Homo sapiens
cctagctgaactcag

SEQ ID NO: 19657 - DNA, 15 bp, Homo sapiens
gcctagctgaactca

SEQ ID NO: 19658 - DNA, 15 bp, Homo sapiens
agcctagctgaactc

SEQ ID NO: 19659 - DNA, 15 bp, Homo sapiens
gagcctagctgaact

SEQ ID NO: 19660 - DNA, 15 bp, Homo sapiens
tgagcctagctgaac

SEQ ID NO: 19661 - DNA, 15 bp, Homo sapiens
ttgagcctagctgaa

SEQ ID NO: 19662 - DNA, 15 bp, Homo sapiens
cttgagcctagctga

SEQ ID NO: 19663 - DNA, 15 bp, Homo sapiens
acttgagcctagctg

SEQ ID NO: 19664 - DNA, 15 bp, Homo sapiens
cacttgagcctagct

SEQ ID NO: 19665 - DNA, 15 bp, Homo sapiens
gcacttgagcctagc

SEQ ID NO: 19666 - DNA, 15 bp, Homo sapiens
ggcacttgagcctag

SEQ ID NO: 19667 - DNA, 15 bp, Homo sapiens
gggcacttgagccta

SEQ ID NO: 19668 - DNA, 15 bp, Homo sapiens
ggggcacttgagcct

SEQ ID NO: 19669 - DNA, 15 bp, Homo sapiens
tggggcacttgagcc

SEQ ID NO: 19670 - DNA, 15 bp, Homo sapiens
gtggggcacttgagc

SEQ ID NO: 19671 - DNA, 15 bp, Homo sapiens
tgtggggcacttgag

SEQ ID NO: 19672 - DNA, 15 bp, Homo sapiens
ttgtggggcacttga

SEQ ID NO: 19673 - DNA, 15 bp, Homo sapiens
attgtggggcacttg

SEQ ID NO: 19674 - DNA, 15 bp, Homo sapiens
aattgtggggcactt

SEQ ID NO: 19675 - DNA, 15 bp, Homo sapiens
aaattgtggggcact

SEQ ID NO: 19676 - DNA, 15 bp, Homo sapiens
aaaattgtggggcac

SEQ ID NO: 19677 - DNA, 15 bp, Homo sapiens
aaaaattgtggggca

SEQ ID NO: 19678 - DNA, 15 bp, Homo sapiens
caaaaattgtggggc

SEQ ID NO: 19679 - DNA, 15 bp, Homo sapiens
acaaaaattgtgggg

SEQ ID NO: 19680 - DNA, 15 bp, Homo sapiens
gacaaaaattgtggg

SEQ ID NO: 19681 - DNA, 15 bp, Homo sapiens
ggacaaaaattgtgg

SEQ ID NO: 19682 - DNA, 15 bp, Homo sapiens
gggacaaaaattgtg

SEQ ID NO: 19683 - DNA, 15 bp, Homo sapiens
tgggacaaaaattgt

SEQ ID NO: 19684 - DNA, 15 bp, Homo sapiens
gtgggacaaaaattg

SEQ ID NO: 19685 - DNA, 15 bp, Homo sapiens
ggtgggacaaaaatt

SEQ ID NO: 19686 - DNA, 15 bp, Homo sapiens
tggtgggacaaaaat

SEQ ID NO: 19687 - DNA, 15 bp, Homo sapiens
ctggtgggacaaaaa

SEQ ID NO: 19688 - DNA, 15 bp, Homo sapiens
tctggtgggacaaaa

SEQ ID NO: 19689 - DNA, 15 bp, Homo sapiens
gtctggtgggacaaa

SEQ ID NO: 19690 - DNA, 15 bp, Homo sapiens
tgtctggtgggacaa

SEQ ID NO: 19691 - DNA, 15 bp, Homo sapiens
ttgtctggtgggaca

SEQ ID NO: 19692 - DNA, 15 bp, Homo sapiens
attgtctggtgggac

SEQ ID NO: 19693 - DNA, 15 bp, Homo sapiens
aattgtctggtggga

SEQ ID NO: 19694 - DNA, 15 bp, Homo sapiens
aaattgtctggtggg

SEQ ID NO: 19695 - DNA, 15 bp, Homo sapiens
gaaattgtctggtgg

SEQ ID NO: 19696 - DNA, 15 bp, Homo sapiens
tgaaattgtctggtg

SEQ ID NO: 19697 - DNA, 15 bp, Homo sapiens
atgaaattgtctggt

SEQ ID NO: 19698 - DNA, 15 bp, Homo sapiens
catgaaattgtctgg

SEQ ID NO: 19699 - DNA, 15 bp, Homo sapiens
tcatgaaattgtctg

SEQ ID NO: 19700 - DNA, 15 bp, Homo sapiens
ttcatgaaattgtct

SEQ ID NO: 19701 - DNA, 15 bp, Homo sapiens
attcatgaaattgtc

SEQ ID NO: 19702 - DNA, 15 bp, Homo sapiens
tattcatgaaattgt

SEQ ID NO: 19703 - DNA, 15 bp, Homo sapiens
atattcatgaaattg

SEQ ID NO: 19704 - DNA, 15 bp, Homo sapiens
gatattcatgaaatt

SEQ ID NO: 19705 - DNA, 15 bp, Homo sapiens
agatattcatgaaat

SEQ ID NO: 19706 - DNA, 15 bp, Homo sapiens
tagatattcatgaaa

SEQ ID NO: 19707 - DNA, 15 bp, Homo sapiens
gtagatattcatgaa

SEQ ID NO: 19708 - DNA, 15 bp, Homo sapiens
tgtagatattcatga

SEQ ID NO: 19709 - DNA, 15 bp, Homo sapiens
ctgtagatattcatg

SEQ ID NO: 19710 - DNA, 15 bp, Homo sapiens
tctgtagatattcat

SEQ ID NO: 19711 - DNA, 15 bp, Homo sapiens
atctgtagatattca

SEQ ID NO: 19712 - DNA, 15 bp, Homo sapiens
aatctgtagatattc

SEQ ID NO: 19713 - DNA, 15 bp, Homo sapiens
caatctgtagatatt

SEQ ID NO: 19714 - DNA, 15 bp, Homo sapiens
acaatctgtagatat

SEQ ID NO: 19715 - DNA, 15 bp, Homo sapiens
aacaatctgtagata

SEQ ID NO: 19716 - DNA, 15 bp, Homo sapiens
gaacaatctgtagat

SEQ ID NO: 19717 - DNA, 15 bp, Homo sapiens
ggaacaatctgtaga

SEQ ID NO: 19718 - DNA, 15 bp, Homo sapiens
gggaacaatctgtag

SEQ ID NO: 19719 - DNA, 15 bp, Homo sapiens
agggaacaatctgta

SEQ ID NO: 19720 - DNA, 15 bp, Homo sapiens
gagggaacaatctgt

SEQ ID NO: 19721 - DNA, 15 bp, Homo sapiens
tgagggaacaatctg

SEQ ID NO: 19722 - DNA, 15 bp, Homo sapiens
ttgagggaacaatct

SEQ ID NO: 19723 - DNA, 15 bp, Homo sapiens
attgagggaacaatc

SEQ ID NO: 19724 - DNA, 15 bp, Homo sapiens
tattgagggaacaat

SEQ ID NO: 19725 - DNA, 15 bp, Homo sapiens
atattgagggaacaa

SEQ ID NO: 19726 - DNA, 15 bp, Homo sapiens
catattgagggaaca

SEQ ID NO: 19727 - DNA, 15 bp, Homo sapiens
gcatattgagggaac

SEQ ID NO: 19728 - DNA, 15 bp, Homo sapiens
ggcatattgagggaa

SEQ ID NO: 19729 - DNA, 15 bp, Homo sapiens
aggcatattgaggga

SEQ ID NO: 19730 - DNA, 15 bp, Homo sapiens
gaggcatattgaggg

SEQ ID NO: 19731 - DNA, 15 bp, Homo sapiens
tgaggcatattgagg

SEQ ID NO: 19732 - DNA, 15 bp, Homo sapiens
ttgaggcatattgag

SEQ ID NO: 19733 - DNA, 15 bp, Homo sapiens
atcaatatgcctcaa

SEQ ID NO: 19734 - DNA, 15 bp, Homo sapiens
aatcaatatgcctca

SEQ ID NO: 19735 - DNA, 15 bp, Homo sapiens
aaatcaatatgcctc

SEQ ID NO: 19736 - DNA, 15 bp, Homo sapiens
caaatcaatatgcct

SEQ ID NO: 19737 - DNA, 15 bp, Homo sapiens
ccaaatcaatatgcc

SEQ ID NO: 19738 - DNA, 15 bp, Homo sapiens
cccaaatcaatatgc

SEQ ID NO: 19739 - DNA, 15 bp, Homo sapiens
ccccaaatcaatatg

SEQ ID NO: 19740 - DNA, 15 bp, Homo sapiens
tccccaaatcaatat

SEQ ID NO: 19741 - DNA, 15 bp, Homo sapiens
ctccccaaatcaata

SEQ ID NO: 19742 - DNA, 15 bp, Homo sapiens
gctccccaaatcaat

SEQ ID NO: 19743 - DNA, 15 bp, Homo sapiens
tgctccccaaatcaa

SEQ ID NO: 19744 - DNA, 15 bp, Homo sapiens
gtgctccccaaatca

SEQ ID NO: 19745 - DNA, 15 bp, Homo sapiens
tgtgctccccaaatc

SEQ ID NO: 19746 - DNA, 15 bp, Homo sapiens
ctgtgctccccaaat

SEQ ID NO: 19747 - DNA, 15 bp, Homo sapiens
tctgtgctccccaaa

SEQ ID NO: 19748 - DNA, 15 bp, Homo sapiens
gtctgtgctccccaa

SEQ ID NO: 19749 - DNA, 15 bp, Homo sapiens
tgtctgtgctcccca

SEQ ID NO: 19750 - DNA, 15 bp, Homo sapiens
ttgtctgtgctcccc

SEQ ID NO: 19751 - DNA, 15 bp, Homo sapiens
cttgtctgtgctccc

SEQ ID NO: 19752 - DNA, 15 bp, Homo sapiens
acttgtctgtgctcc

SEQ ID NO: 19753 - DNA, 15 bp, Homo sapiens
gacttgtctgtgctc

SEQ ID NO: 19754 - DNA, 15 bp, Homo sapiens
tgacttgtctgtgct

SEQ ID NO: 19755 - DNA, 15 bp, Homo sapiens
ttgacttgtctgtgc

SEQ ID NO: 19756 - DNA, 15 bp, Homo sapiens
cttgacttgtctgtg

SEQ ID NO: 19757 - DNA, 15 bp, Homo sapiens
ccttgacttgtctgt

SEQ ID NO: 19758 - DNA, 15 bp, Homo sapiens
accttgacttgtctg

SEQ ID NO: 19759 - DNA, 15 bp, Homo sapiens
aaccttgacttgtct

SEQ ID NO: 19760 - DNA, 15 bp, Homo sapiens
caaccttgacttgtc

SEQ ID NO: 19761 - DNA, 15 bp, Homo sapiens
tcaaccttgacttgt

SEQ ID NO: 19762 - DNA, 15 bp, Homo sapiens
atcaaccttgacttg

SEQ ID NO: 19763 - DNA, 15 bp, Homo sapiens
catcaaccttgactt

SEQ ID NO: 19764 - DNA, 15 bp, Homo sapiens
acatcaaccttgact

SEQ ID NO: 19765 - DNA, 15 bp, Homo sapiens
cacatcaaccttgac

SEQ ID NO: 19766 - DNA, 15 bp, Homo sapiens
gcacatcaaccttga

SEQ ID NO: 19767 - DNA, 15 bp, Homo sapiens
tgcacatcaaccttg

SEQ ID NO: 19768 - DNA, 15 bp, Homo sapiens
atgcacatcaacctt

SEQ ID NO: 19769 - DNA, 15 bp, Homo sapiens
gatgcacatcaacct

SEQ ID NO: 19770 - DNA, 15 bp, Homo sapiens
ggatgcacatcaacc

SEQ ID NO: 19771 - DNA, 15 bp, Homo sapiens
cggatgcacatcaac

SEQ ID NO: 19772 - DNA, 15 bp, Homo sapiens
gcggatgcacatcaa

SEQ ID NO: 19773 - DNA, 15 bp, Homo sapiens
agcggatgcacatca

SEQ ID NO: 19774 - DNA, 15 bp, Homo sapiens
cagcggatgcacatc

SEQ ID NO: 19775 - DNA, 15 bp, Homo sapiens
tcagcggatgcacat

SEQ ID NO: 19776 - DNA, 15 bp, Homo sapiens
ttcagcggatgcaca

SEQ ID NO: 19777 - DNA, 15 bp, Homo sapiens
gttcagcggatgcac

SEQ ID NO: 19778 - DNA, 15 bp, Homo sapiens
tgttcagcggatgca

SEQ ID NO: 19779 - DNA, 15 bp, Homo sapiens
atgttcagcggatgc

SEQ ID NO: 19780 - DNA, 15 bp, Homo sapiens
catgttcagcggatg

SEQ ID NO: 19781 - DNA, 15 bp, Homo sapiens
tcatgttcagcggat

SEQ ID NO: 19782 - DNA, 15 bp, Homo sapiens
atcatgttcagcgga

SEQ ID NO: 19783 - DNA, 15 bp, Homo sapiens
gatcatgttcagcgg

SEQ ID NO: 19784 - DNA, 15 bp, Homo sapiens
agatcatgttcagcg

SEQ ID NO: 19785 - DNA, 15 bp, Homo sapiens
aagatcatgttcagc

SEQ ID NO: 19786 - DNA, 15 bp, Homo sapiens
taagatcatgttcag

SEQ ID NO: 19787 - DNA, 15 bp, Homo sapiens
ttaagatcatgttca

SEQ ID NO: 19788 - DNA, 15 bp, Homo sapiens
cttaagatcatgttc

SEQ ID NO: 19789 - DNA, 15 bp, Homo sapiens
acttaagatcatgtt

SEQ ID NO: 19790 - DNA, 15 bp, Homo sapiens
aacttaagatcatgt

SEQ ID NO: 19791 - DNA, 15 bp, Homo sapiens
caacttaagatcatg

SEQ ID NO: 19792 - DNA, 15 bp, Homo sapiens
acaacttaagatcat

SEQ ID NO: 19793 - DNA, 15 bp, Homo sapiens
aacaacttaagatca

SEQ ID NO: 19794 - DNA, 15 bp, Homo sapiens
caacaacttaagatc

SEQ ID NO: 19795 - DNA, 15 bp, Homo sapiens
tcaacaacttaagat

SEQ ID NO: 19796 - DNA, 15 bp, Homo sapiens
ttcaacaacttaaga

SEQ ID NO: 19797 - DNA, 15 bp, Homo sapiens
cttcaacaacttaag

SEQ ID NO: 19798 - DNA, 15 bp, Homo sapiens
acttcaacaacttaa

SEQ ID NO: 19799 - DNA, 15 bp, Homo sapiens
tacttcaacaactta

SEQ ID NO: 19800 - DNA, 15 bp, Homo sapiens
ctacttcaacaactt

SEQ ID NO: 19801 - DNA, 15 bp, Homo sapiens
cctacttcaacaact

SEQ ID NO: 19802 - DNA, 15 bp, Homo sapiens
acctacttcaacaac

SEQ ID NO: 19803 - DNA, 15 bp, Homo sapiens
tacctacttcaacaa

SEQ ID NO: 19804 - DNA, 15 bp, Homo sapiens
atacctacttcaaca

SEQ ID NO: 19805 - DNA, 15 bp, Homo sapiens
aatacctacttcaac

SEQ ID NO: 19806 - DNA, 15 bp, Homo sapiens
taatacctacttcaa

SEQ ID NO: 19807 - DNA, 15 bp, Homo sapiens
ataatacctacttca

SEQ ID NO: 19808 - DNA, 15 bp, Homo sapiens
aataatacctacttc

SEQ ID NO: 19809 - DNA, 15 bp, Homo sapiens
taataatacctactt

SEQ ID NO: 19810 - DNA, 15 bp, Homo sapiens
ttaataatacctact

SEQ ID NO: 19811 - DNA, 15 bp, Homo sapiens
attaataatacctac

SEQ ID NO: 19812 - DNA, 15 bp, Homo sapiens
cattaataataccta

SEQ ID NO: 19813 - DNA, 15 bp, Homo sapiens
tcattaataatacct

SEQ ID NO: 19814 - DNA, 15 bp, Homo sapiens
ttcattaataatacc

SEQ ID NO: 19815 - DNA, 15 bp, Homo sapiens
gttcattaataatac

SEQ ID NO: 19816 - DNA, 15 bp, Homo sapiens
cgttcattaataata

SEQ ID NO: 19817 - DNA, 15 bp, Homo sapiens
tcgttcattaataat

SEQ ID NO: 19818 - DNA, 15 bp, Homo sapiens
ttcgttcattaataa

SEQ ID NO: 19819 - DNA, 15 bp, Homo sapiens
gttcgttcattaata

SEQ ID NO: 19820 - DNA, 15 bp, Homo sapiens
cgttcgttcattaat

SEQ ID NO: 19821 - DNA, 15 bp, Homo sapiens
acgttcgttcattaa

SEQ ID NO: 19822 - DNA, 15 bp, Homo sapiens
gacgttcgttcatta

SEQ ID NO: 19823 - DNA, 15 bp, Homo sapiens
agacgttcgttcatt

SEQ ID NO: 19824 - DNA, 15 bp, Homo sapiens
tagacgttcgttcat

SEQ ID NO: 19825 - DNA, 15 bp, Homo sapiens
atagacgttcgttca

SEQ ID NO: 19826 - DNA, 15 bp, Homo sapiens
aatagacgttcgttc

SEQ ID NO: 19827 - DNA, 15 bp, Homo sapiens
aaatagacgttcgtt

SEQ ID NO: 19828 - DNA, 15 bp, Homo sapiens
aaaatagacgttcgt

SEQ ID NO: 19829 - DNA, 15 bp, Homo sapiens
taaaatagacgttcg

SEQ ID NO: 19830 - DNA, 15 bp, Homo sapiens
ctaaaatagacgttc

SEQ ID NO: 19831 - DNA, 15 bp, Homo sapiens
gctaaaatagacgtt

SEQ ID NO: 19832 - DNA, 15 bp, Homo sapiens
agctaaaatagacgt

SEQ ID NO: 19833 - DNA, 15 bp, Homo sapiens
gagctaaaatagacg

SEQ ID NO: 19834 - DNA, 15 bp, Homo sapiens
ggagctaaaatagac

SEQ ID NO: 19835 - DNA, 15 bp, Homo sapiens
tggagctaaaataga

SEQ ID NO: 19836 - DNA, 15 bp, Homo sapiens
ttggagctaaaatag

SEQ ID NO: 19837 - DNA, 15 bp, Homo sapiens
cttggagctaaaata

SEQ ID NO: 19838 - DNA, 15 bp, Homo sapiens
tcttggagctaaaat

SEQ ID NO: 19839 - DNA, 15 bp, Homo sapiens
ctcttggagctaaaa

SEQ ID NO: 19840 - DNA, 15 bp, Homo sapiens
gctcttggagctaaa

SEQ ID NO: 19841 - DNA, 15 bp, Homo sapiens
ggctcttggagctaa

SEQ ID NO: 19842 - DNA, 15 bp, Homo sapiens
gggctcttggagcta

SEQ ID NO: 19843 - DNA, 15 bp, Homo sapiens
ggggctcttggagct

SEQ ID NO: 19844 - DNA, 15 bp, Homo sapiens
aggggctcttggagc

SEQ ID NO: 19845 - DNA, 15 bp, Homo sapiens
caggggctcttggag

SEQ ID NO: 19846 - DNA, 15 bp, Homo sapiens
ccaggggctcttgga

SEQ ID NO: 19847 - DNA, 15 bp, Homo sapiens
accaggggctcttgg

SEQ ID NO: 19848 - DNA, 15 bp, Homo sapiens
gaccaggggctcttg

SEQ ID NO: 19849 - DNA, 15 bp, Homo sapiens
agaccaggggctctt

SEQ ID NO: 19850 - DNA, 15 bp, Homo sapiens
aagaccaggggctct

SEQ ID NO: 19851 - DNA, 15 bp, Homo sapiens
gaagaccaggggctc

SEQ ID NO: 19852 - DNA, 15 bp, Homo sapiens
ggaagaccaggggct

SEQ ID NO: 19853 - DNA, 15 bp, Homo sapiens
tggaagaccaggggc

SEQ ID NO: 19854 - DNA, 15 bp, Homo sapiens
ctggaagaccagggg

SEQ ID NO: 19855 - DNA, 15 bp, Homo sapiens
tctggaagaccaggg

SEQ ID NO: 19856 - DNA, 15 bp, Homo sapiens
ttctggaagaccagg

SEQ ID NO: 19857 - DNA, 15 bp, Homo sapiens
cttctggaagaccag

SEQ ID NO: 19858 - DNA, 15 bp, Homo sapiens
tcttctggaagacca

SEQ ID NO: 19859 - DNA, 15 bp, Homo sapiens
ctcttctggaagacc

SEQ ID NO: 19860 - DNA, 15 bp, Homo sapiens
tctcttctggaagac

SEQ ID NO: 19861 - DNA, 15 bp, Homo sapiens
gtctcttctggaaga

SEQ ID NO: 19862 - DNA, 15 bp, Homo sapiens
agtctcttctggaag

SEQ ID NO: 19863 - DNA, 15 bp, Homo sapiens
gagtctcttctggaa

SEQ ID NO: 19864 - DNA, 15 bp, Homo sapiens
ggagtctcttctgga

SEQ ID NO: 19865 - DNA, 15 bp, Homo sapiens
gggagtctcttctgg

SEQ ID NO: 19866 - DNA, 15 bp, Homo sapiens
tgggagtctcttctg

SEQ ID NO: 19867 - DNA, 15 bp, Homo sapiens
ttgggagtctcttct

SEQ ID NO: 19868 - DNA, 15 bp, Homo sapiens
attgggagtctcttc

SEQ ID NO: 19869 - DNA, 15 bp, Homo sapiens
cattgggagtctctt

SEQ ID NO: 19870 - DNA, 15 bp, Homo sapiens
tcattgggagtctct

SEQ ID NO: 19871 - DNA, 15 bp, Homo sapiens
atcattgggagtctc

SEQ ID NO: 19872 - DNA, 15 bp, Homo sapiens
gatcattgggagtct

SEQ ID NO: 19873 - DNA, 15 bp, Homo sapiens
agatcattgggagtc

SEQ ID NO: 19874 - DNA, 15 bp, Homo sapiens
aagatcattgggagt

SEQ ID NO: 19875 - DNA, 15 bp, Homo sapiens
gaagatcattgggag

SEQ ID NO: 19876 - DNA, 15 bp, Homo sapiens
ggaagatcattggga

SEQ ID NO: 19877 - DNA, 15 bp, Homo sapiens
tggaagatcattggg

SEQ ID NO: 19878 - DNA, 15 bp, Homo sapiens
ctggaagatcattgg

SEQ ID NO: 19879 - DNA, 15 bp, Homo sapiens
tctggaagatcattg

SEQ ID NO: 19880 - DNA, 15 bp, Homo sapiens
ttctggaagatcatt

SEQ ID NO: 19881 - DNA, 15 bp, Homo sapiens
cttctggaagatcat

SEQ ID NO: 19882 - DNA, 15 bp, Homo sapiens
gcttctggaagatca

SEQ ID NO: 19883 - DNA, 15 bp, Homo sapiens
tgcttctggaagatc

SEQ ID NO: 19884 - DNA, 15 bp, Homo sapiens
ctgcttctggaagat

SEQ ID NO: 19885 - DNA, 15 bp, Homo sapiens
gctgcttctggaaga

SEQ ID NO: 19886 - DNA, 15 bp, Homo sapiens
agctgcttctggaag

SEQ ID NO: 19887 - DNA, 15 bp, Homo sapiens
cagctgcttctggaa

SEQ ID NO: 19888 - DNA, 15 bp, Homo sapiens
ccagctgcttctgga

SEQ ID NO: 19889 - DNA, 15 bp, Homo sapiens
cccagctgcttctgg

SEQ ID NO: 19890 - DNA, 15 bp, Homo sapiens
gcccagctgcttctg

SEQ ID NO: 19891 - DNA, 15 bp, Homo sapiens
agcccagctgcttct

SEQ ID NO: 19892 - DNA, 15 bp, Homo sapiens
aagcccagctgcttc

SEQ ID NO: 19893 - DNA, 15 bp, Homo sapiens
gaagcccagctgctt

SEQ ID NO: 19894 - DNA, 15 bp, Homo sapiens
agaagcccagctgct

SEQ ID NO: 19895 - DNA, 15 bp, Homo sapiens
aagaagcccagctgc

SEQ ID NO: 19896 - DNA, 15 bp, Homo sapiens
aaagaagcccagctg

SEQ ID NO: 19897 - DNA, 15 bp, Homo sapiens
aaaagaagcccagct

SEQ ID NO: 19898 - DNA, 15 bp, Homo sapiens
caaaagaagcccagc

SEQ ID NO: 19899 - DNA, 15 bp, Homo sapiens
ccaaaagaagcccag

SEQ ID NO: 19900 - DNA, 15 bp, Homo sapiens
accaaaagaagccca

SEQ ID NO: 19901 - DNA, 15 bp, Homo sapiens
gaccaaaagaagccc

SEQ ID NO: 19902 - DNA, 15 bp, Homo sapiens
ggaccaaaagaagcc

SEQ ID NO: 19903 - DNA, 15 bp, Homo sapiens
aggaccaaaagaagc

SEQ ID NO: 19904 - DNA, 15 bp, Homo sapiens
gaggaccaaaagaag

SEQ ID NO: 19905 - DNA, 15 bp, Homo sapiens
ggaggaccaaaagaa

SEQ ID NO: 19906 - DNA, 15 bp, Homo sapiens
gggaggaccaaaaga

SEQ ID NO: 19907 - DNA, 15 bp, Homo sapiens
ggggaggaccaaaag

SEQ ID NO: 19908 - DNA, 15 bp, Homo sapiens
gggggaggaccaaaa

SEQ ID NO: 19909 - DNA, 15 bp, Homo sapiens
tgggggaggaccaaa

SEQ ID NO: 19910 - DNA, 15 bp, Homo sapiens
gtgggggaggaccaa

SEQ ID NO: 19911 - DNA, 15 bp, Homo sapiens
ggtgggggaggacca

SEQ ID NO: 19912 - DNA, 15 bp, Homo sapiens
gggtgggggaggacc

SEQ ID NO: 19913 - DNA, 15 bp, Homo sapiens
tgggtgggggaggac

SEQ ID NO: 19914 - DNA, 15 bp, Homo sapiens
ctgggtgggggagga

SEQ ID NO: 19915 - DNA, 15 bp, Homo sapiens
cctgggtgggggagg

SEQ ID NO: 19916 - DNA, 15 bp, Homo sapiens
acctgggtgggggag

SEQ ID NO: 19917 - DNA, 15 bp, Homo sapiens
cacctgggtggggga

SEQ ID NO: 19918 - DNA, 15 bp, Homo sapiens
gcacctgggtggggg

SEQ ID NO: 19919 - DNA, 15 bp, Homo sapiens
tgcacctgggtgggg

SEQ ID NO: 19920 - DNA, 15 bp, Homo sapiens
ctgcacctgggtggg

SEQ ID NO: 19921 - DNA, 15 bp, Homo sapiens
actgcacctgggtgg

SEQ ID NO: 19922 - DNA, 15 bp, Homo sapiens
gactgcacctgggtg

SEQ ID NO: 19923 - DNA, 15 bp, Homo sapiens
ggactgcacctgggt

SEQ ID NO: 19924 - DNA, 15 bp, Homo sapiens
gggactgcacctggg

SEQ ID NO: 19925 - DNA, 15 bp, Homo sapiens
cgggactgcacctgg

SEQ ID NO: 19926 - DNA, 15 bp, Homo sapiens
acgggactgcacctg

SEQ ID NO: 19927 - DNA, 15 bp, Homo sapiens
aacgggactgcacct

SEQ ID NO: 19928 - DNA, 15 bp, Homo sapiens
gaacgggactgcacc

SEQ ID NO: 19929 - DNA, 15 bp, Homo sapiens
agaacgggactgcac

SEQ ID NO: 19930 - DNA, 15 bp, Homo sapiens
gagaacgggactgca

SEQ ID NO: 19931 - DNA, 15 bp, Homo sapiens
ggagaacgggactgc

SEQ ID NO: 19932 - DNA, 15 bp, Homo sapiens
gggagaacgggactg

SEQ ID NO: 19933 - DNA, 15 bp, Homo sapiens
agggagaacgggact

SEQ ID NO: 19934 - DNA, 15 bp, Homo sapiens
cagggagaacgggac

SEQ ID NO: 19935 - DNA, 15 bp, Homo sapiens
gcagggagaacggga

SEQ ID NO: 19936 - DNA, 15 bp, Homo sapiens
ggcagggagaacggg

SEQ ID NO: 19937 - DNA, 15 bp, Homo sapiens
aggcagggagaacgg

SEQ ID NO: 19938 - DNA, 15 bp, Homo sapiens
caggcagggagaacg

SEQ ID NO: 19939 - DNA, 15 bp, Homo sapiens
ccaggcagggagaac

SEQ ID NO: 19940 - DNA, 15 bp, Homo sapiens
cccaggcagggagaa

SEQ ID NO: 19941 - DNA, 15 bp, Homo sapiens
acccaggcagggaga

SEQ ID NO: 19942 - DNA, 15 bp, Homo sapiens
cacccaggcagggag

SEQ ID NO: 19943 - DNA, 15 bp, Homo sapiens
tcacccaggcaggga

SEQ ID NO: 19944 - DNA, 15 bp, Homo sapiens
ctcacccaggcaggg

SEQ ID NO: 19945 - DNA, 15 bp, Homo sapiens
actcacccaggcagg

SEQ ID NO: 19946 - DNA, 15 bp, Homo sapiens
aactcacccaggcag

SEQ ID NO: 19947 - DNA, 15 bp, Homo sapiens
aaactcacccaggca

SEQ ID NO: 19948 - DNA, 15 bp, Homo sapiens
caaactcacccaggc

SEQ ID NO: 19949 - DNA, 15 bp, Homo sapiens
tcaaactcacccagg

SEQ ID NO: 19950 - DNA, 15 bp, Homo sapiens
atcaaactcacccag

SEQ ID NO: 19951 - DNA, 15 bp, Homo sapiens
aatcaaactcaccca

SEQ ID NO: 19952 - DNA, 15 bp, Homo sapiens
gaatcaaactcaccc

SEQ ID NO: 19953 - DNA, 15 bp, Homo sapiens
ggaatcaaactcacc

SEQ ID NO: 19954 - DNA, 15 bp, Homo sapiens
aggaatcaaactcac

SEQ ID NO: 19955 - DNA, 15 bp, Homo sapiens
gaggaatcaaactca

SEQ ID NO: 19956 - DNA, 15 bp, Homo sapiens
agaggaatcaaactc

SEQ ID NO: 19957 - DNA, 15 bp, Homo sapiens
cagaggaatcaaact

SEQ ID NO: 19958 - DNA, 15 bp, Homo sapiens
gcagaggaatcaaac

SEQ ID NO: 19959 - DNA, 15 bp, Homo sapiens
ggcagaggaatcaaa

SEQ ID NO: 19960 - DNA, 15 bp, Homo sapiens
cggcagaggaatcaa

SEQ ID NO: 19961 - DNA, 15 bp, Homo sapiens
acggcagaggaatca

SEQ ID NO: 19962 - DNA, 15 bp, Homo sapiens
cacggcagaggaatc

SEQ ID NO: 19963 - DNA, 15 bp, Homo sapiens
ccacggcagaggaat

SEQ ID NO: 19964 - DNA, 15 bp, Homo sapiens
tccacggcagaggaa

SEQ ID NO: 19965 - DNA, 15 bp, Homo sapiens
ttccacggcagagga

SEQ ID NO: 19966 - DNA, 15 bp, Homo sapiens
attccacggcagagg

SEQ ID NO: 19967 - DNA, 15 bp, Homo sapiens
tattccacggcagag

SEQ ID NO: 19968 - DNA, 15 bp, Homo sapiens
ctattccacggcaga

SEQ ID NO: 19969 - DNA, 15 bp, Homo sapiens
cctattccacggcag

SEQ ID NO: 19970 - DNA, 15 bp, Homo sapiens
gcctattccacggca

SEQ ID NO: 19971 - DNA, 15 bp, Homo sapiens
agcctattccacggc

SEQ ID NO: 19972 - DNA, 15 bp, Homo sapiens
tagcctattccacgg

SEQ ID NO: 19973 - DNA, 15 bp, Homo sapiens
ctagcctattccacg

SEQ ID NO: 19974 - DNA, 15 bp, Homo sapiens
cctagcctattccac

SEQ ID NO: 19975 - DNA, 15 bp, Homo sapiens
gcctagcctattcca

SEQ ID NO: 19976 - DNA, 15 bp, Homo sapiens
agcctagcctattcc

SEQ ID NO: 19977 - DNA, 15 bp, Homo sapiens
cagcctagcctattc

SEQ ID NO: 19978 - DNA, 15 bp, Homo sapiens
gcagcctagcctatt

SEQ ID NO: 19979 - DNA, 15 bp, Homo sapiens
agcagcctagcctat

SEQ ID NO: 19980 - DNA, 15 bp, Homo sapiens
tagcagcctagccta

SEQ ID NO: 19981 - DNA, 15 bp, Homo sapiens
gtagcagcctagcct

SEQ ID NO: 19982 - DNA, 15 bp, Homo sapiens
ggtagcagcctagcc

SEQ ID NO: 19983 - DNA, 15 bp, Homo sapiens
aggtagcagcctagc

SEQ ID NO: 19984 - DNA, 15 bp, Homo sapiens
gaggtagcagcctag

SEQ ID NO: 19985 - DNA, 15 bp, Homo sapiens
agaggtagcagccta

SEQ ID NO: 19986 - DNA, 15 bp, Homo sapiens
aagaggtagcagcct

SEQ ID NO: 19987 - DNA, 15 bp, Homo sapiens
caagaggtagcagcc

SEQ ID NO: 19988 - DNA, 15 bp, Homo sapiens
tcaagaggtagcagc

SEQ ID NO: 19989 - DNA, 15 bp, Homo sapiens
ctcaagaggtagcag

SEQ ID NO: 19990 - DNA, 15 bp, Homo sapiens
gctcaagaggtagca

SEQ ID NO: 19991 - DNA, 15 bp, Homo sapiens
ggctcaagaggtagc

SEQ ID NO: 19992 - DNA, 15 bp, Homo sapiens
aggctcaagaggtag

SEQ ID NO: 19993 - DNA, 15 bp, Homo sapiens
gaggctcaagaggta

SEQ ID NO: 19994 - DNA, 15 bp, Homo sapiens
agaggctcaagaggt

SEQ ID NO: 19995 - DNA, 15 bp, Homo sapiens
aagaggctcaagagg

SEQ ID NO: 19996 - DNA, 15 bp, Homo sapiens
gaagaggctcaagag

SEQ ID NO: 19997 - DNA, 15 bp, Homo sapiens
ggaagaggctcaaga

SEQ ID NO: 19998 - DNA, 15 bp, Homo sapiens
tggaagaggctcaag

SEQ ID NO: 19999 - DNA, 15 bp, Homo sapiens
gtggaagaggctcaa

SEQ ID NO: 20000 - DNA, 15 bp, Homo sapiens
ggtggaagaggctca

SEQ ID NO: 20001 - DNA, 15 bp, Homo sapiens
tggtggaagaggctc

SEQ ID NO: 20002 - DNA, 15 bp, Homo sapiens
ctggtggaagaggct

SEQ ID NO: 20003 - DNA, 15 bp, Homo sapiens
cctggtggaagaggc

SEQ ID NO: 20004 - DNA, 15 bp, Homo sapiens
gcctggtggaagagg

SEQ ID NO: 20005 - DNA, 15 bp, Homo sapiens
ggcctggtggaagag

SEQ ID NO: 20006 - DNA, 15 bp, Homo sapiens
tggcctggtggaaga

SEQ ID NO: 20007 - DNA, 15 bp, Homo sapiens
atggcctggtggaag

SEQ ID NO: 20008 - DNA, 15 bp, Homo sapiens
gatggcctggtggaa

SEQ ID NO: 20009 - DNA, 15 bp, Homo sapiens
ggatggcctggtgga

SEQ ID NO: 20010 - DNA, 15 bp, Homo sapiens
tggatggcctggtgg

SEQ ID NO: 20011 - DNA, 15 bp, Homo sapiens
atggatggcctggtg

SEQ ID NO: 20012 - DNA, 15 bp, Homo sapiens
aatggatggcctggt

SEQ ID NO: 20013 - DNA, 15 bp, Homo sapiens
taatggatggcctgg

SEQ ID NO: 20014 - DNA, 15 bp, Homo sapiens
ctaatggatggcctg

SEQ ID NO: 20015 - DNA, 15 bp, Homo sapiens
cctaatggatggcct

SEQ ID NO: 20016 - DNA, 15 bp, Homo sapiens
acctaatggatggcc

SEQ ID NO: 20017 - DNA, 15 bp, Homo sapiens
cacctaatggatggc

SEQ ID NO: 20018 - DNA, 15 bp, Homo sapiens
ccacctaatggatgg

SEQ ID NO: 20019 - DNA, 15 bp, Homo sapiens
gccacctaatggatg

SEQ ID NO: 20020 - DNA, 15 bp, Homo sapiens
cgccacctaatggat

SEQ ID NO: 20021 - DNA, 15 bp, Homo sapiens
tcgccacctaatgga

SEQ ID NO: 20022 - DNA, 15 bp, Homo sapiens
gtcgccacctaatgg

SEQ ID NO: 20023 - DNA, 15 bp, Homo sapiens
tgtcgccacctaatg

SEQ ID NO: 20024 - DNA, 15 bp, Homo sapiens
ctgtcgccacctaat

SEQ ID NO: 20025 - DNA, 15 bp, Homo sapiens
tctgtcgccacctaa

SEQ ID NO: 20026 - DNA, 15 bp, Homo sapiens
ctctgtcgccaccta

SEQ ID NO: 20027 - DNA, 15 bp, Homo sapiens
tctctgtcgccacct

SEQ ID NO: 20028 - DNA, 15 bp, Homo sapiens
ctctctgtcgccacc

SEQ ID NO: 20029 - DNA, 15 bp, Homo sapiens
gctctctgtcgccac

SEQ ID NO: 20030 - DNA, 15 bp, Homo sapiens
tgctctctgtcgcca

SEQ ID NO: 20031 - DNA, 15 bp, Homo sapiens
gtgctctctgtcgcc

SEQ ID NO: 20032 - DNA, 15 bp, Homo sapiens
agtgctctctgtcgc

SEQ ID NO: 20033 - DNA, 15 bp, Homo sapiens
tagtgctctctgtcg

SEQ ID NO: 20034 - DNA, 15 bp, Homo sapiens
ttagtgctctctgtc

SEQ ID NO: 20035 - DNA, 15 bp, Homo sapiens
tttagtgctctctgt

SEQ ID NO: 20036 - DNA, 15 bp, Homo sapiens
ttttagtgctctctg

SEQ ID NO: 20037 - DNA, 15 bp, Homo sapiens
cttttagtgctctct

SEQ ID NO: 20038 - DNA, 15 bp, Homo sapiens
ccttttagtgctctc

SEQ ID NO: 20039 - DNA, 15 bp, Homo sapiens
tccttttagtgctct

SEQ ID NO: 20040 - DNA, 15 bp, Homo sapiens
ttccttttagtgctc

SEQ ID NO: 20041 - DNA, 15 bp, Homo sapiens
gttccttttagtgct

SEQ ID NO: 20042 - DNA, 15 bp, Homo sapiens
agttccttttagtgc

SEQ ID NO: 20043 - DNA, 15 bp, Homo sapiens
tagttccttttagtg

SEQ ID NO: 20044 - DNA, 15 bp, Homo sapiens
gtagttccttttagt

SEQ ID NO: 20045 - DNA, 15 bp, Homo sapiens
agtagttccttttag

SEQ ID NO: 20046 - DNA, 15 bp, Homo sapiens
tagtagttcctttta

SEQ ID NO: 20047 - DNA, 15 bp, Homo sapiens
atagtagttcctttt

SEQ ID NO: 20048 - DNA, 15 bp, Homo sapiens
catagtagttccttt

SEQ ID NO: 20049 - DNA, 15 bp, Homo sapiens
ccatagtagttcctt

SEQ ID NO: 20050 - DNA, 15 bp, Homo sapiens
tccatagtagttcct

SEQ ID NO: 20051 - DNA, 15 bp, Homo sapiens
ttccatagtagttcc

SEQ ID NO: 20052 - DNA, 15 bp, Homo sapiens
tttccatagtagttc

SEQ ID NO: 20053 - DNA, 15 bp, Homo sapiens
atttccatagtagtt

SEQ ID NO: 20054 - DNA, 15 bp, Homo sapiens
tatttccatagtagt

SEQ ID NO: 20055 - DNA, 15 bp, Homo sapiens
ttatttccatagtag

SEQ ID NO: 20056 - DNA, 15 bp, Homo sapiens
tttatttccatagta

SEQ ID NO: 20057 - DNA, 15 bp, Homo sapiens
ttttatttccatagt

SEQ ID NO: 20058 - DNA, 15 bp, Homo sapiens
gttttatttccatag

SEQ ID NO: 20059 - DNA, 15 bp, Homo sapiens
agttttatttccata

SEQ ID NO: 20060 - DNA, 15 bp, Homo sapiens
aagttttatttccat

SEQ ID NO: 20061 - DNA, 15 bp, Homo sapiens
caagttttatttcca

SEQ ID NO: 20062 - DNA, 15 bp, Homo sapiens
acaagttttatttcc

SEQ ID NO: 20063 - DNA, 15 bp, Homo sapiens
aacaagttttatttc

SEQ ID NO: 20064 - DNA, 15 bp, Homo sapiens
aaacaagttttattt

SEQ ID NO: 20065 - DNA, 15 bp, Homo sapiens
aaaacaagttttatt

SEQ ID NO: 20066 - DNA, 15 bp, Homo sapiens
caaaacaagttttat

SEQ ID NO: 20067 - DNA, 15 bp, Homo sapiens
gcaaaacaagtttta

SEQ ID NO: 20068 - DNA, 15 bp, Homo sapiens
agcaaaacaagtttt

SEQ ID NO: 20069 - DNA, 15 bp, Homo sapiens
aagcaaaacaagttt

SEQ ID NO: 20070 - DNA, 15 bp, Homo sapiens
gaagcaaaacaagtt

SEQ ID NO: 20071 - DNA, 15 bp, Homo sapiens
agaagcaaaacaagt

SEQ ID NO: 20072 - DNA, 15 bp, Homo sapiens
aagaagcaaaacaag

SEQ ID NO: 20073 - DNA, 15 bp, Homo sapiens
caagaagcaaaacaa

SEQ ID NO: 20074 - DNA, 15 bp, Homo sapiens
ccaagaagcaaaaca

SEQ ID NO: 20075 - DNA, 15 bp, Homo sapiens
cccaagaagcaaaac

SEQ ID NO: 20076 - DNA, 15 bp, Homo sapiens
ccccaagaagcaaaa

SEQ ID NO: 20077 - DNA, 15 bp, Homo sapiens
cccccaagaagcaaa

SEQ ID NO: 20078 - DNA, 15 bp, Homo sapiens
ccccccaagaagcaa

SEQ ID NO: 20079 - DNA, 15 bp, Homo sapiens
tccccccaagaagca

SEQ ID NO: 20080 - DNA, 15 bp, Homo sapiens
ttccccccaagaagc

SEQ ID NO: 20081 - DNA, 15 bp, Homo sapiens
tttccccccaagaag

SEQ ID NO: 20082 - DNA, 15 bp, Homo sapiens
ttttccccccaagaa

SEQ ID NO: 20083 - DNA, 15 bp, Homo sapiens
tttttccccccaaga

SEQ ID NO: 20084 - DNA, 15 bp, Homo sapiens
ttttttccccccaag

SEQ ID NO: 20085 - DNA, 15 bp, Homo sapiens
tttttttccccccaa

SEQ ID NO: 20086 - DNA, 15 bp, Homo sapiens
tttttttttcccccc

SEQ ID NO: 20087 - DNA, 15 bp, Homo sapiens
ctttttttttccccc

SEQ ID NO: 20088 - DNA, 15 bp, Homo sapiens
tctttttttttcccc

SEQ ID NO: 20089 - DNA, 15 bp, Homo sapiens
ttctttttttttccc

SEQ ID NO: 20090 - DNA, 15 bp, Homo sapiens
tttctttttttttcc

SEQ ID NO: 20091 - DNA, 15 bp, Homo sapiens
ttttctttttttttc

SEQ ID NO: 20092 - DNA, 15 bp, Homo sapiens
cctttttcttttttt

SEQ ID NO: 20093 - DNA, 15 bp, Homo sapiens
gcctttttctttttt

SEQ ID NO: 20094 - DNA, 15 bp, Homo sapiens
agcctttttcttttt

SEQ ID NO: 20095 - DNA, 15 bp, Homo sapiens
aagcctttttctttt

SEQ ID NO: 20096 - DNA, 15 bp, Homo sapiens
caagcctttttcttt

SEQ ID NO: 20097 - DNA, 15 bp, Homo sapiens
acaagcctttttctt

SEQ ID NO: 20098 - DNA, 15 bp, Homo sapiens
cacaagcctttttct

SEQ ID NO: 20099 - DNA, 15 bp, Homo sapiens
ccacaagcctttttc

SEQ ID NO: 20100 - DNA, 15 bp, Homo sapiens
cccacaagccttttt

SEQ ID NO: 20101 - DNA, 15 bp, Homo sapiens
ccccacaagcctttt

SEQ ID NO: 20102 - DNA, 15 bp, Homo sapiens
gccccacaagccttt

SEQ ID NO: 20103 - DNA, 15 bp, Homo sapiens
cgccccacaagcctt

SEQ ID NO: 20104 - DNA, 15 bp, Homo sapiens
acgccccacaagcct

SEQ ID NO: 20105 - DNA, 15 bp, Homo sapiens
cacgccccacaagcc

SEQ ID NO: 20106 - DNA, 15 bp, Homo sapiens
acacgccccacaagc

SEQ ID NO: 20107 - DNA, 15 bp, Homo sapiens
cacacgccccacaag

SEQ ID NO: 20108 - DNA, 15 bp, Homo sapiens
acacacgccccacaa

SEQ ID NO: 20109 - DNA, 15 bp, Homo sapiens
cacacacgccccaca

SEQ ID NO: 20110 - DNA, 15 bp, Homo sapiens
gcacacacgccccac

SEQ ID NO: 20111 - DNA, 15 bp, Homo sapiens
tgcacacacgcccca

SEQ ID NO: 20112 - DNA, 15 bp, Homo sapiens
atgcacacacgcccc

SEQ ID NO: 20113 - DNA, 15 bp, Homo sapiens
aatgcacacacgccc

SEQ ID NO: 20114 - DNA, 15 bp, Homo sapiens
aaatgcacacacgcc

SEQ ID NO: 20115 - DNA, 15 bp, Homo sapiens
aaaatgcacacacgc

SEQ ID NO: 20116 - DNA, 15 bp, Homo sapiens
taaaatgcacacacg

SEQ ID NO: 20117 - DNA, 15 bp, Homo sapiens
ctaaaatgcacacac

SEQ ID NO: 20118 - DNA, 15 bp, Homo sapiens
actaaaatgcacaca

SEQ ID NO: 20119 - DNA, 15 bp, Homo sapiens
gactaaaatgcacac

SEQ ID NO: 20120 - DNA, 15 bp, Homo sapiens
tgactaaaatgcaca

SEQ ID NO: 20121 - DNA, 15 bp, Homo sapiens
ctgactaaaatgcac

SEQ ID NO: 20122 - DNA, 15 bp, Homo sapiens
tctgactaaaatgca

SEQ ID NO: 20123 - DNA, 15 bp, Homo sapiens
atctgactaaaatgc

SEQ ID NO: 20124 - DNA, 15 bp, Homo sapiens
aatctgactaaaatg

SEQ ID NO: 20125 - DNA, 15 bp, Homo sapiens
aaatctgactaaaat

SEQ ID NO: 20126 - DNA, 15 bp, Homo sapiens
aaaatctgactaaaa

SEQ ID NO: 20127 - DNA, 15 bp, Homo sapiens
taaaatctgactaaa

SEQ ID NO: 20128 - DNA, 15 bp, Homo sapiens
gtaaaatctgactaa

SEQ ID NO: 20129 - DNA, 15 bp, Homo sapiens
agtaaaatctgacta

SEQ ID NO: 20130 - DNA, 15 bp, Homo sapiens
cagtaaaatctgact

SEQ ID NO: 20131 - DNA, 15 bp, Homo sapiens
acagtaaaatctgac

SEQ ID NO: 20132 - DNA, 15 bp, Homo sapiens
cacagtaaaatctga

SEQ ID NO: 20133 - DNA, 15 bp, Homo sapiens
gcacagtaaaatctg

SEQ ID NO: 20134 - DNA, 15 bp, Homo sapiens
tgcacagtaaaatct

SEQ ID NO: 20135 - DNA, 15 bp, Homo sapiens
ttgcacagtaaaatc

SEQ ID NO: 20136 - DNA, 15 bp, Homo sapiens
tttgcacagtaaaat

SEQ ID NO: 20137 - DNA, 15 bp, Homo sapiens
ttttgcacagtaaaa

SEQ ID NO: 20138 - DNA, 15 bp, Homo sapiens
gttttgcacagtaaa

SEQ ID NO: 20139 - DNA, 15 bp, Homo sapiens
tgttttgcacagtaa

SEQ ID NO: 20140 - DNA, 15 bp, Homo sapiens
atgttttgcacagta

SEQ ID NO: 20141 - DNA, 15 bp, Homo sapiens
aatgttttgcacagt

SEQ ID NO: 20142 - DNA, 15 bp, Homo sapiens
aaatgttttgcacag

SEQ ID NO: 20143 - DNA, 15 bp, Homo sapiens
caaatgttttgcaca

SEQ ID NO: 20144 - DNA, 15 bp, Homo sapiens
tcaaatgttttgcac

SEQ ID NO: 20145 - DNA, 15 bp, Homo sapiens
ctcaaatgttttgca

SEQ ID NO: 20146 - DNA, 15 bp, Homo sapiens
tctcaaatgttttgc

SEQ ID NO: 20147 - DNA, 15 bp, Homo sapiens
ctctcaaatgttttg

SEQ ID NO: 20148 - DNA, 15 bp, Homo sapiens
tctctcaaatgtttt

SEQ ID NO: 20149 - DNA, 15 bp, Homo sapiens
atctctcaaatgttt

SEQ ID NO: 20150 - DNA, 15 bp, Homo sapiens
aatctctcaaatgtt

SEQ ID NO: 20151 - DNA, 15 bp, Homo sapiens
aaatctctcaaatgt

SEQ ID NO: 20152 - DNA, 15 bp, Homo sapiens
gaaatctctcaaatg

SEQ ID NO: 20153 - DNA, 15 bp, Homo sapiens
agaaatctctcaaat

SEQ ID NO: 20154 - DNA, 15 bp, Homo sapiens
cagaaatctctcaaa

SEQ ID NO: 20155 - DNA, 15 bp, Homo sapiens
gcagaaatctctcaa

SEQ ID NO: 20156 - DNA, 15 bp, Homo sapiens
ggcagaaatctctca

SEQ ID NO: 20157 - DNA, 15 bp, Homo sapiens
gggcagaaatctctc

SEQ ID NO: 20158 - DNA, 15 bp, Homo sapiens
agggcagaaatctct

SEQ ID NO: 20159 - DNA, 15 bp, Homo sapiens
gagggcagaaatctc

SEQ ID NO: 20160 - DNA, 15 bp, Homo sapiens
agagggcagaaatct

SEQ ID NO: 20161 - DNA, 15 bp, Homo sapiens
aagagggcagaaatc

SEQ ID NO: 20162 - DNA, 15 bp, Homo sapiens
aaagagggcagaaat

SEQ ID NO: 20163 - DNA, 15 bp, Homo sapiens
gaaagagggcagaaa

SEQ ID NO: 20164 - DNA, 15 bp, Homo sapiens
agaaagagggcagaa

SEQ ID NO: 20165 - DNA, 15 bp, Homo sapiens
gagaaagagggcaga

SEQ ID NO: 20166 - DNA, 15 bp, Homo sapiens
ggagaaagagggcag

SEQ ID NO: 20167 - DNA, 15 bp, Homo sapiens
gggagaaagagggca

SEQ ID NO: 20168 - DNA, 15 bp, Homo sapiens
agggagaaagagggc

SEQ ID NO: 20169 - DNA, 15 bp, Homo sapiens
aagggagaaagaggg

SEQ ID NO: 20170 - DNA, 15 bp, Homo sapiens
gaagggagaaagagg

SEQ ID NO: 20171 - DNA, 15 bp, Homo sapiens
ggaagggagaaagag

SEQ ID NO: 20172 - DNA, 15 bp, Homo sapiens
tggaagggagaaaga

SEQ ID NO: 20173 - DNA, 15 bp, Homo sapiens
atggaagggagaaag

SEQ ID NO: 20174 - DNA, 15 bp, Homo sapiens
aatggaagggagaaa

SEQ ID NO: 20175 - DNA, 15 bp, Homo sapiens
gaatggaagggagaa

SEQ ID NO: 20176 - DNA, 15 bp, Homo sapiens
agaatggaagggaga

SEQ ID NO: 20177 - DNA, 15 bp, Homo sapiens
aagaatggaagggag

SEQ ID NO: 20178 - DNA, 15 bp, Homo sapiens
gaagaatggaaggga

SEQ ID NO: 20179 - DNA, 15 bp, Homo sapiens
agaagaatggaaggg

SEQ ID NO: 20180 - DNA, 15 bp, Homo sapiens
gagaagaatggaagg

SEQ ID NO: 20181 - DNA, 15 bp, Homo sapiens
tgagaagaatggaag

SEQ ID NO: 20182 - DNA, 15 bp, Homo sapiens
ttgagaagaatggaa

SEQ ID NO: 20183 - DNA, 15 bp, Homo sapiens
gttgagaagaatgga

SEQ ID NO: 20184 - DNA, 15 bp, Homo sapiens
ggttgagaagaatgg

SEQ ID NO: 20185 - DNA, 15 bp, Homo sapiens
gggttgagaagaatg

SEQ ID NO: 20186 - DNA, 15 bp, Homo sapiens
tgggttgagaagaat

SEQ ID NO: 20187 - DNA, 15 bp, Homo sapiens
gtgggttgagaagaa

SEQ ID NO: 20188 - DNA, 15 bp, Homo sapiens
agtgggttgagaaga

SEQ ID NO: 20189 - DNA, 15 bp, Homo sapiens
cagtgggttgagaag

SEQ ID NO: 20190 - DNA, 15 bp, Homo sapiens
ccagtgggttgagaa

SEQ ID NO: 20191 - DNA, 15 bp, Homo sapiens
cccagtgggttgaga

SEQ ID NO: 20192 - DNA, 15 bp, Homo sapiens
gcccagtgggttgag

SEQ ID NO: 20193 - DNA, 15 bp, Homo sapiens
cgcccagtgggttga

SEQ ID NO: 20194 - DNA, 15 bp, Homo sapiens
gcgcccagtgggttg

SEQ ID NO: 20195 - DNA, 15 bp, Homo sapiens
ggcgcccagtgggtt

SEQ ID NO: 20196 - DNA, 15 bp, Homo sapiens
gggcgcccagtgggt

SEQ ID NO: 20197 - DNA, 15 bp, Homo sapiens
agggcgcccagtggg

SEQ ID NO: 20198 - DNA, 15 bp, Homo sapiens
tagggcgcccagtgg

SEQ ID NO: 20199 - DNA, 15 bp, Homo sapiens
gtagggcgcccagtg

SEQ ID NO: 20200 - DNA, 15 bp, Homo sapiens
ggtagggcgcccagt

SEQ ID NO: 20201 - DNA, 15 bp, Homo sapiens
tggtagggcgcccag

SEQ ID NO: 20202 - DNA, 15 bp, Homo sapiens
gtggtagggcgccca

SEQ ID NO: 20203 - DNA, 15 bp, Homo sapiens
ggtggtagggcgccc

SEQ ID NO: 20204 - DNA, 15 bp, Homo sapiens
gggtggtagggcgcc

SEQ ID NO: 20205 - DNA, 15 bp, Homo sapiens
ggggtggtagggcgc

SEQ ID NO: 20206 - DNA, 15 bp, Homo sapiens
aggggtggtagggcg

SEQ ID NO: 20207 - DNA, 15 bp, Homo sapiens
caggggtggtagggc

SEQ ID NO: 20208 - DNA, 15 bp, Homo sapiens
acaggggtggtaggg

SEQ ID NO: 20209 - DNA, 15 bp, Homo sapiens
gacaggggtggtagg

SEQ ID NO: 20210 - DNA, 15 bp, Homo sapiens
agacaggggtggtag

SEQ ID NO: 20211 - DNA, 15 bp, Homo sapiens
gagacaggggtggta

SEQ ID NO: 20212 - DNA, 15 bp, Homo sapiens
ggagacaggggtggt

SEQ ID NO: 20213 - DNA, 15 bp, Homo sapiens
aggagacaggggtgg

SEQ ID NO: 20214 - DNA, 15 bp, Homo sapiens
aaggagacaggggtg

SEQ ID NO: 20215 - DNA, 15 bp, Homo sapiens
gaaggagacaggggt

SEQ ID NO: 20216 - DNA, 15 bp, Homo sapiens
tgaaggagacagggg

SEQ ID NO: 20217 - DNA, 15 bp, Homo sapiens
ttgaaggagacaggg

SEQ ID NO: 20218 - DNA, 15 bp, Homo sapiens
cttgaaggagacagg

SEQ ID NO: 20219 - DNA, 15 bp, Homo sapiens
tcttgaaggagacag

SEQ ID NO: 20220 - DNA, 15 bp, Homo sapiens
atcttgaaggagaca

SEQ ID NO: 20221 - DNA, 15 bp, Homo sapiens
tatcttgaaggagac

SEQ ID NO: 20222 - DNA, 15 bp, Homo sapiens
ttatcttgaaggaga

SEQ ID NO: 20223 - DNA, 15 bp, Homo sapiens
cttatcttgaaggag

SEQ ID NO: 20224 - DNA, 15 bp, Homo sapiens
ccttatcttgaagga

SEQ ID NO: 20225 - DNA, 15 bp, Homo sapiens
accttatcttgaagg

SEQ ID NO: 20226 - DNA, 15 bp, Homo sapiens
taccttatcttgaag

SEQ ID NO: 20227 - DNA, 15 bp, Homo sapiens
ctaccttatcttgaa

SEQ ID NO: 20228 - DNA, 15 bp, Homo sapiens
tctaccttatcttga

SEQ ID NO: 20229 - DNA, 15 bp, Homo sapiens
atctaccttatcttg

SEQ ID NO: 20230 - DNA, 15 bp, Homo sapiens
gatctaccttatctt

SEQ ID NO: 20231 - DNA, 15 bp, Homo sapiens
tgatctaccttatct

SEQ ID NO: 20232 - DNA, 15 bp, Homo sapiens
ctgatctaccttatc

SEQ ID NO: 20233 - DNA, 15 bp, Homo sapiens
tctgatctaccttat

SEQ ID NO: 20234 - DNA, 15 bp, Homo sapiens
ttctgatctacctta

SEQ ID NO: 20235 - DNA, 15 bp, Homo sapiens
cttctgatctacctt

SEQ ID NO: 20236 - DNA, 15 bp, Homo sapiens
tcttctgatctacct

SEQ ID NO: 20237 - DNA, 15 bp, Homo sapiens
gtcttctgatctacc

SEQ ID NO: 20238 - DNA, 15 bp, Homo sapiens
ggtcttctgatctac

SEQ ID NO: 20239 - DNA, 15 bp, Homo sapiens
tggtcttctgatcta

SEQ ID NO: 20240 - DNA, 15 bp, Homo sapiens
ttggtcttctgatct

SEQ ID NO: 20241 - DNA, 15 bp, Homo sapiens
tttggtcttctgatc

SEQ ID NO: 20242 - DNA, 15 bp, Homo sapiens
atttggtcttctgat

SEQ ID NO: 20243 - DNA, 15 bp, Homo sapiens
tatttggtcttctga

SEQ ID NO: 20244 - DNA, 15 bp, Homo sapiens
ctatttggtcttctg

SEQ ID NO: 20245 - DNA, 15 bp, Homo sapiens
tctatttggtcttct

SEQ ID NO: 20246 - DNA, 15 bp, Homo sapiens
gtctatttggtcttc

SEQ ID NO: 20247 - DNA, 15 bp, Homo sapiens
tgtctatttggtctt

SEQ ID NO: 20248 - DNA, 15 bp, Homo sapiens
ttgtctatttggtct

SEQ ID NO: 20249 - DNA, 15 bp, Homo sapiens
tttgtctatttggtc

SEQ ID NO: 20250 - DNA, 15 bp, Homo sapiens
atttgtctatttggt

SEQ ID NO: 20251 - DNA, 15 bp, Homo sapiens
catttgtctatttgg

SEQ ID NO: 20252 - DNA, 15 bp, Homo sapiens
gcatttgtctatttg

SEQ ID NO: 20253 - DNA, 15 bp, Homo sapiens
ggcatttgtctattt

SEQ ID NO: 20254 - DNA, 15 bp, Homo sapiens
tggcatttgtctatt

SEQ ID NO: 20255 - DNA, 15 bp, Homo sapiens
atggcatttgtctat

SEQ ID NO: 20256 - DNA, 15 bp, Homo sapiens
catggcatttgtcta

SEQ ID NO: 20257 - DNA, 15 bp, Homo sapiens
acatggcatttgtct

SEQ ID NO: 20258 - DNA, 15 bp, Homo sapiens
gacatggcatttgtc

SEQ ID NO: 20259 - DNA, 15 bp, Homo sapiens
ggacatggcatttgt

SEQ ID NO: 20260 - DNA, 15 bp, Homo sapiens
tggacatggcatttg

SEQ ID NO: 20261 - DNA, 15 bp, Homo sapiens
gtggacatggcattt

SEQ ID NO: 20262 - DNA, 15 bp, Homo sapiens
agtggacatggcatt

SEQ ID NO: 20263 - DNA, 15 bp, Homo sapiens
cagtggacatggcat

SEQ ID NO: 20264 - DNA, 15 bp, Homo sapiens
acagtggacatggca

SEQ ID NO: 20265 - DNA, 15 bp, Homo sapiens
aacagtggacatggc

SEQ ID NO: 20266 - DNA, 15 bp, Homo sapiens
aaacagtggacatgg

SEQ ID NO: 20267 - DNA, 15 bp, Homo sapiens
aaaacagtggacatg

SEQ ID NO: 20268 - DNA, 15 bp, Homo sapiens
gaaaacagtggacat

SEQ ID NO: 20269 - DNA, 15 bp, Homo sapiens
agaaaacagtggaca

SEQ ID NO: 20270 - DNA, 15 bp, Homo sapiens
cagaaaacagtggac

SEQ ID NO: 20271 - DNA, 15 bp, Homo sapiens
acagaaaacagtgga

SEQ ID NO: 20272 - DNA, 15 bp, Homo sapiens
gacagaaaacagtgg

SEQ ID NO: 20273 - DNA, 15 bp, Homo sapiens
tgacagaaaacagtg

SEQ ID NO: 20274 - DNA, 15 bp, Homo sapiens
gtgacagaaaacagt

SEQ ID NO: 20275 - DNA, 15 bp, Homo sapiens
tgtgacagaaaacag

SEQ ID NO: 20276 - DNA, 15 bp, Homo sapiens
ctgtgacagaaaaca

SEQ ID NO: 20277 - DNA, 15 bp, Homo sapiens
actgtgacagaaaac

SEQ ID NO: 20278 - DNA, 15 bp, Homo sapiens
aactgtgacagaaaa

SEQ ID NO: 20279 - DNA, 15 bp, Homo sapiens
caactgtgacagaaa

SEQ ID NO: 20280 - DNA, 15 bp, Homo sapiens
tcaactgtgacagaa

SEQ ID NO: 20281 - DNA, 15 bp, Homo sapiens
atcaactgtgacaga

SEQ ID NO: 20282 - DNA, 15 bp, Homo sapiens
tatcaactgtgacag

SEQ ID NO: 20283 - DNA, 15 bp, Homo sapiens
ctatcaactgtgaca

SEQ ID NO: 20284 - DNA, 15 bp, Homo sapiens
gctatcaactgtgac

SEQ ID NO: 20285 - DNA, 15 bp, Homo sapiens
ggctatcaactgtga

SEQ ID NO: 20286 - DNA, 15 bp, Homo sapiens
tggctatcaactgtg

SEQ ID NO: 20287 - DNA, 15 bp, Homo sapiens
atggctatcaactgt

SEQ ID NO: 20288 - DNA, 15 bp, Homo sapiens
tatggctatcaactg

SEQ ID NO: 20289 - DNA, 15 bp, Homo sapiens
gtatggctatcaact

SEQ ID NO: 20290 - DNA, 15 bp, Homo sapiens
ggtatggctatcaac

SEQ ID NO: 20291 - DNA, 15 bp, Homo sapiens
tggtatggctatcaa

SEQ ID NO: 20292 - DNA, 15 bp, Homo sapiens
ctggtatggctatca

SEQ ID NO: 20293 - DNA, 15 bp, Homo sapiens
actggtatggctatc

SEQ ID NO: 20294 - DNA, 15 bp, Homo sapiens
gactggtatggctat

SEQ ID NO: 20295 - DNA, 15 bp, Homo sapiens
tgactggtatggcta

SEQ ID NO: 20296 - DNA, 15 bp, Homo sapiens
gtgactggtatggct

SEQ ID NO: 20297 - DNA, 15 bp, Homo sapiens
ggtgactggtatggc

SEQ ID NO: 20298 - DNA, 15 bp, Homo sapiens
gggtgactggtatgg

SEQ ID NO: 20299 - DNA, 15 bp, Homo sapiens
tgggtgactggtatg

SEQ ID NO: 20300 - DNA, 15 bp, Homo sapiens
ttgggtgactggtat

SEQ ID NO: 20301 - DNA, 15 bp, Homo sapiens
cttgggtgactggta

SEQ ID NO: 20302 - DNA, 15 bp, Homo sapiens
gcttgggtgactggt

SEQ ID NO: 20303 - DNA, 15 bp, Homo sapiens
agcttgggtgactgg

SEQ ID NO: 20304 - DNA, 15 bp, Homo sapiens
cagcttgggtgactg

SEQ ID NO: 20305 - DNA, 15 bp, Homo sapiens
ccagcttgggtgact

SEQ ID NO: 20306 - DNA, 15 bp, Homo sapiens
tccagcttgggtgac

SEQ ID NO: 20307 - DNA, 15 bp, Homo sapiens
ttccagcttgggtga

SEQ ID NO: 20308 - DNA, 15 bp, Homo sapiens
tttccagcttgggtg

SEQ ID NO: 20309 - DNA, 15 bp, Homo sapiens
gtttccagcttgggt

SEQ ID NO: 20310 - DNA, 15 bp, Homo sapiens
ggtttccagcttggg

SEQ ID NO: 20311 - DNA, 15 bp, Homo sapiens
gggtttccagcttgg

SEQ ID NO: 20312 - DNA, 15 bp, Homo sapiens
tgggtttccagcttg

SEQ ID NO: 20313 - DNA, 15 bp, Homo sapiens
ttgggtttccagctt

SEQ ID NO: 20314 - DNA, 15 bp, Homo sapiens
gttgggtttccagct

SEQ ID NO: 20315 - DNA, 15 bp, Homo sapiens
tgttgggtttccagc

SEQ ID NO: 20316 - DNA, 15 bp, Homo sapiens
ctgttgggtttccag

SEQ ID NO: 20317 - DNA, 15 bp, Homo sapiens
cctgttgggtttcca

SEQ ID NO: 20318 - DNA, 15 bp, Homo sapiens
gcctgttgggtttcc

SEQ ID NO: 20319 - DNA, 15 bp, Homo sapiens
ggcctgttgggtttc

SEQ ID NO: 20320 - DNA, 15 bp, Homo sapiens
gggcctgttgggttt

SEQ ID NO: 20321 - DNA, 15 bp, Homo sapiens
ggggcctgttgggtt

SEQ ID NO: 20322 - DNA, 15 bp, Homo sapiens
aggggcctgttgggt

SEQ ID NO: 20323 - DNA, 15 bp, Homo sapiens
caggggcctgttggg

SEQ ID NO: 20324 - DNA, 15 bp, Homo sapiens
gcaggggcctgttgg

SEQ ID NO: 20325 - DNA, 15 bp, Homo sapiens
ggcaggggcctgttg

SEQ ID NO: 20326 - DNA, 15 bp, Homo sapiens
gggcaggggcctgtt

SEQ ID NO: 20327 - DNA, 15 bp, Homo sapiens
agggcaggggcctgt

SEQ ID NO: 20328 - DNA, 15 bp, Homo sapiens
aagggcaggggcctg

SEQ ID NO: 20329 - DNA, 15 bp, Homo sapiens
gaagggcaggggcct

SEQ ID NO: 20330 - DNA, 15 bp, Homo sapiens
tgaagggcaggggcc

SEQ ID NO: 20331 - DNA, 15 bp, Homo sapiens
gtgaagggcaggggc

SEQ ID NO: 20332 - DNA, 15 bp, Homo sapiens
agtgaagggcagggg

SEQ ID NO: 20333 - DNA, 15 bp, Homo sapiens
cagtgaagggcaggg

SEQ ID NO: 20334 - DNA, 15 bp, Homo sapiens
gcagtgaagggcagg

SEQ ID NO: 20335 - DNA, 15 bp, Homo sapiens
ggcagtgaagggcag

SEQ ID NO: 20336 - DNA, 15 bp, Homo sapiens
gggcagtgaagggca

SEQ ID NO: 20337 - DNA, 15 bp, Homo sapiens
tgggcagtgaagggc

SEQ ID NO: 20338 - DNA, 15 bp, Homo sapiens
gtgggcagtgaaggg

SEQ ID NO: 20339 - DNA, 15 bp, Homo sapiens
tgtgggcagtgaagg

SEQ ID NO: 20340 - DNA, 15 bp, Homo sapiens
atgtgggcagtgaag

SEQ ID NO: 20341 - DNA, 15 bp, Homo sapiens
gatgtgggcagtgaa

SEQ ID NO: 20342 - DNA, 15 bp, Homo sapiens
ggatgtgggcagtga

SEQ ID NO: 20343 - DNA, 15 bp, Homo sapiens
tggatgtgggcagtg

SEQ ID NO: 20344 - DNA, 15 bp, Homo sapiens
ttggatgtgggcagt

SEQ ID NO: 20345 - DNA, 15 bp, Homo sapiens
cttggatgtgggcag

SEQ ID NO: 20346 - DNA, 15 bp, Homo sapiens
ccttggatgtgggca

SEQ ID NO: 20347 - DNA, 15 bp, Homo sapiens
cccttggatgtgggc

SEQ ID NO: 20348 - DNA, 15 bp, Homo sapiens
tcccttggatgtggg

SEQ ID NO: 20349 - DNA, 15 bp, Homo sapiens
ctcccttggatgtgg

SEQ ID NO: 20350 - DNA, 15 bp, Homo sapiens
gctcccttggatgtg

SEQ ID NO: 20351 - DNA, 15 bp, Homo sapiens
ggctcccttggatgt

SEQ ID NO: 20352 - DNA, 15 bp, Homo sapiens
tggctcccttggatg

SEQ ID NO: 20353 - DNA, 15 bp, Homo sapiens
gtggctcccttggat

SEQ ID NO: 20354 - DNA, 15 bp, Homo sapiens
ggtggctcccttgga

SEQ ID NO: 20355 - DNA, 15 bp, Homo sapiens
tggtggctcccttgg

SEQ ID NO: 20356 - DNA, 15 bp, Homo sapiens
ttggtggctcccttg

SEQ ID NO: 20357 - DNA, 15 bp, Homo sapiens
cttggtggctccctt

SEQ ID NO: 20358 - DNA, 15 bp, Homo sapiens
acttggtggctccct

SEQ ID NO: 20359 - DNA, 15 bp, Homo sapiens
gacttggtggctccc

SEQ ID NO: 20360 - DNA, 15 bp, Homo sapiens
ggacttggtggctcc

SEQ ID NO: 20361 - DNA, 15 bp, Homo sapiens
gggacttggtggctc

SEQ ID NO: 20362 - DNA, 15 bp, Homo sapiens
tgggacttggtggct

SEQ ID NO: 20363 - DNA, 15 bp, Homo sapiens
gtgggacttggtggc

SEQ ID NO: 20364 - DNA, 15 bp, Homo sapiens
tgtgggacttggtgg

SEQ ID NO: 20365 - DNA, 15 bp, Homo sapiens
ttgtgggacttggtg

SEQ ID NO: 20366 - DNA, 15 bp, Homo sapiens
tttgtgggacttggt

SEQ ID NO: 20367 - DNA, 15 bp, Homo sapiens
atttgtgggacttgg

SEQ ID NO: 20368 - DNA, 15 bp, Homo sapiens
aatttgtgggacttg

SEQ ID NO: 20369 - DNA, 15 bp, Homo sapiens
caatttgtgggactt

SEQ ID NO: 20370 - DNA, 15 bp, Homo sapiens
acaatttgtgggact

SEQ ID NO: 20371 - DNA, 15 bp, Homo sapiens
aacaatttgtgggac

SEQ ID NO: 20372 - DNA, 15 bp, Homo sapiens
gaacaatttgtggga

SEQ ID NO: 20373 - DNA, 15 bp, Homo sapiens
ggaacaatttgtggg

SEQ ID NO: 20374 - DNA, 15 bp, Homo sapiens
aggaacaatttgtgg

SEQ ID NO: 20375 - DNA, 15 bp, Homo sapiens
aaggaacaatttgtg

SEQ ID NO: 20376 - DNA, 15 bp, Homo sapiens
aaaggaacaatttgt

SEQ ID NO: 20377 - DNA, 15 bp, Homo sapiens
taaaggaacaatttg

SEQ ID NO: 20378 - DNA, 15 bp, Homo sapiens
ttaaaggaacaattt

SEQ ID NO: 20379 - DNA, 15 bp, Homo sapiens
gttaaaggaacaatt

SEQ ID NO: 20380 - DNA, 15 bp, Homo sapiens
agttaaaggaacaat

SEQ ID NO: 20381 - DNA, 15 bp, Homo sapiens
cagttaaaggaacaa

SEQ ID NO: 20382 - DNA, 15 bp, Homo sapiens
acagttaaaggaaca

SEQ ID NO: 20383 - DNA, 15 bp, Homo sapiens
aacagttaaaggaac

SEQ ID NO: 20384 - DNA, 15 bp, Homo sapiens
aaacagttaaaggaa

SEQ ID NO: 20385 - DNA, 15 bp, Homo sapiens
caaacagttaaagga

SEQ ID NO: 20386 - DNA, 15 bp, Homo sapiens
acaaacagttaaagg

SEQ ID NO: 20387 - DNA, 15 bp, Homo sapiens
gacaaacagttaaag

SEQ ID NO: 20388 - DNA, 15 bp, Homo sapiens
ggacaaacagttaaa

SEQ ID NO: 20389 - DNA, 15 bp, Homo sapiens
gggacaaacagttaa

SEQ ID NO: 20390 - DNA, 15 bp, Homo sapiens
agggacaaacagtta

SEQ ID NO: 20391 - DNA, 15 bp, Homo sapiens
gagggacaaacagtt

SEQ ID NO: 20392 - DNA, 15 bp, Homo sapiens
agagggacaaacagt

SEQ ID NO: 20393 - DNA, 15 bp, Homo sapiens
aagagggacaaacag

SEQ ID NO: 20394 - DNA, 15 bp, Homo sapiens
aaagagggacaaaca

SEQ ID NO: 20395 - DNA, 15 bp, Homo sapiens
aaaagagggacaaac

SEQ ID NO: 20396 - DNA, 15 bp, Homo sapiens
caaaagagggacaaa

SEQ ID NO: 20397 - DNA, 15 bp, Homo sapiens
acaaaagagggacaa

SEQ ID NO: 20398 - DNA, 15 bp, Homo sapiens
gacaaaagagggaca

SEQ ID NO: 20399 - DNA, 15 bp, Homo sapiens
agacaaaagagggac

SEQ ID NO: 20400 - DNA, 15 bp, Homo sapiens
aagacaaaagaggga

SEQ ID NO: 20401 - DNA, 15 bp, Homo sapiens
gaagacaaaagaggg

SEQ ID NO: 20402 - DNA, 15 bp, Homo sapiens
agaagacaaaagagg

SEQ ID NO: 20403 - DNA, 15 bp, Homo sapiens
cagaagacaaaagag

SEQ ID NO: 20404 - DNA, 15 bp, Homo sapiens
acagaagacaaaaga

SEQ ID NO: 20405 - DNA, 15 bp, Homo sapiens
gacagaagacaaaag

SEQ ID NO: 20406 - DNA, 15 bp, Homo sapiens
tgacagaagacaaaa

SEQ ID NO: 20407 - DNA, 15 bp, Homo sapiens
atgacagaagacaaa

SEQ ID NO: 20408 - DNA, 15 bp, Homo sapiens
gatgacagaagacaa

SEQ ID NO: 20409 - DNA, 15 bp, Homo sapiens
ggatgacagaagaca

SEQ ID NO: 20410 - DNA, 15 bp, Homo sapiens
gggatgacagaagac

SEQ ID NO: 20411 - DNA, 15 bp, Homo sapiens
agggatgacagaaga

SEQ ID NO: 20412 - DNA, 15 bp, Homo sapiens
aagggatgacagaag

SEQ ID NO: 20413 - DNA, 15 bp, Homo sapiens
gaagggatgacagaa

SEQ ID NO: 20414 - DNA, 15 bp, Homo sapiens
agaagggatgacaga

SEQ ID NO: 20415 - DNA, 15 bp, Homo sapiens
tagaagggatgacag

SEQ ID NO: 20416 - DNA, 15 bp, Homo sapiens
gtagaagggatgaca

SEQ ID NO: 20417 - DNA, 15 bp, Homo sapiens
ggtagaagggatgac

SEQ ID NO: 20418 - DNA, 15 bp, Homo sapiens
cggtagaagggatga

SEQ ID NO: 20419 - DNA, 15 bp, Homo sapiens
gcggtagaagggatg

SEQ ID NO: 20420 - DNA, 15 bp, Homo sapiens
agcggtagaagggat

SEQ ID NO: 20421 - DNA, 15 bp, Homo sapiens
cagcggtagaaggga

SEQ ID NO: 20422 - DNA, 15 bp, Homo sapiens
acagcggtagaaggg

SEQ ID NO: 20423 - DNA, 15 bp, Homo sapiens
gacagcggtagaagg

SEQ ID NO: 20424 - DNA, 15 bp, Homo sapiens
ggacagcggtagaag

SEQ ID NO: 20425 - DNA, 15 bp, Homo sapiens
aggacagcggtagaa

SEQ ID NO: 20426 - DNA, 15 bp, Homo sapiens
caggacagcggtaga

SEQ ID NO: 20427 - DNA, 15 bp, Homo sapiens
ccaggacagcggtag

SEQ ID NO: 20428 - DNA, 15 bp, Homo sapiens
accaggacagcggta

SEQ ID NO: 20429 - DNA, 15 bp, Homo sapiens
aaccaggacagcggt

SEQ ID NO: 20430 - DNA, 15 bp, Homo sapiens
gaaccaggacagcgg

SEQ ID NO: 20431 - DNA, 15 bp, Homo sapiens
tgaaccaggacagcg

SEQ ID NO: 20432 - DNA, 15 bp, Homo sapiens
ttgaaccaggacagc

SEQ ID NO: 20433 - DNA, 15 bp, Homo sapiens
attgaaccaggacag

SEQ ID NO: 20434 - DNA, 15 bp, Homo sapiens
gattgaaccaggaca

SEQ ID NO: 20435 - DNA, 15 bp, Homo sapiens
ggattgaaccaggac

SEQ ID NO: 20436 - DNA, 15 bp, Homo sapiens
gggattgaaccagga

SEQ ID NO: 20437 - DNA, 15 bp, Homo sapiens
agggattgaaccagg

SEQ ID NO: 20438 - DNA, 15 bp, Homo sapiens
gagggattgaaccag

SEQ ID NO: 20439 - DNA, 15 bp, Homo sapiens
tgagggattgaacca

SEQ ID NO: 20440 - DNA, 15 bp, Homo sapiens
atgagggattgaacc

SEQ ID NO: 20441 - DNA, 15 bp, Homo sapiens
gatgagggattgaac

SEQ ID NO: 20442 - DNA, 15 bp, Homo sapiens
agatgagggattgaa

SEQ ID NO: 20443 - DNA, 15 bp, Homo sapiens
aagatgagggattga

SEQ ID NO: 20444 - DNA, 15 bp, Homo sapiens
caagatgagggattg

SEQ ID NO: 20445 - DNA, 15 bp, Homo sapiens
gcaagatgagggatt

SEQ ID NO: 20446 - DNA, 15 bp, Homo sapiens
agcaagatgagggat

SEQ ID NO: 20447 - DNA, 15 bp, Homo sapiens
gagcaagatgaggga

SEQ ID NO: 20448 - DNA, 15 bp, Homo sapiens
agagcaagatgaggg

SEQ ID NO: 20449 - DNA, 15 bp, Homo sapiens
cagagcaagatgagg

SEQ ID NO: 20450 - DNA, 15 bp, Homo sapiens
ccagagcaagatgag

SEQ ID NO: 20451 - DNA, 15 bp, Homo sapiens
cccagagcaagatga

SEQ ID NO: 20452 - DNA, 15 bp, Homo sapiens
tcccagagcaagatg

SEQ ID NO: 20453 - DNA, 15 bp, Homo sapiens
gtcccagagcaagat

SEQ ID NO: 20454 - DNA, 15 bp, Homo sapiens
agtcccagagcaaga

SEQ ID NO: 20455 - DNA, 15 bp, Homo sapiens
gagtcccagagcaag

SEQ ID NO: 20456 - DNA, 15 bp, Homo sapiens
ggagtcccagagcaa

SEQ ID NO: 20457 - DNA, 15 bp, Homo sapiens
gggagtcccagagca

SEQ ID NO: 20458 - DNA, 15 bp, Homo sapiens
tgggagtcccagagc

SEQ ID NO: 20459 - DNA, 15 bp, Homo sapiens
atgggagtcccagag

SEQ ID NO: 20460 - DNA, 15 bp, Homo sapiens
catgggagtcccaga

SEQ ID NO: 20461 - DNA, 15 bp, Homo sapiens
tcatgggagtcccag

SEQ ID NO: 20462 - DNA, 15 bp, Homo sapiens
atcatgggagtccca

SEQ ID NO: 20463 - DNA, 15 bp, Homo sapiens
tatcatgggagtccc

SEQ ID NO: 20464 - DNA, 15 bp, Homo sapiens
ttatcatgggagtcc

SEQ ID NO: 20465 - DNA, 15 bp, Homo sapiens
gttatcatgggagtc

SEQ ID NO: 20466 - DNA, 15 bp, Homo sapiens
agttatcatgggagt

SEQ ID NO: 20467 - DNA, 15 bp, Homo sapiens
aagttatcatgggag

SEQ ID NO: 20468 - DNA, 15 bp, Homo sapiens
taagttatcatggga

SEQ ID NO: 20469 - DNA, 15 bp, Homo sapiens
ataagttatcatggg

SEQ ID NO: 20470 - DNA, 15 bp, Homo sapiens
cataagttatcatgg

SEQ ID NO: 20471 - DNA, 15 bp, Homo sapiens
tcataagttatcatg

SEQ ID NO: 20472 - DNA, 15 bp, Homo sapiens
atcataagttatcat

SEQ ID NO: 20473 - DNA, 15 bp, Homo sapiens
gatcataagttatca

SEQ ID NO: 20474 - DNA, 15 bp, Homo sapiens
agatcataagttatc

SEQ ID NO: 20475 - DNA, 15 bp, Homo sapiens
aagatcataagttat

SEQ ID NO: 20476 - DNA, 15 bp, Homo sapiens
aaagatcataagtta

SEQ ID NO: 20477 - DNA, 15 bp, Homo sapiens
gaaagatcataagtt

SEQ ID NO: 20478 - DNA, 15 bp, Homo sapiens
ggaaagatcataagt

SEQ ID NO: 20479 - DNA, 15 bp, Homo sapiens
aggaaagatcataag

SEQ ID NO: 20480 - DNA, 15 bp, Homo sapiens
gaggaaagatcataa

SEQ ID NO: 20481 - DNA, 15 bp, Homo sapiens
ggaggaaagatcata

SEQ ID NO: 20482 - DNA, 15 bp, Homo sapiens
tggaggaaagatcat

SEQ ID NO: 20483 - DNA, 15 bp, Homo sapiens
gtggaggaaagatca

SEQ ID NO: 20484 - DNA, 15 bp, Homo sapiens
ggtggaggaaagatc

SEQ ID NO: 20485 - DNA, 15 bp, Homo sapiens
aggtggaggaaagat

SEQ ID NO: 20486 - DNA, 15 bp, Homo sapiens
gaggtggaggaaaga

SEQ ID NO: 20487 - DNA, 15 bp, Homo sapiens
agaggtggaggaaag

SEQ ID NO: 20488 - DNA, 15 bp, Homo sapiens
gagaggtggaggaaa

SEQ ID NO: 20489 - DNA, 15 bp, Homo sapiens
agagaggtggaggaa

SEQ ID NO: 20490 - DNA, 15 bp, Homo sapiens
tagagaggtggagga

SEQ ID NO: 20491 - DNA, 15 bp, Homo sapiens
atagagaggtggagg

SEQ ID NO: 20492 - DNA, 15 bp, Homo sapiens
gatagagaggtggag

SEQ ID NO: 20493 - DNA, 15 bp, Homo sapiens
agatagagaggtgga

SEQ ID NO: 20494 - DNA, 15 bp, Homo sapiens
aagatagagaggtgg

SEQ ID NO: 20495 - DNA, 15 bp, Homo sapiens
gaagatagagaggtg

SEQ ID NO: 20496 - DNA, 15 bp, Homo sapiens
ggaagatagagaggt

SEQ ID NO: 20497 - DNA, 15 bp, Homo sapiens
tggaagatagagagg

SEQ ID NO: 20498 - DNA, 15 bp, Homo sapiens
gtggaagatagagag

SEQ ID NO: 20499 - DNA, 15 bp, Homo sapiens
tgtggaagatagaga

SEQ ID NO: 20500 - DNA, 15 bp, Homo sapiens
gtgtggaagatagag

SEQ ID NO: 20501 - DNA, 15 bp, Homo sapiens
tgtgtggaagataga

SEQ ID NO: 20502 - DNA, 15 bp, Homo sapiens
ttgtgtggaagatag

SEQ ID NO: 20503 - DNA, 15 bp, Homo sapiens
attgtgtggaagata

SEQ ID NO: 20504 - DNA, 15 bp, Homo sapiens
gattgtgtggaagat

SEQ ID NO: 20505 - DNA, 15 bp, Homo sapiens
ggattgtgtggaaga

SEQ ID NO: 20506 - DNA, 15 bp, Homo sapiens
gggattgtgtggaag

SEQ ID NO: 20507 - DNA, 15 bp, Homo sapiens
agggattgtgtggaa

SEQ ID NO: 20508 - DNA, 15 bp, Homo sapiens
tagggattgtgtgga

SEQ ID NO: 20509 - DNA, 15 bp, Homo sapiens
atagggattgtgtgg

SEQ ID NO: 20510 - DNA, 15 bp, Homo sapiens
gatagggattgtgtg

SEQ ID NO: 20511 - DNA, 15 bp, Homo sapiens
tgatagggattgtgt

SEQ ID NO: 20512 - DNA, 15 bp, Homo sapiens
atgatagggattgtg

SEQ ID NO: 20513 - DNA, 15 bp, Homo sapiens
gatgatagggattgt

SEQ ID NO: 20514 - DNA, 15 bp, Homo sapiens
tgatgatagggattg

SEQ ID NO: 20515 - DNA, 15 bp, Homo sapiens
ttgatgatagggatt

SEQ ID NO: 20516 - DNA, 15 bp, Homo sapiens
attgatgatagggat

SEQ ID NO: 20517 - DNA, 15 bp, Homo sapiens
gattgatgataggga

SEQ ID NO: 20518 - DNA, 15 bp, Homo sapiens
agattgatgataggg

SEQ ID NO: 20519 - DNA, 15 bp, Homo sapiens
gagattgatgatagg

SEQ ID NO: 20520 - DNA, 15 bp, Homo sapiens
tgagattgatgatag

SEQ ID NO: 20521 - DNA, 15 bp, Homo sapiens
atgagattgatgata

SEQ ID NO: 20522 - DNA, 15 bp, Homo sapiens
aatgagattgatgat

SEQ ID NO: 20523 - DNA, 15 bp, Homo sapiens
gaatgagattgatga

SEQ ID NO: 20524 - DNA, 15 bp, Homo sapiens
ggaatgagattgatg

SEQ ID NO: 20525 - DNA, 15 bp, Homo sapiens
gggaatgagattgat

SEQ ID NO: 20526 - DNA, 15 bp, Homo sapiens
ggggaatgagattga

SEQ ID NO: 20527 - DNA, 15 bp, Homo sapiens
aggggaatgagattg

SEQ ID NO: 20528 - DNA, 15 bp, Homo sapiens
caggggaatgagatt

SEQ ID NO: 20529 - DNA, 15 bp, Homo sapiens
gcaggggaatgagat

SEQ ID NO: 20530 - DNA, 15 bp, Homo sapiens
agcaggggaatgaga

SEQ ID NO: 20531 - DNA, 15 bp, Homo sapiens
aagcaggggaatgag

SEQ ID NO: 20532 - DNA, 15 bp, Homo sapiens
aaagcaggggaatga

SEQ ID NO: 20533 - DNA, 15 bp, Homo sapiens
taaagcaggggaatg

SEQ ID NO: 20534 - DNA, 15 bp, Homo sapiens
ttaaagcaggggaat

SEQ ID NO: 20535 - DNA, 15 bp, Homo sapiens
tttaaagcaggggaa

SEQ ID NO: 20536 - DNA, 15 bp, Homo sapiens
gtttaaagcagggga

SEQ ID NO: 20537 - DNA, 15 bp, Homo sapiens
ggtttaaagcagggg

SEQ ID NO: 20538 - DNA, 15 bp, Homo sapiens
gggtttaaagcaggg

SEQ ID NO: 20539 - DNA, 15 bp, Homo sapiens
tgggtttaaagcagg

SEQ ID NO: 20540 - DNA, 15 bp, Homo sapiens
ttgggtttaaagcag

SEQ ID NO: 20541 - DNA, 15 bp, Homo sapiens
cttgggtttaaagca

SEQ ID NO: 20542 - DNA, 15 bp, Homo sapiens
tcttgggtttaaagc

SEQ ID NO: 20543 - DNA, 15 bp, Homo sapiens
ctcttgggtttaaag

SEQ ID NO: 20544 - DNA, 15 bp, Homo sapiens
actcttgggtttaaa

SEQ ID NO: 20545 - DNA, 15 bp, Homo sapiens
cactcttgggtttaa

SEQ ID NO: 20546 - DNA, 15 bp, Homo sapiens
ccactcttgggttta

SEQ ID NO: 20547 - DNA, 15 bp, Homo sapiens
gccactcttgggttt

SEQ ID NO: 20548 - DNA, 15 bp, Homo sapiens
tgccactcttgggtt

SEQ ID NO: 20549 - DNA, 15 bp, Homo sapiens
gtgccactcttgggt

SEQ ID NO: 20550 - DNA, 15 bp, Homo sapiens
ggtgccactcttggg

SEQ ID NO: 20551 - DNA, 15 bp, Homo sapiens
gggtgccactcttgg

SEQ ID NO: 20552 - DNA, 15 bp, Homo sapiens
agggtgccactcttg

SEQ ID NO: 20553 - DNA, 15 bp, Homo sapiens
cagggtgccactctt

SEQ ID NO: 20554 - DNA, 15 bp, Homo sapiens
acagggtgccactct

SEQ ID NO: 20555 - DNA, 15 bp, Homo sapiens
cacagggtgccactc

SEQ ID NO: 20556 - DNA, 15 bp, Homo sapiens
acacagggtgccact

SEQ ID NO: 20557 - DNA, 15 bp, Homo sapiens
aacacagggtgccac

SEQ ID NO: 20558 - DNA, 15 bp, Homo sapiens
aaacacagggtgcca

SEQ ID NO: 20559 - DNA, 15 bp, Homo sapiens
caaacacagggtgcc

SEQ ID NO: 20560 - DNA, 15 bp, Homo sapiens
tcaaacacagggtgc

SEQ ID NO: 20561 - DNA, 15 bp, Homo sapiens
ctcaaacacagggtg

SEQ ID NO: 20562 - DNA, 15 bp, Homo sapiens
actcaaacacagggt

SEQ ID NO: 20563 - DNA, 15 bp, Homo sapiens
cactcaaacacaggg

SEQ ID NO: 20564 - DNA, 15 bp, Homo sapiens
tcactcaaacacagg

SEQ ID NO: 20565 - DNA, 15 bp, Homo sapiens
gtcactcaaacacag

SEQ ID NO: 20566 - DNA, 15 bp, Homo sapiens
tgtcactcaaacaca

SEQ ID NO: 20567 - DNA, 15 bp, Homo sapiens
atgtcactcaaacac

SEQ ID NO: 20568 - DNA, 15 bp, Homo sapiens
gatgtcactcaaaca

SEQ ID NO: 20569 - DNA, 15 bp, Homo sapiens
tgatgtcactcaaac

SEQ ID NO: 20570 - DNA, 15 bp, Homo sapiens
ctgatgtcactcaaa

SEQ ID NO: 20571 - DNA, 15 bp, Homo sapiens
cctgatgtcactcaa

SEQ ID NO: 20572 - DNA, 15 bp, Homo sapiens
ccctgatgtcactca

SEQ ID NO: 20573 - DNA, 15 bp, Homo sapiens
gccctgatgtcactc

SEQ ID NO: 20574 - DNA, 15 bp, Homo sapiens
ggccctgatgtcact

SEQ ID NO: 20575 - DNA, 15 bp, Homo sapiens
gggccctgatgtcac

SEQ ID NO: 20576 - DNA, 15 bp, Homo sapiens
ggggccctgatgtca

SEQ ID NO: 20577 - DNA, 15 bp, Homo sapiens
aggggccctgatgtc

SEQ ID NO: 20578 - DNA, 15 bp, Homo sapiens
gaggggccctgatgt

SEQ ID NO: 20579 - DNA, 15 bp, Homo sapiens
tgaggggccctgatg

SEQ ID NO: 20580 - DNA, 15 bp, Homo sapiens
atgaggggccctgat

SEQ ID NO: 20581 - DNA, 15 bp, Homo sapiens
catgaggggccctga

SEQ ID NO: 20582 - DNA, 15 bp, Homo sapiens
acatgaggggccctg

SEQ ID NO: 20583 - DNA, 15 bp, Homo sapiens
cacatgaggggccct

SEQ ID NO: 20584 - DNA, 15 bp, Homo sapiens
ccacatgaggggccc

SEQ ID NO: 20585 - DNA, 15 bp, Homo sapiens
gccacatgaggggcc

SEQ ID NO: 20586 - DNA, 15 bp, Homo sapiens
agccacatgaggggc

SEQ ID NO: 20587 - DNA, 15 bp, Homo sapiens
gagccacatgagggg

SEQ ID NO: 20588 - DNA, 15 bp, Homo sapiens
ggagccacatgaggg

SEQ ID NO: 20589 - DNA, 15 bp, Homo sapiens
aggagccacatgagg

SEQ ID NO: 20590 - DNA, 15 bp, Homo sapiens
caggagccacatgag

SEQ ID NO: 20591 - DNA, 15 bp, Homo sapiens
gcaggagccacatga

SEQ ID NO: 20592 - DNA, 15 bp, Homo sapiens
agcaggagccacatg

SEQ ID NO: 20593 - DNA, 15 bp, Homo sapiens
aagcaggagccacat

SEQ ID NO: 20594 - DNA, 15 bp, Homo sapiens
gaagcaggagccaca

SEQ ID NO: 20595 - DNA, 15 bp, Homo sapiens
agaagcaggagccac

SEQ ID NO: 20596 - DNA, 15 bp, Homo sapiens
gagaagcaggagcca

SEQ ID NO: 20597 - DNA, 15 bp, Homo sapiens
agagaagcaggagcc

SEQ ID NO: 20598 - DNA, 15 bp, Homo sapiens
aagagaagcaggagc

SEQ ID NO: 20599 - DNA, 15 bp, Homo sapiens
aaagagaagcaggag

SEQ ID NO: 20600 - DNA, 15 bp, Homo sapiens
caaagagaagcagga

SEQ ID NO: 20601 - DNA, 15 bp, Homo sapiens
acaaagagaagcagg

SEQ ID NO: 20602 - DNA, 15 bp, Homo sapiens
cacaaagagaagcag

SEQ ID NO: 20603 - DNA, 15 bp, Homo sapiens
ccacaaagagaagca

SEQ ID NO: 20604 - DNA, 15 bp, Homo sapiens
gccacaaagagaagc

SEQ ID NO: 20605 - DNA, 15 bp, Homo sapiens
ggccacaaagagaag

SEQ ID NO: 20606 - DNA, 15 bp, Homo sapiens
gggccacaaagagaa

SEQ ID NO: 20607 - DNA, 15 bp, Homo sapiens
ggggccacaaagaga

SEQ ID NO: 20608 - DNA, 15 bp, Homo sapiens
aggggccacaaagag

SEQ ID NO: 20609 - DNA, 15 bp, Homo sapiens
aaggggccacaaaga

SEQ ID NO: 20610 - DNA, 15 bp, Homo sapiens
gaaggggccacaaag

SEQ ID NO: 20611 - DNA, 15 bp, Homo sapiens
agaaggggccacaaa

SEQ ID NO: 20612 - DNA, 15 bp, Homo sapiens
cagaaggggccacaa

SEQ ID NO: 20613 - DNA, 15 bp, Homo sapiens
acagaaggggccaca

SEQ ID NO: 20614 - DNA, 15 bp, Homo sapiens
aacagaaggggccac

SEQ ID NO: 20615 - DNA, 15 bp, Homo sapiens
caacagaaggggcca

SEQ ID NO: 20616 - DNA, 15 bp, Homo sapiens
gcaacagaaggggcc

SEQ ID NO: 20617 - DNA, 15 bp, Homo sapiens
agcaacagaaggggc

SEQ ID NO: 20618 - DNA, 15 bp, Homo sapiens
cagcaacagaagggg

SEQ ID NO: 20619 - DNA, 15 bp, Homo sapiens
gcagcaacagaaggg

SEQ ID NO: 20620 - DNA, 15 bp, Homo sapiens
agcagcaacagaagg

SEQ ID NO: 20621 - DNA, 15 bp, Homo sapiens
cagcagcaacagaag

SEQ ID NO: 20622 - DNA, 15 bp, Homo sapiens
gcagcagcaacagaa

SEQ ID NO: 20623 - DNA, 15 bp, Homo sapiens
agcagcagcaacaga

SEQ ID NO: 20624 - DNA, 15 bp, Homo sapiens
aagcagcagcaacag

SEQ ID NO: 20625 - DNA, 15 bp, Homo sapiens
aaagcagcagcaaca

SEQ ID NO: 20626 - DNA, 15 bp, Homo sapiens
aaaagcagcagcaac

SEQ ID NO: 20627 - DNA, 15 bp, Homo sapiens
gaaaagcagcagcaa

SEQ ID NO: 20628 - DNA, 15 bp, Homo sapiens
agaaaagcagcagca

SEQ ID NO: 20629 - DNA, 15 bp, Homo sapiens
aagaaaagcagcagc

SEQ ID NO: 20630 - DNA, 15 bp, Homo sapiens
taagaaaagcagcag

SEQ ID NO: 20631 - DNA, 15 bp, Homo sapiens
ataagaaaagcagca

SEQ ID NO: 20632 - DNA, 15 bp, Homo sapiens
cataagaaaagcagc

SEQ ID NO: 20633 - DNA, 15 bp, Homo sapiens
ccataagaaaagcag

SEQ ID NO: 20634 - DNA, 15 bp, Homo sapiens
tccataagaaaagca

SEQ ID NO: 20635 - DNA, 15 bp, Homo sapiens
gtccataagaaaagc

SEQ ID NO: 20636 - DNA, 15 bp, Homo sapiens
tgtccataagaaaag

SEQ ID NO: 20637 - DNA, 15 bp, Homo sapiens
atgtccataagaaaa

SEQ ID NO: 20638 - DNA, 15 bp, Homo sapiens
tatgtccataagaaa

SEQ ID NO: 20639 - DNA, 15 bp, Homo sapiens
ctatgtccataagaa

SEQ ID NO: 20640 - DNA, 15 bp, Homo sapiens
gctatgtccataaga

SEQ ID NO: 20641 - DNA, 15 bp, Homo sapiens
ggctatgtccataag

SEQ ID NO: 20642 - DNA, 15 bp, Homo sapiens
gggctatgtccataa

SEQ ID NO: 20643 - DNA, 15 bp, Homo sapiens
agggctatgtccata

SEQ ID NO: 20644 - DNA, 15 bp, Homo sapiens
gagggctatgtccat

SEQ ID NO: 20645 - DNA, 15 bp, Homo sapiens
tgagggctatgtcca

SEQ ID NO: 20646 - DNA, 15 bp, Homo sapiens
ctgagggctatgtcc

SEQ ID NO: 20647 - DNA, 15 bp, Homo sapiens
gctgagggctatgtc

SEQ ID NO: 20648 - DNA, 15 bp, Homo sapiens
tgctgagggctatgt

SEQ ID NO: 20649 - DNA, 15 bp, Homo sapiens
ctgctgagggctatg

SEQ ID NO: 20650 - DNA, 15 bp, Homo sapiens
actgctgagggctat

SEQ ID NO: 20651 - DNA, 15 bp, Homo sapiens
gactgctgagggcta

SEQ ID NO: 20652 - DNA, 15 bp, Homo sapiens
ggactgctgagggct

SEQ ID NO: 20653 - DNA, 15 bp, Homo sapiens
tggactgctgagggc

SEQ ID NO: 20654 - DNA, 15 bp, Homo sapiens
ctggactgctgaggg

SEQ ID NO: 20655 - DNA, 15 bp, Homo sapiens
cctggactgctgagg

SEQ ID NO: 20656 - DNA, 15 bp, Homo sapiens
tcctggactgctgag

SEQ ID NO: 20657 - DNA, 15 bp, Homo sapiens
gtcctggactgctga

SEQ ID NO: 20658 - DNA, 15 bp, Homo sapiens
agtcctggactgctg

SEQ ID NO: 20659 - DNA, 15 bp, Homo sapiens
cagtcctggactgct

SEQ ID NO: 20660 - DNA, 15 bp, Homo sapiens
gcagtcctggactgc

SEQ ID NO: 20661 - DNA, 15 bp, Homo sapiens
agcagtcctggactg

SEQ ID NO: 20662 - DNA, 15 bp, Homo sapiens
aagcagtcctggact

SEQ ID NO: 20663 - DNA, 15 bp, Homo sapiens
caagcagtcctggac

SEQ ID NO: 20664 - DNA, 15 bp, Homo sapiens
acaagcagtcctgga

SEQ ID NO: 20665 - DNA, 15 bp, Homo sapiens
tacaagcagtcctgg

SEQ ID NO: 20666 - DNA, 15 bp, Homo sapiens
ctacaagcagtcctg

SEQ ID NO: 20667 - DNA, 15 bp, Homo sapiens
actacaagcagtcct

SEQ ID NO: 20668 - DNA, 15 bp, Homo sapiens
aactacaagcagtcc

SEQ ID NO: 20669 - DNA, 15 bp, Homo sapiens
gaactacaagcagtc

SEQ ID NO: 20670 - DNA, 15 bp, Homo sapiens
ggaactacaagcagt

SEQ ID NO: 20671 - DNA, 15 bp, Homo sapiens
aggaactacaagcag

SEQ ID NO: 20672 - DNA, 15 bp, Homo sapiens
gaggaactacaagca

SEQ ID NO: 20673 - DNA, 15 bp, Homo sapiens
ggaggaactacaagc

SEQ ID NO: 20674 - DNA, 15 bp, Homo sapiens
gggaggaactacaag

SEQ ID NO: 20675 - DNA, 15 bp, Homo sapiens
tgggaggaactacaa

SEQ ID NO: 20676 - DNA, 15 bp, Homo sapiens
ctgggaggaactaca

SEQ ID NO: 20677 - DNA, 15 bp, Homo sapiens
cctgggaggaactac

SEQ ID NO: 20678 - DNA, 15 bp, Homo sapiens
acctgggaggaacta

SEQ ID NO: 20679 - DNA, 15 bp, Homo sapiens
tacctgggaggaact

SEQ ID NO: 20680 - DNA, 15 bp, Homo sapiens
gtacctgggaggaac

SEQ ID NO: 20681 - DNA, 15 bp, Homo sapiens
ggtacctgggaggaa

SEQ ID NO: 20682 - DNA, 15 bp, Homo sapiens
tggtacctgggagga

SEQ ID NO: 20683 - DNA, 15 bp, Homo sapiens
atggtacctgggagg

SEQ ID NO: 20684 - DNA, 15 bp, Homo sapiens
catggtacctgggag

SEQ ID NO: 20685 - DNA, 15 bp, Homo sapiens
acatggtacctggga

SEQ ID NO: 20686 - DNA, 15 bp, Homo sapiens
aacatggtacctggg

SEQ ID NO: 20687 - DNA, 15 bp, Homo sapiens
aaacatggtacctgg

SEQ ID NO: 20688 - DNA, 15 bp, Homo sapiens
gaaacatggtacctg

SEQ ID NO: 20689 - DNA, 15 bp, Homo sapiens
agaaacatggtacct

SEQ ID NO: 20690 - DNA, 15 bp, Homo sapiens
aagaaacatggtacc

SEQ ID NO: 20691 - DNA, 15 bp, Homo sapiens
caagaaacatggtac

SEQ ID NO: 20692 - DNA, 15 bp, Homo sapiens
gcaagaaacatggta

SEQ ID NO: 20693 - DNA, 15 bp, Homo sapiens
tgcaagaaacatggt

SEQ ID NO: 20694 - DNA, 15 bp, Homo sapiens
gtgcaagaaacatgg

SEQ ID NO: 20695 - DNA, 15 bp, Homo sapiens
agtgcaagaaacatg

SEQ ID NO: 20696 - DNA, 15 bp, Homo sapiens
gagtgcaagaaacat

SEQ ID NO: 20697 - DNA, 15 bp, Homo sapiens
ggagtgcaagaaaca

SEQ ID NO: 20698 - DNA, 15 bp, Homo sapiens
aggagtgcaagaaac

SEQ ID NO: 20699 - DNA, 15 bp, Homo sapiens
caggagtgcaagaaa

SEQ ID NO: 20700 - DNA, 15 bp, Homo sapiens
ccaggagtgcaagaa

SEQ ID NO: 20701 - DNA, 15 bp, Homo sapiens
gccaggagtgcaaga

SEQ ID NO: 20702 - DNA, 15 bp, Homo sapiens
ggccaggagtgcaag

SEQ ID NO: 20703 - DNA, 15 bp, Homo sapiens
aggccaggagtgcaa

SEQ ID NO: 20704 - DNA, 15 bp, Homo sapiens
aaggccaggagtgca

SEQ ID NO: 20705 - DNA, 15 bp, Homo sapiens
aaaggccaggagtgc

SEQ ID NO: 20706 - DNA, 15 bp, Homo sapiens
caaaggccaggagtg

SEQ ID NO: 20707 - DNA, 15 bp, Homo sapiens
acaaaggccaggagt

SEQ ID NO: 20708 - DNA, 15 bp, Homo sapiens
gacaaaggccaggag

SEQ ID NO: 20709 - DNA, 15 bp, Homo sapiens
tgacaaaggccagga

SEQ ID NO: 20710 - DNA, 15 bp, Homo sapiens
atgacaaaggccagg

SEQ ID NO: 20711 - DNA, 15 bp, Homo sapiens
aatgacaaaggccag

SEQ ID NO: 20712 - DNA, 15 bp, Homo sapiens
caatgacaaaggcca

SEQ ID NO: 20713 - DNA, 15 bp, Homo sapiens
ccaatgacaaaggcc

SEQ ID NO: 20714 - DNA, 15 bp, Homo sapiens
gccaatgacaaaggc

SEQ ID NO: 20715 - DNA, 15 bp, Homo sapiens
agccaatgacaaagg

SEQ ID NO: 20716 - DNA, 15 bp, Homo sapiens
gagccaatgacaaag

SEQ ID NO: 20717 - DNA, 15 bp, Homo sapiens
ggagccaatgacaaa

SEQ ID NO: 20718 - DNA, 15 bp, Homo sapiens
gggagccaatgacaa

SEQ ID NO: 20719 - DNA, 15 bp, Homo sapiens
ggggagccaatgaca

SEQ ID NO: 20720 - DNA, 15 bp, Homo sapiens
aggggagccaatgac

SEQ ID NO: 20721 - DNA, 15 bp, Homo sapiens
caggggagccaatga

SEQ ID NO: 20722 - DNA, 15 bp, Homo sapiens
gcaggggagccaatg

SEQ ID NO: 20723 - DNA, 15 bp, Homo sapiens
ggcaggggagccaat

SEQ ID NO: 20724 - DNA, 15 bp, Homo sapiens
gggcaggggagccaa

SEQ ID NO: 20725 - DNA, 15 bp, Homo sapiens
tgggcaggggagcca

SEQ ID NO: 20726 - DNA, 15 bp, Homo sapiens
ttgggcaggggagcc

SEQ ID NO: 20727 - DNA, 15 bp, Homo sapiens
cttgggcaggggagc

SEQ ID NO: 20728 - DNA, 15 bp, Homo sapiens
acttgggcaggggag

SEQ ID NO: 20729 - DNA, 15 bp, Homo sapiens
gacttgggcagggga

SEQ ID NO: 20730 - DNA, 15 bp, Homo sapiens
ggacttgggcagggg

SEQ ID NO: 20731 - DNA, 15 bp, Homo sapiens
gggacttgggcaggg

SEQ ID NO: 20732 - DNA, 15 bp, Homo sapiens
ggggacttgggcagg

SEQ ID NO: 20733 - DNA, 15 bp, Homo sapiens
aggggacttgggcag

SEQ ID NO: 20734 - DNA, 15 bp, Homo sapiens
aaggggacttgggca

SEQ ID NO: 20735 - DNA, 15 bp, Homo sapiens
gaaggggacttgggc

SEQ ID NO: 20736 - DNA, 15 bp, Homo sapiens
agaaggggacttggg

SEQ ID NO: 20737 - DNA, 15 bp, Homo sapiens
gagaaggggacttgg

SEQ ID NO: 20738 - DNA, 15 bp, Homo sapiens
agagaaggggacttg

SEQ ID NO: 20739 - DNA, 15 bp, Homo sapiens
aagagaaggggactt

SEQ ID NO: 20740 - DNA, 15 bp, Homo sapiens
gaagagaaggggact

SEQ ID NO: 20741 - DNA, 15 bp, Homo sapiens
agaagagaaggggac

SEQ ID NO: 20742 - DNA, 15 bp, Homo sapiens
gagaagagaagggga

SEQ ID NO: 20743 - DNA, 15 bp, Homo sapiens
ggagaagagaagggg

SEQ ID NO: 20744 - DNA, 15 bp, Homo sapiens
aggagaagagaaggg

SEQ ID NO: 20745 - DNA, 15 bp, Homo sapiens
aaggagaagagaagg

SEQ ID NO: 20746 - DNA, 15 bp, Homo sapiens
aaaggagaagagaag

SEQ ID NO: 20747 - DNA, 15 bp, Homo sapiens
gaaaggagaagagaa

SEQ ID NO: 20748 - DNA, 15 bp, Homo sapiens
ggaaaggagaagaga

SEQ ID NO: 20749 - DNA, 15 bp, Homo sapiens
aggaaaggagaagag

SEQ ID NO: 20750 - DNA, 15 bp, Homo sapiens
aaggaaaggagaaga

SEQ ID NO: 20751 - DNA, 15 bp, Homo sapiens
gaaggaaaggagaag

SEQ ID NO: 20752 - DNA, 15 bp, Homo sapiens
ggaaggaaaggagaa

SEQ ID NO: 20753 - DNA, 15 bp, Homo sapiens
gggaaggaaaggaga

SEQ ID NO: 20754 - DNA, 15 bp, Homo sapiens
ggggaaggaaaggag

SEQ ID NO: 20755 - DNA, 15 bp, Homo sapiens
aggggaaggaaagga

SEQ ID NO: 20756 - DNA, 15 bp, Homo sapiens
caggggaaggaaagg

SEQ ID NO: 20757 - DNA, 15 bp, Homo sapiens
acaggggaaggaaag

SEQ ID NO: 20758 - DNA, 15 bp, Homo sapiens
cacaggggaaggaaa

SEQ ID NO: 20759 - DNA, 15 bp, Homo sapiens
ccacaggggaaggaa

SEQ ID NO: 20760 - DNA, 15 bp, Homo sapiens
gccacaggggaagga

SEQ ID NO: 20761 - DNA, 15 bp, Homo sapiens
ggccacaggggaagg

SEQ ID NO: 20762 - DNA, 15 bp, Homo sapiens
aggccacaggggaag

SEQ ID NO: 20763 - DNA, 15 bp, Homo sapiens
aaggccacaggggaa

SEQ ID NO: 20764 - DNA, 15 bp, Homo sapiens
caaggccacagggga

SEQ ID NO: 20765 - DNA, 15 bp, Homo sapiens
gcaaggccacagggg

SEQ ID NO: 20766 - DNA, 15 bp, Homo sapiens
ggcaaggccacaggg

SEQ ID NO: 20767 - DNA, 15 bp, Homo sapiens
aggcaaggccacagg

SEQ ID NO: 20768 - DNA, 15 bp, Homo sapiens
aaggcaaggccacag

SEQ ID NO: 20769 - DNA, 15 bp, Homo sapiens
caaggcaaggccaca

SEQ ID NO: 20770 - DNA, 15 bp, Homo sapiens
acaaggcaaggccac

SEQ ID NO: 20771 - DNA, 15 bp, Homo sapiens
gacaaggcaaggcca

SEQ ID NO: 20772 - DNA, 15 bp, Homo sapiens
cgacaaggcaaggcc

SEQ ID NO: 20773 - DNA, 15 bp, Homo sapiens
acgacaaggcaaggc

SEQ ID NO: 20774 - DNA, 15 bp, Homo sapiens
cacgacaaggcaagg

SEQ ID NO: 20775 - DNA, 15 bp, Homo sapiens
gcacgacaaggcaag

SEQ ID NO: 20776 - DNA, 15 bp, Homo sapiens
agcacgacaaggcaa

SEQ ID NO: 20777 - DNA, 15 bp, Homo sapiens
aagcacgacaaggca

SEQ ID NO: 20778 - DNA, 15 bp, Homo sapiens
taagcacgacaaggc

SEQ ID NO: 20779 - DNA, 15 bp, Homo sapiens
ataagcacgacaagg

SEQ ID NO: 20780 - DNA, 15 bp, Homo sapiens
gataagcacgacaag

SEQ ID NO: 20781 - DNA, 15 bp, Homo sapiens
ggataagcacgacaa

SEQ ID NO: 20782 - DNA, 15 bp, Homo sapiens
aggataagcacgaca

SEQ ID NO: 20783 - DNA, 15 bp, Homo sapiens
aaggataagcacgac

SEQ ID NO: 20784 - DNA, 15 bp, Homo sapiens
caaggataagcacga

SEQ ID NO: 20785 - DNA, 15 bp, Homo sapiens
tcaaggataagcacg

SEQ ID NO: 20786 - DNA, 15 bp, Homo sapiens
ttcaaggataagcac

SEQ ID NO: 20787 - DNA, 15 bp, Homo sapiens
cttcaaggataagca

SEQ ID NO: 20788 - DNA, 15 bp, Homo sapiens
tcttcaaggataagc

SEQ ID NO: 20789 - DNA, 15 bp, Homo sapiens
gtcttcaaggataag

SEQ ID NO: 20790 - DNA, 15 bp, Homo sapiens
ggtcttcaaggataa

SEQ ID NO: 20791 - DNA, 15 bp, Homo sapiens
gggtcttcaaggata

SEQ ID NO: 20792 - DNA, 15 bp, Homo sapiens
agggtcttcaaggat

SEQ ID NO: 20793 - DNA, 15 bp, Homo sapiens
cagggtcttcaagga

SEQ ID NO: 20794 - DNA, 15 bp, Homo sapiens
acagggtcttcaagg

SEQ ID NO: 20795 - DNA, 15 bp, Homo sapiens
gacagggtcttcaag

SEQ ID NO: 20796 - DNA, 15 bp, Homo sapiens
tgacagggtcttcaa

SEQ ID NO: 20797 - DNA, 15 bp, Homo sapiens
ctgacagggtcttca

SEQ ID NO: 20798 - DNA, 15 bp, Homo sapiens
cctgacagggtcttc

SEQ ID NO: 20799 - DNA, 15 bp, Homo sapiens
acctgacagggtctt

SEQ ID NO: 20800 - DNA, 15 bp, Homo sapiens
tacctgacagggtct

SEQ ID NO: 20801 - DNA, 15 bp, Homo sapiens
atacctgacagggtc

SEQ ID NO: 20802 - DNA, 15 bp, Homo sapiens
gatacctgacagggt

SEQ ID NO: 20803 - DNA, 15 bp, Homo sapiens
agatacctgacaggg

SEQ ID NO: 20804 - DNA, 15 bp, Homo sapiens
gagatacctgacagg

SEQ ID NO: 20805 - DNA, 15 bp, Homo sapiens
agagatacctgacag

SEQ ID NO: 20806 - DNA, 15 bp, Homo sapiens
aagagatacctgaca

SEQ ID NO: 20807 - DNA, 15 bp, Homo sapiens
gaagagatacctgac

SEQ ID NO: 20808 - DNA, 15 bp, Homo sapiens
ggaagagatacctga

SEQ ID NO: 20809 - DNA, 15 bp, Homo sapiens
gggaagagatacctg

SEQ ID NO: 20810 - DNA, 15 bp, Homo sapiens
ggggaagagatacct

SEQ ID NO: 20811 - DNA, 15 bp, Homo sapiens
tggggaagagatacc

SEQ ID NO: 20812 - DNA, 15 bp, Homo sapiens
ttggggaagagatac

SEQ ID NO: 20813 - DNA, 15 bp, Homo sapiens
tttggggaagagata

SEQ ID NO: 20814 - DNA, 15 bp, Homo sapiens
ctttggggaagagat

SEQ ID NO: 20815 - DNA, 15 bp, Homo sapiens
tctttggggaagaga

SEQ ID NO: 20816 - DNA, 15 bp, Homo sapiens
ctctttggggaagag

SEQ ID NO: 20817 - DNA, 15 bp, Homo sapiens
gctctttggggaaga

SEQ ID NO: 20818 - DNA, 15 bp, Homo sapiens
ggctctttggggaag

SEQ ID NO: 20819 - DNA, 15 bp, Homo sapiens
gggctctttggggaa

SEQ ID NO: 20820 - DNA, 15 bp, Homo sapiens
agggctctttgggga

SEQ ID NO: 20821 - DNA, 15 bp, Homo sapiens
cagggctctttgggg

SEQ ID NO: 20822 - DNA, 15 bp, Homo sapiens
gcagggctctttggg

SEQ ID NO: 20823 - DNA, 15 bp, Homo sapiens
ggcagggctctttgg

SEQ ID NO: 20824 - DNA, 15 bp, Homo sapiens
aggcagggctctttg

SEQ ID NO: 20825 - DNA, 15 bp, Homo sapiens
taggcagggctcttt

SEQ ID NO: 20826 - DNA, 15 bp, Homo sapiens
ttaggcagggctctt

SEQ ID NO: 20827 - DNA, 15 bp, Homo sapiens
gttaggcagggctct

SEQ ID NO: 20828 - DNA, 15 bp, Homo sapiens
ggttaggcagggctc

SEQ ID NO: 20829 - DNA, 15 bp, Homo sapiens
tggttaggcagggct

SEQ ID NO: 20830 - DNA, 15 bp, Homo sapiens
gtggttaggcagggc

SEQ ID NO: 20831 - DNA, 15 bp, Homo sapiens
ggtggttaggcaggg

SEQ ID NO: 20832 - DNA, 15 bp, Homo sapiens
cggtggttaggcagg

SEQ ID NO: 20833 - DNA, 15 bp, Homo sapiens
gcggtggttaggcag

SEQ ID NO: 20834 - DNA, 15 bp, Homo sapiens
ggcggtggttaggca

SEQ ID NO: 20835 - DNA, 15 bp, Homo sapiens
gggcggtggttaggc

SEQ ID NO: 20836 - DNA, 15 bp, Homo sapiens
ggggcggtggttagg

SEQ ID NO: 20837 - DNA, 15 bp, Homo sapiens
gggggcggtggttag

SEQ ID NO: 20838 - DNA, 15 bp, Homo sapiens
ggggggcggtggtta

SEQ ID NO: 20839 - DNA, 15 bp, Homo sapiens
aggggggcggtggtt

SEQ ID NO: 20840 - DNA, 15 bp, Homo sapiens
gaggggggcggtggt

SEQ ID NO: 20841 - DNA, 15 bp, Homo sapiens
ggaggggggcggtgg

SEQ ID NO: 20842 - DNA, 15 bp, Homo sapiens
gggaggggggcggtg

SEQ ID NO: 20843 - DNA, 15 bp, Homo sapiens
ggggaggggggcggt

SEQ ID NO: 20844 - DNA, 15 bp, Homo sapiens
gggggaggggggcgg

SEQ ID NO: 20845 - DNA, 15 bp, Homo sapiens
ggggggaggggggcg

SEQ ID NO: 20846 - DNA, 15 bp, Homo sapiens
gggggggaggggggc

SEQ ID NO: 20847 - DNA, 15 bp, Homo sapiens
cgggggggagggggg

SEQ ID NO: 20848 - DNA, 15 bp, Homo sapiens
gcgggggggaggggg

SEQ ID NO: 20849 - DNA, 15 bp, Homo sapiens
cgcgggggggagggg

SEQ ID NO: 20850 - DNA, 15 bp, Homo sapiens
tcgcgggggggaggg

SEQ ID NO: 20851 - DNA, 15 bp, Homo sapiens
gtcgcgggggggagg

SEQ ID NO: 20852 - DNA, 15 bp, Homo sapiens
tgtcgcgggggggag

SEQ ID NO: 20853 - DNA, 15 bp, Homo sapiens
gtgtcgcggggggga

SEQ ID NO: 20854 - DNA, 15 bp, Homo sapiens
tgtgtcgcggggggg

SEQ ID NO: 20855 - DNA, 15 bp, Homo sapiens
gtgtgtcgcgggggg

SEQ ID NO: 20856 - DNA, 15 bp, Homo sapiens
tgtgtgtcgcggggg

SEQ ID NO: 20857 - DNA, 15 bp, Homo sapiens
gtgtgtgtcgcgggg

SEQ ID NO: 20858 - DNA, 15 bp, Homo sapiens
tgtgtgtgtcgcggg

SEQ ID NO: 20859 - DNA, 15 bp, Homo sapiens
gtgtgtgtgtcgcgg

SEQ ID NO: 20860 - DNA, 15 bp, Homo sapiens
ggtgtgtgtgtcgcg

SEQ ID NO: 20861 - DNA, 15 bp, Homo sapiens
aggtgtgtgtgtcgc

SEQ ID NO: 20862 - DNA, 15 bp, Homo sapiens
caggtgtgtgtgtcg

SEQ ID NO: 20863 - DNA, 15 bp, Homo sapiens
ccaggtgtgtgtgtc

SEQ ID NO: 20864 - DNA, 15 bp, Homo sapiens
cccaggtgtgtgtgt

SEQ ID NO: 20865 - DNA, 15 bp, Homo sapiens
acccaggtgtgtgtg

SEQ ID NO: 20866 - DNA, 15 bp, Homo sapiens
aacccaggtgtgtgt

SEQ ID NO: 20867 - DNA, 15 bp, Homo sapiens
taacccaggtgtgtg

SEQ ID NO: 20868 - DNA, 15 bp, Homo sapiens
ctaacccaggtgtgt

SEQ ID NO: 20869 - DNA, 15 bp, Homo sapiens
cctaacccaggtgtg

SEQ ID NO: 20870 - DNA, 15 bp, Homo sapiens
gcctaacccaggtgt

SEQ ID NO: 20871 - DNA, 15 bp, Homo sapiens
ggcctaacccaggtg

SEQ ID NO: 20872 - DNA, 15 bp, Homo sapiens
gggcctaacccaggt

SEQ ID NO: 20873 - DNA, 15 bp, Homo sapiens
agggcctaacccagg

SEQ ID NO: 20874 - DNA, 15 bp, Homo sapiens
cagggcctaacccag

SEQ ID NO: 20875 - DNA, 15 bp, Homo sapiens
gcagggcctaaccca

SEQ ID NO: 20876 - DNA, 15 bp, Homo sapiens
ggcagggcctaaccc

SEQ ID NO: 20877 - DNA, 15 bp, Homo sapiens
aggcagggcctaacc

SEQ ID NO: 20878 - DNA, 15 bp, Homo sapiens
gaggcagggcctaac

SEQ ID NO: 20879 - DNA, 15 bp, Homo sapiens
agaggcagggcctaa

SEQ ID NO: 20880 - DNA, 15 bp, Homo sapiens
gagaggcagggccta

SEQ ID NO: 20881 - DNA, 15 bp, Homo sapiens
ggagaggcagggcct

SEQ ID NO: 20882 - DNA, 15 bp, Homo sapiens
tggagaggcagggcc

SEQ ID NO: 20883 - DNA, 15 bp, Homo sapiens
gtggagaggcagggc

SEQ ID NO: 20884 - DNA, 15 bp, Homo sapiens
cgtggagaggcaggg

SEQ ID NO: 20885 - DNA, 15 bp, Homo sapiens
gcgtggagaggcagg

SEQ ID NO: 20886 - DNA, 15 bp, Homo sapiens
ggcgtggagaggcag

SEQ ID NO: 20887 - DNA, 15 bp, Homo sapiens
aggcgtggagaggca

SEQ ID NO: 20888 - DNA, 15 bp, Homo sapiens
caggcgtggagaggc

SEQ ID NO: 20889 - DNA, 15 bp, Homo sapiens
acaggcgtggagagg

SEQ ID NO: 20890 - DNA, 15 bp, Homo sapiens
cacaggcgtggagag

SEQ ID NO: 20891 - DNA, 15 bp, Homo sapiens
gcacaggcgtggaga

SEQ ID NO: 20892 - DNA, 15 bp, Homo sapiens
ggcacaggcgtggag

SEQ ID NO: 20893 - DNA, 15 bp, Homo sapiens
aggcacaggcgtgga

SEQ ID NO: 20894 - DNA, 15 bp, Homo sapiens
gaggcacaggcgtgg

SEQ ID NO: 20895 - DNA, 15 bp, Homo sapiens
ggaggcacaggcgtg

SEQ ID NO: 20896 - DNA, 15 bp, Homo sapiens
aggaggcacaggcgt

SEQ ID NO: 20897 - DNA, 15 bp, Homo sapiens
caggaggcacaggcg

SEQ ID NO: 20898 - DNA, 15 bp, Homo sapiens
gcaggaggcacaggc

SEQ ID NO: 20899 - DNA, 15 bp, Homo sapiens
ggcaggaggcacagg

SEQ ID NO: 20900 - DNA, 15 bp, Homo sapiens
tggcaggaggcacag

SEQ ID NO: 20901 - DNA, 15 bp, Homo sapiens
ttggcaggaggcaca

SEQ ID NO: 20902 - DNA, 15 bp, Homo sapiens
cttggcaggaggcac

SEQ ID NO: 20903 - DNA, 15 bp, Homo sapiens
acttggcaggaggca

SEQ ID NO: 20904 - DNA, 15 bp, Homo sapiens
gacttggcaggaggc

SEQ ID NO: 20905 - DNA, 15 bp, Homo sapiens
ggacttggcaggagg

SEQ ID NO: 20906 - DNA, 15 bp, Homo sapiens
aggacttggcaggag

SEQ ID NO: 20907 - DNA, 15 bp, Homo sapiens
gaggacttggcagga

SEQ ID NO: 20908 - DNA, 15 bp, Homo sapiens
tgaggacttggcagg

SEQ ID NO: 20909 - DNA, 15 bp, Homo sapiens
ctgaggacttggcag

SEQ ID NO: 20910 - DNA, 15 bp, Homo sapiens
tctgaggacttggca

SEQ ID NO: 20911 - DNA, 15 bp, Homo sapiens
ctctgaggacttggc

SEQ ID NO: 20912 - DNA, 15 bp, Homo sapiens
cctctgaggacttgg

SEQ ID NO: 20913 - DNA, 15 bp, Homo sapiens
acctctgaggacttg

SEQ ID NO: 20914 - DNA, 15 bp, Homo sapiens
gacctctgaggactt

SEQ ID NO: 20915 - DNA, 15 bp, Homo sapiens
agacctctgaggact

SEQ ID NO: 20916 - DNA, 15 bp, Homo sapiens
gagacctctgaggac

SEQ ID NO: 20917 - DNA, 15 bp, Homo sapiens
agagacctctgagga

SEQ ID NO: 20918 - DNA, 15 bp, Homo sapiens
cagagacctctgagg

SEQ ID NO: 20919 - DNA, 15 bp, Homo sapiens
tcagagacctctgag

SEQ ID NO: 20920 - DNA, 15 bp, Homo sapiens
atcagagacctctga

SEQ ID NO: 20921 - DNA, 15 bp, Homo sapiens
gatcagagacctctg

SEQ ID NO: 20922 - DNA, 15 bp, Homo sapiens
ggatcagagacctct

SEQ ID NO: 20923 - DNA, 15 bp, Homo sapiens
gggatcagagacctc

SEQ ID NO: 20924 - DNA, 15 bp, Homo sapiens
tgggatcagagacct

SEQ ID NO: 20925 - DNA, 15 bp, Homo sapiens
atgggatcagagacc

SEQ ID NO: 20926 - DNA, 15 bp, Homo sapiens
catgggatcagagac

SEQ ID NO: 20927 - DNA, 15 bp, Homo sapiens
acatgggatcagaga

SEQ ID NO: 20928 - DNA, 15 bp, Homo sapiens
cacatgggatcagag

SEQ ID NO: 20929 - DNA, 15 bp, Homo sapiens
gcacatgggatcaga

SEQ ID NO: 20930 - DNA, 15 bp, Homo sapiens
ggcacatgggatcag

SEQ ID NO: 20931 - DNA, 15 bp, Homo sapiens
aggcacatgggatca

SEQ ID NO: 20932 - DNA, 15 bp, Homo sapiens
gaggcacatgggatc

SEQ ID NO: 20933 - DNA, 15 bp, Homo sapiens
ggaggcacatgggat

SEQ ID NO: 20934 - DNA, 15 bp, Homo sapiens
tggaggcacatggga

SEQ ID NO: 20935 - DNA, 15 bp, Homo sapiens
ctggaggcacatggg

SEQ ID NO: 20936 - DNA, 15 bp, Homo sapiens
cctggaggcacatgg

SEQ ID NO: 20937 - DNA, 15 bp, Homo sapiens
gcctggaggcacatg

SEQ ID NO: 20938 - DNA, 15 bp, Homo sapiens
tgcctggaggcacat

SEQ ID NO: 20939 - DNA, 15 bp, Homo sapiens
atgcctggaggcaca

SEQ ID NO: 20940 - DNA, 15 bp, Homo sapiens
catgcctggaggcac

SEQ ID NO: 20941 - DNA, 15 bp, Homo sapiens
ccatgcctggaggca

SEQ ID NO: 20942 - DNA, 15 bp, Homo sapiens
gccatgcctggaggc

SEQ ID NO: 20943 - DNA, 15 bp, Homo sapiens
tgccatgcctggagg

SEQ ID NO: 20944 - DNA, 15 bp, Homo sapiens
atgccatgcctggag

SEQ ID NO: 20945 - DNA, 15 bp, Homo sapiens
tatgccatgcctgga

SEQ ID NO: 20946 - DNA, 15 bp, Homo sapiens
ctatgccatgcctgg

SEQ ID NO: 20947 - DNA, 15 bp, Homo sapiens
cctatgccatgcctg

SEQ ID NO: 20948 - DNA, 15 bp, Homo sapiens
ccctatgccatgcct

SEQ ID NO: 20949 - DNA, 15 bp, Homo sapiens
cccctatgccatgcc

SEQ ID NO: 20950 - DNA, 15 bp, Homo sapiens
ccccctatgccatgc

SEQ ID NO: 20951 - DNA, 15 bp, Homo sapiens
tccccctatgccatg

SEQ ID NO: 20952 - DNA, 15 bp, Homo sapiens
gtccccctatgccat

SEQ ID NO: 20953 - DNA, 15 bp, Homo sapiens
agtccccctatgcca

SEQ ID NO: 20954 - DNA, 15 bp, Homo sapiens
cagtccccctatgcc

SEQ ID NO: 20955 - DNA, 15 bp, Homo sapiens
acagtccccctatgc

SEQ ID NO: 20956 - DNA, 15 bp, Homo sapiens
cacagtccccctatg

SEQ ID NO: 20957 - DNA, 15 bp, Homo sapiens
tcacagtccccctat

SEQ ID NO: 20958 - DNA, 15 bp, Homo sapiens
gtcacagtcccccta

SEQ ID NO: 20959 - DNA, 15 bp, Homo sapiens
tgtcacagtccccct

SEQ ID NO: 20960 - DNA, 15 bp, Homo sapiens
gtgtcacagtccccc

SEQ ID NO: 20961 - DNA, 15 bp, Homo sapiens
tgtgtcacagtcccc

SEQ ID NO: 20962 - DNA, 15 bp, Homo sapiens
ctgtgtcacagtccc

SEQ ID NO: 20963 - DNA, 15 bp, Homo sapiens
gctgtgtcacagtcc

SEQ ID NO: 20964 - DNA, 15 bp, Homo sapiens
ggctgtgtcacagtc

SEQ ID NO: 20965 - DNA, 15 bp, Homo sapiens
aggctgtgtcacagt

SEQ ID NO: 20966 - DNA, 15 bp, Homo sapiens
gaggctgtgtcacag

SEQ ID NO: 20967 - DNA, 15 bp, Homo sapiens
agaggctgtgtcaca

SEQ ID NO: 20968 - DNA, 15 bp, Homo sapiens
gagaggctgtgtcac

SEQ ID NO: 20969 - DNA, 15 bp, Homo sapiens
cgagaggctgtgtca

SEQ ID NO: 20970 - DNA, 15 bp, Homo sapiens
ccgagaggctgtgtc

SEQ ID NO: 20971 - DNA, 15 bp, Homo sapiens
gccgagaggctgtgt

SEQ ID NO: 20972 - DNA, 15 bp, Homo sapiens
ggccgagaggctgtg

SEQ ID NO: 20973 - DNA, 15 bp, Homo sapiens
gggccgagaggctgt

SEQ ID NO: 20974 - DNA, 15 bp, Homo sapiens
tgggccgagaggctg

SEQ ID NO: 20975 - DNA, 15 bp, Homo sapiens
gtgggccgagaggct

SEQ ID NO: 20976 - DNA, 15 bp, Homo sapiens
tgtgggccgagaggc

SEQ ID NO: 20977 - DNA, 15 bp, Homo sapiens
ctgtgggccgagagg

SEQ ID NO: 20978 - DNA, 15 bp, Homo sapiens
tctgtgggccgagag

SEQ ID NO: 20979 - DNA, 15 bp, Homo sapiens
gtctgtgggccgaga

SEQ ID NO: 20980 - DNA, 15 bp, Homo sapiens
ggtctgtgggccgag

SEQ ID NO: 20981 - DNA, 15 bp, Homo sapiens
gggtctgtgggccga

SEQ ID NO: 20982 - DNA, 15 bp, Homo sapiens
ggggtctgtgggccg

SEQ ID NO: 20983 - DNA, 15 bp, Homo sapiens
aggggtctgtgggcc

SEQ ID NO: 20984 - DNA, 15 bp, Homo sapiens
caggggtctgtgggc

SEQ ID NO: 20985 - DNA, 15 bp, Homo sapiens
tcaggggtctgtggg

SEQ ID NO: 20986 - DNA, 15 bp, Homo sapiens
atcaggggtctgtgg

SEQ ID NO: 20987 - DNA, 15 bp, Homo sapiens
aatcaggggtctgtg

SEQ ID NO: 20988 - DNA, 15 bp, Homo sapiens
caatcaggggtctgt

SEQ ID NO: 20989 - DNA, 15 bp, Homo sapiens
acaatcaggggtctg

SEQ ID NO: 20990 - DNA, 15 bp, Homo sapiens
cacaatcaggggtct

SEQ ID NO: 20991 - DNA, 15 bp, Homo sapiens
ccacaatcaggggtc

SEQ ID NO: 20992 - DNA, 15 bp, Homo sapiens
cccacaatcaggggt

SEQ ID NO: 20993 - DNA, 15 bp, Homo sapiens
gcccacaatcagggg

SEQ ID NO: 20994 - DNA, 15 bp, Homo sapiens
agcccacaatcaggg

SEQ ID NO: 20995 - DNA, 15 bp, Homo sapiens
aagcccacaatcagg

SEQ ID NO: 20996 - DNA, 15 bp, Homo sapiens
caagcccacaatcag

SEQ ID NO: 20997 - DNA, 15 bp, Homo sapiens
gcaagcccacaatca

SEQ ID NO: 20998 - DNA, 15 bp, Homo sapiens
agcaagcccacaatc

SEQ ID NO: 20999 - DNA, 15 bp, Homo sapiens
gagcaagcccacaat

SEQ ID NO: 21000 - DNA, 15 bp, Homo sapiens
tgagcaagcccacaa

SEQ ID NO: 21001 - DNA, 15 bp, Homo sapiens
gtgagcaagcccaca

SEQ ID NO: 21002 - DNA, 15 bp, Homo sapiens
agtgagcaagcccac

SEQ ID NO: 21003 - DNA, 15 bp, Homo sapiens
cagtgagcaagccca

SEQ ID NO: 21004 - DNA, 15 bp, Homo sapiens
gcagtgagcaagccc

SEQ ID NO: 21005 - DNA, 15 bp, Homo sapiens
ggcagtgagcaagcc

SEQ ID NO: 21006 - DNA, 15 bp, Homo sapiens
gggcagtgagcaagc

SEQ ID NO: 21007 - DNA, 15 bp, Homo sapiens
ggggcagtgagcaag

SEQ ID NO: 21008 - DNA, 15 bp, Homo sapiens
tggggcagtgagcaa

SEQ ID NO: 21009 - DNA, 15 bp, Homo sapiens
ctggggcagtgagca

SEQ ID NO: 21010 - DNA, 15 bp, Homo sapiens
actggggcagtgagc

SEQ ID NO: 21011 - DNA, 15 bp, Homo sapiens
gactggggcagtgag

SEQ ID NO: 21012 - DNA, 15 bp, Homo sapiens
tgactggggcagtga

SEQ ID NO: 21013 - DNA, 15 bp, Homo sapiens
ctgactggggcagtg

SEQ ID NO: 21014 - DNA, 15 bp, Homo sapiens
actgactggggcagt

SEQ ID NO: 21015 - DNA, 15 bp, Homo sapiens
gactgactggggcag

SEQ ID NO: 21016 - DNA, 15 bp, Homo sapiens
ggactgactggggca

SEQ ID NO: 21017 - DNA, 15 bp, Homo sapiens
aggactgactggggc

SEQ ID NO: 21018 - DNA, 15 bp, Homo sapiens
gaggactgactgggg

SEQ ID NO: 21019 - DNA, 15 bp, Homo sapiens
agaggactgactggg

SEQ ID NO: 21020 - DNA, 15 bp, Homo sapiens
aagaggactgactgg

SEQ ID NO: 21021 - DNA, 15 bp, Homo sapiens
taagaggactgactg

SEQ ID NO: 21022 - DNA, 15 bp, Homo sapiens
ataagaggactgact

SEQ ID NO: 21023 - DNA, 15 bp, Homo sapiens
aataagaggactgac

SEQ ID NO: 21024 - DNA, 15 bp, Homo sapiens
caataagaggactga

SEQ ID NO: 21025 - DNA, 15 bp, Homo sapiens
tcaataagaggactg

SEQ ID NO: 21026 - DNA, 15 bp, Homo sapiens
ctcaataagaggact

SEQ ID NO: 21027 - DNA, 15 bp, Homo sapiens
cctcaataagaggac

SEQ ID NO: 21028 - DNA, 15 bp, Homo sapiens
tcctcaataagagga

SEQ ID NO: 21029 - DNA, 15 bp, Homo sapiens
atcctcaataagagg

SEQ ID NO: 21030 - DNA, 15 bp, Homo sapiens
aatcctcaataagag

SEQ ID NO: 21031 - DNA, 15 bp, Homo sapiens
gaatcctcaataaga

SEQ ID NO: 21032 - DNA, 15 bp, Homo sapiens
ggaatcctcaataag

SEQ ID NO: 21033 - DNA, 15 bp, Homo sapiens
cggaatcctcaataa

SEQ ID NO: 21034 - DNA, 15 bp, Homo sapiens
acggaatcctcaata

SEQ ID NO: 21035 - DNA, 15 bp, Homo sapiens
cacggaatcctcaat

SEQ ID NO: 21036 - DNA, 15 bp, Homo sapiens
gcacggaatcctcaa

SEQ ID NO: 21037 - DNA, 15 bp, Homo sapiens
ggcacggaatcctca

SEQ ID NO: 21038 - DNA, 15 bp, Homo sapiens
tggcacggaatcctc

SEQ ID NO: 21039 - DNA, 15 bp, Homo sapiens
ctggcacggaatcct

SEQ ID NO: 21040 - DNA, 15 bp, Homo sapiens
actggcacggaatcc

SEQ ID NO: 21041 - DNA, 15 bp, Homo sapiens
aactggcacggaatc

SEQ ID NO: 21042 - DNA, 15 bp, Homo sapiens
gaactggcacggaat

SEQ ID NO: 21043 - DNA, 15 bp, Homo sapiens
ggaactggcacggaa

SEQ ID NO: 21044 - DNA, 15 bp, Homo sapiens
aggaactggcacgga

SEQ ID NO: 21045 - DNA, 15 bp, Homo sapiens
caggaactggcacgg

SEQ ID NO: 21046 - DNA, 15 bp, Homo sapiens
tcaggaactggcacg

SEQ ID NO: 21047 - DNA, 15 bp, Homo sapiens
gtcaggaactggcac

SEQ ID NO: 21048 - DNA, 15 bp, Homo sapiens
agtcaggaactggca

SEQ ID NO: 21049 - DNA, 15 bp, Homo sapiens
gagtcaggaactggc

SEQ ID NO: 21050 - DNA, 15 bp, Homo sapiens
ggagtcaggaactgg

SEQ ID NO: 21051 - DNA, 15 bp, Homo sapiens
tggagtcaggaactg

SEQ ID NO: 21052 - DNA, 15 bp, Homo sapiens
ctggagtcaggaact

SEQ ID NO: 21053 - DNA, 15 bp, Homo sapiens
gctggagtcaggaac

SEQ ID NO: 21054 - DNA, 15 bp, Homo sapiens
tgctggagtcaggaa

SEQ ID NO: 21055 - DNA, 15 bp, Homo sapiens
gtgctggagtcagga

SEQ ID NO: 21056 - DNA, 15 bp, Homo sapiens
tgtgctggagtcagg

SEQ ID NO: 21057 - DNA, 15 bp, Homo sapiens
gtgtgctggagtcag

SEQ ID NO: 21058 - DNA, 15 bp, Homo sapiens
tgtgtgctggagtca

SEQ ID NO: 21059 - DNA, 15 bp, Homo sapiens
gtgtgtgctggagtc

SEQ ID NO: 21060 - DNA, 15 bp, Homo sapiens
tgtgtgtgctggagt

SEQ ID NO: 21061 - DNA, 15 bp, Homo sapiens
gtgtgtgtgctggag

SEQ ID NO: 21062 - DNA, 15 bp, Homo sapiens
cgtgtgtgtgctgga

SEQ ID NO: 21063 - DNA, 15 bp, Homo sapiens
gcgtgtgtgtgctgg

SEQ ID NO: 21064 - DNA, 15 bp, Homo sapiens
tgcgtgtgtgtgctg

SEQ ID NO: 21065 - DNA, 15 bp, Homo sapiens
atgcgtgtgtgtgct

SEQ ID NO: 21066 - DNA, 15 bp, Homo sapiens
catgcgtgtgtgtgc

SEQ ID NO: 21067 - DNA, 15 bp, Homo sapiens
acatgcgtgtgtgtg

SEQ ID NO: 21068 - DNA, 15 bp, Homo sapiens
tacatgcgtgtgtgt

SEQ ID NO: 21069 - DNA, 15 bp, Homo sapiens
ctacatgcgtgtgtg

SEQ ID NO: 21070 - DNA, 15 bp, Homo sapiens
cctacatgcgtgtgt

SEQ ID NO: 21071 - DNA, 15 bp, Homo sapiens
gcctacatgcgtgtg

SEQ ID NO: 21072 - DNA, 15 bp, Homo sapiens
ggcctacatgcgtgt

SEQ ID NO: 21073 - DNA, 15 bp, Homo sapiens
cggcctacatgcgtg

SEQ ID NO: 21074 - DNA, 15 bp, Homo sapiens
gcggcctacatgcgt

SEQ ID NO: 21075 - DNA, 15 bp, Homo sapiens
ggcggcctacatgcg

SEQ ID NO: 21076 - DNA, 15 bp, Homo sapiens
gggcggcctacatgc

SEQ ID NO: 21077 - DNA, 15 bp, Homo sapiens
agggcggcctacatg

SEQ ID NO: 21078 - DNA, 15 bp, Homo sapiens
gagggcggcctacat

SEQ ID NO: 21079 - DNA, 15 bp, Homo sapiens
ggagggcggcctaca

SEQ ID NO: 21080 - DNA, 15 bp, Homo sapiens
aggagggcggcctac

SEQ ID NO: 21081 - DNA, 15 bp, Homo sapiens
taggagggcggccta

SEQ ID NO: 21082 - DNA, 15 bp, Homo sapiens
ctaggagggcggcct

SEQ ID NO: 21083 - DNA, 15 bp, Homo sapiens
actaggagggcggcc

SEQ ID NO: 21084 - DNA, 15 bp, Homo sapiens
cactaggagggcggc

SEQ ID NO: 21085 - DNA, 15 bp, Homo sapiens
gcactaggagggcgg

SEQ ID NO: 21086 - DNA, 15 bp, Homo sapiens
ggcactaggagggcg

SEQ ID NO: 21087 - DNA, 15 bp, Homo sapiens
aggcactaggagggc

SEQ ID NO: 21088 - DNA, 15 bp, Homo sapiens
caggcactaggaggg

SEQ ID NO: 21089 - DNA, 15 bp, Homo sapiens
ccaggcactaggagg

SEQ ID NO: 21090 - DNA, 15 bp, Homo sapiens
gccaggcactaggag

SEQ ID NO: 21091 - DNA, 15 bp, Homo sapiens
agccaggcactagga

SEQ ID NO: 21092 - DNA, 15 bp, Homo sapiens
gagccaggcactagg

SEQ ID NO: 21093 - DNA, 15 bp, Homo sapiens
ggagccaggcactag

SEQ ID NO: 21094 - DNA, 15 bp, Homo sapiens
aggagccaggcacta

SEQ ID NO: 21095 - DNA, 15 bp, Homo sapiens
aaggagccaggcact

SEQ ID NO: 21096 - DNA, 15 bp, Homo sapiens
gaaggagccaggcac

SEQ ID NO: 21097 - DNA, 15 bp, Homo sapiens
ggaaggagccaggca

SEQ ID NO: 21098 - DNA, 15 bp, Homo sapiens
gggaaggagccaggc

SEQ ID NO: 21099 - DNA, 15 bp, Homo sapiens
agggaaggagccagg

SEQ ID NO: 21100 - DNA, 15 bp, Homo sapiens
cagggaaggagccag

SEQ ID NO: 21101 - DNA, 15 bp, Homo sapiens
acagggaaggagcca

SEQ ID NO: 21102 - DNA, 15 bp, Homo sapiens
gacagggaaggagcc

SEQ ID NO: 21103 - DNA, 15 bp, Homo sapiens
agacagggaaggagc

SEQ ID NO: 21104 - DNA, 15 bp, Homo sapiens
gagacagggaaggag

SEQ ID NO: 21105 - DNA, 15 bp, Homo sapiens
agagacagggaagga

SEQ ID NO: 21106 - DNA, 15 bp, Homo sapiens
aagagacagggaagg

SEQ ID NO: 21107 - DNA, 15 bp, Homo sapiens
gaagagacagggaag

SEQ ID NO: 21108 - DNA, 15 bp, Homo sapiens
agaagagacagggaa

SEQ ID NO: 21109 - DNA, 15 bp, Homo sapiens
cagaagagacaggga

SEQ ID NO: 21110 - DNA, 15 bp, Homo sapiens
gcagaagagacaggg

SEQ ID NO: 21111 - DNA, 15 bp, Homo sapiens
ggcagaagagacagg

SEQ ID NO: 21112 - DNA, 15 bp, Homo sapiens
tggcagaagagacag

SEQ ID NO: 21113 - DNA, 15 bp, Homo sapiens
gtggcagaagagaca

SEQ ID NO: 21114 - DNA, 15 bp, Homo sapiens
agtggcagaagagac

SEQ ID NO: 21115 - DNA, 15 bp, Homo sapiens
gagtggcagaagaga

SEQ ID NO: 21116 - DNA, 15 bp, Homo sapiens
tgagtggcagaagag

SEQ ID NO: 21117 - DNA, 15 bp, Homo sapiens
atgagtggcagaaga

SEQ ID NO: 21118 - DNA, 15 bp, Homo sapiens
aatgagtggcagaag

SEQ ID NO: 21119 - DNA, 15 bp, Homo sapiens
gaatgagtggcagaa

SEQ ID NO: 21120 - DNA, 15 bp, Homo sapiens
ggaatgagtggcaga

SEQ ID NO: 21121 - DNA, 15 bp, Homo sapiens
gggaatgagtggcag

SEQ ID NO: 21122 - DNA, 15 bp, Homo sapiens
tgggaatgagtggca

SEQ ID NO: 21123 - DNA, 15 bp, Homo sapiens
atgggaatgagtggc

SEQ ID NO: 21124 - DNA, 15 bp, Homo sapiens
catgggaatgagtgg

SEQ ID NO: 21125 - DNA, 15 bp, Homo sapiens
ccatgggaatgagtg

SEQ ID NO: 21126 - DNA, 15 bp, Homo sapiens
accatgggaatgagt

SEQ ID NO: 21127 - DNA, 15 bp, Homo sapiens
gaccatgggaatgag

SEQ ID NO: 21128 - DNA, 15 bp, Homo sapiens
cgaccatgggaatga

SEQ ID NO: 21129 - DNA, 15 bp, Homo sapiens
acgaccatgggaatg

SEQ ID NO: 21130 - DNA, 15 bp, Homo sapiens
tacgaccatgggaat

SEQ ID NO: 21131 - DNA, 15 bp, Homo sapiens
atacgaccatgggaa

SEQ ID NO: 21132 - DNA, 15 bp, Homo sapiens
gatacgaccatggga

SEQ ID NO: 21133 - DNA, 15 bp, Homo sapiens
ggatacgaccatggg

SEQ ID NO: 21134 - DNA, 15 bp, Homo sapiens
aggatacgaccatgg

SEQ ID NO: 21135 - DNA, 15 bp, Homo sapiens
caggatacgaccatg

SEQ ID NO: 21136 - DNA, 15 bp, Homo sapiens
ccaggatacgaccat

SEQ ID NO: 21137 - DNA, 15 bp, Homo sapiens
tccaggatacgacca

SEQ ID NO: 21138 - DNA, 15 bp, Homo sapiens
ctccaggatacgacc

SEQ ID NO: 21139 - DNA, 15 bp, Homo sapiens
actccaggatacgac

SEQ ID NO: 21140 - DNA, 15 bp, Homo sapiens
aactccaggatacga

SEQ ID NO: 21141 - DNA, 15 bp, Homo sapiens
caactccaggatacg

SEQ ID NO: 21142 - DNA, 15 bp, Homo sapiens
ccaactccaggatac

SEQ ID NO: 21143 - DNA, 15 bp, Homo sapiens
accaactccaggata

SEQ ID NO: 21144 - DNA, 15 bp, Homo sapiens
gaccaactccaggat

SEQ ID NO: 21145 - DNA, 15 bp, Homo sapiens
tgaccaactccagga

SEQ ID NO: 21146 - DNA, 15 bp, Homo sapiens
atgaccaactccagg

SEQ ID NO: 21147 - DNA, 15 bp, Homo sapiens
gatgaccaactccag

SEQ ID NO: 21148 - DNA, 15 bp, Homo sapiens
agatgaccaactcca

SEQ ID NO: 21149 - DNA, 15 bp, Homo sapiens
gagatgaccaactcc

SEQ ID NO: 21150 - DNA, 15 bp, Homo sapiens
agagatgaccaactc

SEQ ID NO: 21151 - DNA, 15 bp, Homo sapiens
cagagatgaccaact

SEQ ID NO: 21152 - DNA, 15 bp, Homo sapiens
ccagagatgaccaac

SEQ ID NO: 21153 - DNA, 15 bp, Homo sapiens
tccagagatgaccaa

SEQ ID NO: 21154 - DNA, 15 bp, Homo sapiens
ttccagagatgacca

SEQ ID NO: 21155 - DNA, 15 bp, Homo sapiens
gttccagagatgacc

SEQ ID NO: 21156 - DNA, 15 bp, Homo sapiens
agttccagagatgac

SEQ ID NO: 21157 - DNA, 15 bp, Homo sapiens
gagttccagagatga

SEQ ID NO: 21158 - DNA, 15 bp, Homo sapiens
ggagttccagagatg

SEQ ID NO: 21159 - DNA, 15 bp, Homo sapiens
tggagttccagagat

SEQ ID NO: 21160 - DNA, 15 bp, Homo sapiens
gtggagttccagaga

SEQ ID NO: 21161 - DNA, 15 bp, Homo sapiens
ggtggagttccagag

SEQ ID NO: 21162 - DNA, 15 bp, Homo sapiens
gggtggagttccaga

SEQ ID NO: 21163 - DNA, 15 bp, Homo sapiens
tgggtggagttccag

SEQ ID NO: 21164 - DNA, 15 bp, Homo sapiens
gtgggtggagttcca

SEQ ID NO: 21165 - DNA, 15 bp, Homo sapiens
cgtgggtggagttcc

SEQ ID NO: 21166 - DNA, 15 bp, Homo sapiens
ccgtgggtggagttc

SEQ ID NO: 21167 - DNA, 15 bp, Homo sapiens
tccgtgggtggagtt

SEQ ID NO: 21168 - DNA, 15 bp, Homo sapiens
ctccgtgggtggagt

SEQ ID NO: 21169 - DNA, 15 bp, Homo sapiens
actccgtgggtggag

SEQ ID NO: 21170 - DNA, 15 bp, Homo sapiens
aactccgtgggtgga

SEQ ID NO: 21171 - DNA, 15 bp, Homo sapiens
gaactccgtgggtgg

SEQ ID NO: 21172 - DNA, 15 bp, Homo sapiens
agaactccgtgggtg

SEQ ID NO: 21173 - DNA, 15 bp, Homo sapiens
tagaactccgtgggt

SEQ ID NO: 21174 - DNA, 15 bp, Homo sapiens
ttagaactccgtggg

SEQ ID NO: 21175 - DNA, 15 bp, Homo sapiens
gttagaactccgtgg

SEQ ID NO: 21176 - DNA, 15 bp, Homo sapiens
agttagaactccgtg

SEQ ID NO: 21177 - DNA, 15 bp, Homo sapiens
aagttagaactccgt

SEQ ID NO: 21178 - DNA, 15 bp, Homo sapiens
taagttagaactccg

SEQ ID NO: 21179 - DNA, 15 bp, Homo sapiens
ctaagttagaactcc

SEQ ID NO: 21180 - DNA, 15 bp, Homo sapiens
gctaagttagaactc

SEQ ID NO: 21181 - DNA, 15 bp, Homo sapiens
agctaagttagaact

SEQ ID NO: 21182 - DNA, 15 bp, Homo sapiens
gagctaagttagaac

SEQ ID NO: 21183 - DNA, 15 bp, Homo sapiens
agagctaagttagaa

SEQ ID NO: 21184 - DNA, 15 bp, Homo sapiens
cagagctaagttaga

SEQ ID NO: 21185 - DNA, 15 bp, Homo sapiens
gcagagctaagttag

SEQ ID NO: 21186 - DNA, 15 bp, Homo sapiens
ggcagagctaagtta

SEQ ID NO: 21187 - DNA, 15 bp, Homo sapiens
aggcagagctaagtt

SEQ ID NO: 21188 - DNA, 15 bp, Homo sapiens
taggcagagctaagt

SEQ ID NO: 21189 - DNA, 15 bp, Homo sapiens
ataggcagagctaag

SEQ ID NO: 21190 - DNA, 15 bp, Homo sapiens
cataggcagagctaa

SEQ ID NO: 21191 - DNA, 15 bp, Homo sapiens
tcataggcagagcta

SEQ ID NO: 21192 - DNA, 15 bp, Homo sapiens
atcataggcagagct

SEQ ID NO: 21193 - DNA, 15 bp, Homo sapiens
catcataggcagagc

SEQ ID NO: 21194 - DNA, 15 bp, Homo sapiens
tcatcataggcagag

SEQ ID NO: 21195 - DNA, 15 bp, Homo sapiens
ctcatcataggcaga

SEQ ID NO: 21196 - DNA, 15 bp, Homo sapiens
cctcatcataggcag

SEQ ID NO: 21197 - DNA, 15 bp, Homo sapiens
tcctcatcataggca

SEQ ID NO: 21198 - DNA, 15 bp, Homo sapiens
gtcctcatcataggc

SEQ ID NO: 21199 - DNA, 15 bp, Homo sapiens
agtcctcatcatagg

SEQ ID NO: 21200 - DNA, 15 bp, Homo sapiens
aagtcctcatcatag

SEQ ID NO: 21201 - DNA, 15 bp, Homo sapiens
taagtcctcatcata

SEQ ID NO: 21202 - DNA, 15 bp, Homo sapiens
gtaagtcctcatcat

SEQ ID NO: 21203 - DNA, 15 bp, Homo sapiens
agtaagtcctcatca

SEQ ID NO: 21204 - DNA, 15 bp, Homo sapiens
cagtaagtcctcatc

SEQ ID NO: 21205 - DNA, 15 bp, Homo sapiens
acagtaagtcctcat

SEQ ID NO: 21206 - DNA, 15 bp, Homo sapiens
gacagtaagtcctca

SEQ ID NO: 21207 - DNA, 15 bp, Homo sapiens
agacagtaagtcctc

SEQ ID NO: 21208 - DNA, 15 bp, Homo sapiens
aagacagtaagtcct

SEQ ID NO: 21209 - DNA, 15 bp, Homo sapiens
gaagacagtaagtcc

SEQ ID NO: 21210 - DNA, 15 bp, Homo sapiens
ggaagacagtaagtc

SEQ ID NO: 21211 - DNA, 15 bp, Homo sapiens
gggaagacagtaagt

SEQ ID NO: 21212 - DNA, 15 bp, Homo sapiens
tgggaagacagtaag

SEQ ID NO: 21213 - DNA, 15 bp, Homo sapiens
ctgggaagacagtaa

SEQ ID NO: 21214 - DNA, 15 bp, Homo sapiens
gctgggaagacagta

SEQ ID NO: 21215 - DNA, 15 bp, Homo sapiens
agctgggaagacagt

SEQ ID NO: 21216 - DNA, 15 bp, Homo sapiens
aagctgggaagacag

SEQ ID NO: 21217 - DNA, 15 bp, Homo sapiens
caagctgggaagaca

SEQ ID NO: 21218 - DNA, 15 bp, Homo sapiens
gcaagctgggaagac

SEQ ID NO: 21219 - DNA, 15 bp, Homo sapiens
tgcaagctgggaaga

SEQ ID NO: 21220 - DNA, 15 bp, Homo sapiens
ctgcaagctgggaag

SEQ ID NO: 21221 - DNA, 15 bp, Homo sapiens
actgcaagctgggaa

SEQ ID NO: 21222 - DNA, 15 bp, Homo sapiens
cactgcaagctggga

SEQ ID NO: 21223 - DNA, 15 bp, Homo sapiens
acactgcaagctggg

SEQ ID NO: 21224 - DNA, 15 bp, Homo sapiens
gacactgcaagctgg

SEQ ID NO: 21225 - DNA, 15 bp, Homo sapiens
tgacactgcaagctg

SEQ ID NO: 21226 - DNA, 15 bp, Homo sapiens
ttgacactgcaagct

SEQ ID NO: 21227 - DNA, 15 bp, Homo sapiens
gttgacactgcaagc

SEQ ID NO: 21228 - DNA, 15 bp, Homo sapiens
ggttgacactgcaag

SEQ ID NO: 21229 - DNA, 15 bp, Homo sapiens
tggttgacactgcaa

SEQ ID NO: 21230 - DNA, 15 bp, Homo sapiens
gtggttgacactgca

SEQ ID NO: 21231 - DNA, 15 bp, Homo sapiens
agtggttgacactgc

SEQ ID NO: 21232 - DNA, 15 bp, Homo sapiens
cagtggttgacactg

SEQ ID NO: 21233 - DNA, 15 bp, Homo sapiens
acagtggttgacact

SEQ ID NO: 21234 - DNA, 15 bp, Homo sapiens
aacagtggttgacac

SEQ ID NO: 21235 - DNA, 15 bp, Homo sapiens
aaacagtggttgaca

SEQ ID NO: 21236 - DNA, 15 bp, Homo sapiens
caaacagtggttgac

SEQ ID NO: 21237 - DNA, 15 bp, Homo sapiens
tcaaacagtggttga

SEQ ID NO: 21238 - DNA, 15 bp, Homo sapiens
atcaaacagtggttg

SEQ ID NO: 21239 - DNA, 15 bp, Homo sapiens
catcaaacagtggtt

SEQ ID NO: 21240 - DNA, 15 bp, Homo sapiens
gcatcaaacagtggt

SEQ ID NO: 21241 - DNA, 15 bp, Homo sapiens
ggcatcaaacagtgg

SEQ ID NO: 21242 - DNA, 15 bp, Homo sapiens
gggcatcaaacagtg

SEQ ID NO: 21243 - DNA, 15 bp, Homo sapiens
ggggcatcaaacagt

SEQ ID NO: 21244 - DNA, 15 bp, Homo sapiens
aggggcatcaaacag

SEQ ID NO: 21245 - DNA, 15 bp, Homo sapiens
caggggcatcaaaca

SEQ ID NO: 21246 - DNA, 15 bp, Homo sapiens
ccaggggcatcaaac

SEQ ID NO: 21247 - DNA, 15 bp, Homo sapiens
cccaggggcatcaaa

SEQ ID NO: 21248 - DNA, 15 bp, Homo sapiens
tcccaggggcatcaa

SEQ ID NO: 21249 - DNA, 15 bp, Homo sapiens
gtcccaggggcatca

SEQ ID NO: 21250 - DNA, 15 bp, Homo sapiens
agtcccaggggcatc

SEQ ID NO: 21251 - DNA, 15 bp, Homo sapiens
gagtcccaggggcat

SEQ ID NO: 21252 - DNA, 15 bp, Homo sapiens
ggagtcccaggggca

SEQ ID NO: 21253 - DNA, 15 bp, Homo sapiens
tggagtcccaggggc

SEQ ID NO: 21254 - DNA, 15 bp, Homo sapiens
atggagtcccagggg

SEQ ID NO: 21255 - DNA, 15 bp, Homo sapiens
aatggagtcccaggg

SEQ ID NO: 21256 - DNA, 15 bp, Homo sapiens
caatggagtcccagg

SEQ ID NO: 21257 - DNA, 15 bp, Homo sapiens
ccaatggagtcccag

SEQ ID NO: 21258 - DNA, 15 bp, Homo sapiens
accaatggagtccca

SEQ ID NO: 21259 - DNA, 15 bp, Homo sapiens
gaccaatggagtccc

SEQ ID NO: 21260 - DNA, 15 bp, Homo sapiens
agaccaatggagtcc

SEQ ID NO: 21261 - DNA, 15 bp, Homo sapiens
aagaccaatggagtc

SEQ ID NO: 21262 - DNA, 15 bp, Homo sapiens
gaagaccaatggagt

SEQ ID NO: 21263 - DNA, 15 bp, Homo sapiens
ggaagaccaatggag

SEQ ID NO: 21264 - DNA, 15 bp, Homo sapiens
gggaagaccaatgga

SEQ ID NO: 21265 - DNA, 15 bp, Homo sapiens
agggaagaccaatgg

SEQ ID NO: 21266 - DNA, 15 bp, Homo sapiens
gagggaagaccaatg

SEQ ID NO: 21267 - DNA, 15 bp, Homo sapiens
ggagggaagaccaat

SEQ ID NO: 21268 - DNA, 15 bp, Homo sapiens
aggagggaagaccaa

SEQ ID NO: 21269 - DNA, 15 bp, Homo sapiens
gaggagggaagacca

SEQ ID NO: 21270 - DNA, 15 bp, Homo sapiens
agaggagggaagacc

SEQ ID NO: 21271 - DNA, 15 bp, Homo sapiens
aagaggagggaagac

SEQ ID NO: 21272 - DNA, 15 bp, Homo sapiens
caagaggagggaaga

SEQ ID NO: 21273 - DNA, 15 bp, Homo sapiens
acaagaggagggaag

SEQ ID NO: 21274 - DNA, 15 bp, Homo sapiens
cacaagaggagggaa

SEQ ID NO: 21275 - DNA, 15 bp, Homo sapiens
tcacaagaggaggga

SEQ ID NO: 21276 - DNA, 15 bp, Homo sapiens
ttcacaagaggaggg

SEQ ID NO: 21277 - DNA, 15 bp, Homo sapiens
gttcacaagaggagg

SEQ ID NO: 21278 - DNA, 15 bp, Homo sapiens
agttcacaagaggag

SEQ ID NO: 21279 - DNA, 15 bp, Homo sapiens
cagttcacaagagga

SEQ ID NO: 21280 - DNA, 15 bp, Homo sapiens
acagttcacaagagg

SEQ ID NO: 21281 - DNA, 15 bp, Homo sapiens
cacagttcacaagag

SEQ ID NO: 21282 - DNA, 15 bp, Homo sapiens
gcacagttcacaaga

SEQ ID NO: 21283 - DNA, 15 bp, Homo sapiens
ggcacagttcacaag

SEQ ID NO: 21284 - DNA, 15 bp, Homo sapiens
gggcacagttcacaa

SEQ ID NO: 21285 - DNA, 15 bp, Homo sapiens
tgggcacagttcaca

SEQ ID NO: 21286 - DNA, 15 bp, Homo sapiens
atgggcacagttcac

SEQ ID NO: 21287 - DNA, 15 bp, Homo sapiens
gatgggcacagttca

SEQ ID NO: 21288 - DNA, 15 bp, Homo sapiens
tgatgggcacagttc

SEQ ID NO: 21289 - DNA, 15 bp, Homo sapiens
gtgatgggcacagtt

SEQ ID NO: 21290 - DNA, 15 bp, Homo sapiens
ggtgatgggcacagt

SEQ ID NO: 21291 - DNA, 15 bp, Homo sapiens
tggtgatgggcacag

SEQ ID NO: 21292 - DNA, 15 bp, Homo sapiens
ctggtgatgggcaca

SEQ ID NO: 21293 - DNA, 15 bp, Homo sapiens
tctggtgatgggcac

SEQ ID NO: 21294 - DNA, 15 bp, Homo sapiens
gtctggtgatgggca

SEQ ID NO: 21295 - DNA, 15 bp, Homo sapiens
cgtctggtgatgggc

SEQ ID NO: 21296 - DNA, 15 bp, Homo sapiens
tcgtctggtgatggg

SEQ ID NO: 21297 - DNA, 15 bp, Homo sapiens
ttcgtctggtgatgg

SEQ ID NO: 21298 - DNA, 15 bp, Homo sapiens
gttcgtctggtgatg

SEQ ID NO: 21299 - DNA, 15 bp, Homo sapiens
agttcgtctggtgat

SEQ ID NO: 21300 - DNA, 15 bp, Homo sapiens
aagttcgtctggtga

SEQ ID NO: 21301 - DNA, 15 bp, Homo sapiens
caagttcgtctggtg

SEQ ID NO: 21302 - DNA, 15 bp, Homo sapiens
acaagttcgtctggt

SEQ ID NO: 21303 - DNA, 15 bp, Homo sapiens
aacaagttcgtctgg

SEQ ID NO: 21304 - DNA, 15 bp, Homo sapiens
aaacaagttcgtctg

SEQ ID NO: 21305 - DNA, 15 bp, Homo sapiens
aaaacaagttcgtct

SEQ ID NO: 21306 - DNA, 15 bp, Homo sapiens
taaaacaagttcgtc

SEQ ID NO: 21307 - DNA, 15 bp, Homo sapiens
ctaaaacaagttcgt

SEQ ID NO: 21308 - DNA, 15 bp, Homo sapiens
tctaaaacaagttcg

SEQ ID NO: 21309 - DNA, 15 bp, Homo sapiens
ttctaaaacaagttc

SEQ ID NO: 21310 - DNA, 15 bp, Homo sapiens
attctaaaacaagtt

SEQ ID NO: 21311 - DNA, 15 bp, Homo sapiens
aattctaaaacaagt

SEQ ID NO: 21312 - DNA, 15 bp, Homo sapiens
aaattctaaaacaag

SEQ ID NO: 21313 - DNA, 15 bp, Homo sapiens
taaattctaaaacaa

SEQ ID NO: 21314 - DNA, 15 bp, Homo sapiens
gtaaattctaaaaca

SEQ ID NO: 21315 - DNA, 15 bp, Homo sapiens
ggtaaattctaaaac

SEQ ID NO: 21316 - DNA, 15 bp, Homo sapiens
tggtaaattctaaaa

SEQ ID NO: 21317 - DNA, 15 bp, Homo sapiens
atggtaaattctaaa

SEQ ID NO: 21318 - DNA, 15 bp, Homo sapiens
gatggtaaattctaa

SEQ ID NO: 21319 - DNA, 15 bp, Homo sapiens
cgatggtaaattcta

SEQ ID NO: 21320 - DNA, 15 bp, Homo sapiens
acgatggtaaattct

SEQ ID NO: 21321 - DNA, 15 bp, Homo sapiens
tacgatggtaaattc

SEQ ID NO: 21322 - DNA, 15 bp, Homo sapiens
ttacgatggtaaatt

SEQ ID NO: 21323 - DNA, 15 bp, Homo sapiens
gttacgatggtaaat

SEQ ID NO: 21324 - DNA, 15 bp, Homo sapiens
agttacgatggtaaa

SEQ ID NO: 21325 - DNA, 15 bp, Homo sapiens
cagttacgatggtaa

SEQ ID NO: 21326 - DNA, 15 bp, Homo sapiens
tcagttacgatggta

SEQ ID NO: 21327 - DNA, 15 bp, Homo sapiens
ctcagttacgatggt

SEQ ID NO: 21328 - DNA, 15 bp, Homo sapiens
gctcagttacgatgg

SEQ ID NO: 21329 - DNA, 15 bp, Homo sapiens
agctcagttacgatg

SEQ ID NO: 21330 - DNA, 15 bp, Homo sapiens
gagctcagttacgat

SEQ ID NO: 21331 - DNA, 15 bp, Homo sapiens
ggagctcagttacga

SEQ ID NO: 21332 - DNA, 15 bp, Homo sapiens
gggagctcagttacg

SEQ ID NO: 21333 - DNA, 15 bp, Homo sapiens
agggagctcagttac

SEQ ID NO: 21334 - DNA, 15 bp, Homo sapiens
aagggagctcagtta

SEQ ID NO: 21335 - DNA, 15 bp, Homo sapiens
gaagggagctcagtt

SEQ ID NO: 21336 - DNA, 15 bp, Homo sapiens
tgaagggagctcagt

SEQ ID NO: 21337 - DNA, 15 bp, Homo sapiens
ctgaagggagctcag

SEQ ID NO: 21338 - DNA, 15 bp, Homo sapiens
gctgaagggagctca

SEQ ID NO: 21339 - DNA, 15 bp, Homo sapiens
cgctgaagggagctc

SEQ ID NO: 21340 - DNA, 15 bp, Homo sapiens
gcgctgaagggagct

SEQ ID NO: 21341 - DNA, 15 bp, Homo sapiens
tgcgctgaagggagc

SEQ ID NO: 21342 - DNA, 15 bp, Homo sapiens
atgcgctgaagggag

SEQ ID NO: 21343 - DNA, 15 bp, Homo sapiens
tatgcgctgaaggga

SEQ ID NO: 21344 - DNA, 15 bp, Homo sapiens
gtatgcgctgaaggg

SEQ ID NO: 21345 - DNA, 15 bp, Homo sapiens
ggtatgcgctgaagg

SEQ ID NO: 21346 - DNA, 15 bp, Homo sapiens
aggtatgcgctgaag

SEQ ID NO: 21347 - DNA, 15 bp, Homo sapiens
gaggtatgcgctgaa

SEQ ID NO: 21348 - DNA, 15 bp, Homo sapiens
ggaggtatgcgctga

SEQ ID NO: 21349 - DNA, 15 bp, Homo sapiens
aggaggtatgcgctg

SEQ ID NO: 21350 - DNA, 15 bp, Homo sapiens
aaggaggtatgcgct

SEQ ID NO: 21351 - DNA, 15 bp, Homo sapiens
caaggaggtatgcgc

SEQ ID NO: 21352 - DNA, 15 bp, Homo sapiens
ccaaggaggtatgcg

SEQ ID NO: 21353 - DNA, 15 bp, Homo sapiens
gccaaggaggtatgc

SEQ ID NO: 21354 - DNA, 15 bp, Homo sapiens
agccaaggaggtatg

SEQ ID NO: 21355 - DNA, 15 bp, Homo sapiens
gagccaaggaggtat

SEQ ID NO: 21356 - DNA, 15 bp, Homo sapiens
ggagccaaggaggta

SEQ ID NO: 21357 - DNA, 15 bp, Homo sapiens
aggagccaaggaggt

SEQ ID NO: 21358 - DNA, 15 bp, Homo sapiens
caggagccaaggagg

SEQ ID NO: 21359 - DNA, 15 bp, Homo sapiens
gcaggagccaaggag

SEQ ID NO: 21360 - DNA, 15 bp, Homo sapiens
agcaggagccaagga

SEQ ID NO: 21361 - DNA, 15 bp, Homo sapiens
gagcaggagccaagg

SEQ ID NO: 21362 - DNA, 15 bp, Homo sapiens
tgagcaggagccaag

SEQ ID NO: 21363 - DNA, 15 bp, Homo sapiens
ctgagcaggagccaa

SEQ ID NO: 21364 - DNA, 15 bp, Homo sapiens
actgagcaggagcca

SEQ ID NO: 21365 - DNA, 15 bp, Homo sapiens
gactgagcaggagcc

SEQ ID NO: 21366 - DNA, 15 bp, Homo sapiens
agactgagcaggagc

SEQ ID NO: 21367 - DNA, 15 bp, Homo sapiens
gagactgagcaggag

SEQ ID NO: 21368 - DNA, 15 bp, Homo sapiens
agagactgagcagga

SEQ ID NO: 21369 - DNA, 15 bp, Homo sapiens
cagagactgagcagg

SEQ ID NO: 21370 - DNA, 15 bp, Homo sapiens
acagagactgagcag

SEQ ID NO: 21371 - DNA, 15 bp, Homo sapiens
aacagagactgagca

SEQ ID NO: 21372 - DNA, 15 bp, Homo sapiens
aaacagagactgagc

SEQ ID NO: 21373 - DNA, 15 bp, Homo sapiens
gaaacagagactgag

SEQ ID NO: 21374 - DNA, 15 bp, Homo sapiens
agaaacagagactga

SEQ ID NO: 21375 - DNA, 15 bp, Homo sapiens
gagaaacagagactg

SEQ ID NO: 21376 - DNA, 15 bp, Homo sapiens
ggagaaacagagact

SEQ ID NO: 21377 - DNA, 15 bp, Homo sapiens
aggagaaacagagac

SEQ ID NO: 21378 - DNA, 15 bp, Homo sapiens
aaggagaaacagaga

SEQ ID NO: 21379 - DNA, 15 bp, Homo sapiens
aaaggagaaacagag

SEQ ID NO: 21380 - DNA, 15 bp, Homo sapiens
aaaaggagaaacaga

SEQ ID NO: 21381 - DNA, 15 bp, Homo sapiens
taaaaggagaaacag

SEQ ID NO: 21382 - DNA, 15 bp, Homo sapiens
ctaaaaggagaaaca

SEQ ID NO: 21383 - DNA, 15 bp, Homo sapiens
gctaaaaggagaaac

SEQ ID NO: 21384 - DNA, 15 bp, Homo sapiens
ggctaaaaggagaaa

SEQ ID NO: 21385 - DNA, 15 bp, Homo sapiens
tggctaaaaggagaa

SEQ ID NO: 21386 - DNA, 15 bp, Homo sapiens
ttggctaaaaggaga

SEQ ID NO: 21387 - DNA, 15 bp, Homo sapiens
tttggctaaaaggag

SEQ ID NO: 21388 - DNA, 15 bp, Homo sapiens
gtttggctaaaagga

SEQ ID NO: 21389 - DNA, 15 bp, Homo sapiens
agtttggctaaaagg

SEQ ID NO: 21390 - DNA, 15 bp, Homo sapiens
gagtttggctaaaag

SEQ ID NO: 21391 - DNA, 15 bp, Homo sapiens
agagtttggctaaaa

SEQ ID NO: 21392 - DNA, 15 bp, Homo sapiens
gagagtttggctaaa

SEQ ID NO: 21393 - DNA, 15 bp, Homo sapiens
agagagtttggctaa

SEQ ID NO: 21394 - DNA, 15 bp, Homo sapiens
tagagagtttggcta

SEQ ID NO: 21395 - DNA, 15 bp, Homo sapiens
ttagagagtttggct

SEQ ID NO: 21396 - DNA, 15 bp, Homo sapiens
cttagagagtttggc

SEQ ID NO: 21397 - DNA, 15 bp, Homo sapiens
tcttagagagtttgg

SEQ ID NO: 21398 - DNA, 15 bp, Homo sapiens
ctcttagagagtttg

SEQ ID NO: 21399 - DNA, 15 bp, Homo sapiens
actcttagagagttt

SEQ ID NO: 21400 - DNA, 15 bp, Homo sapiens
aactcttagagagtt

SEQ ID NO: 21401 - DNA, 15 bp, Homo sapiens
gaactcttagagagt

SEQ ID NO: 21402 - DNA, 15 bp, Homo sapiens
agaactcttagagag

SEQ ID NO: 21403 - DNA, 15 bp, Homo sapiens
gagaactcttagaga

SEQ ID NO: 21404 - DNA, 15 bp, Homo sapiens
agagaactcttagag

SEQ ID NO: 21405 - DNA, 15 bp, Homo sapiens
gagagaactcttaga

SEQ ID NO: 21406 - DNA, 15 bp, Homo sapiens
ggagagaactcttag

SEQ ID NO: 21407 - DNA, 15 bp, Homo sapiens
tggagagaactctta

SEQ ID NO: 21408 - DNA, 15 bp, Homo sapiens
gtggagagaactctt

SEQ ID NO: 21409 - DNA, 15 bp, Homo sapiens
agtggagagaactct

SEQ ID NO: 21410 - DNA, 15 bp, Homo sapiens
gagtggagagaactc

SEQ ID NO: 21411 - DNA, 15 bp, Homo sapiens
tgagtggagagaact

SEQ ID NO: 21412 - DNA, 15 bp, Homo sapiens
atgagtggagagaac

SEQ ID NO: 21413 - DNA, 15 bp, Homo sapiens
catgagtggagagaa

SEQ ID NO: 21414 - DNA, 15 bp, Homo sapiens
ccatgagtggagaga

SEQ ID NO: 21415 - DNA, 15 bp, Homo sapiens
cccatgagtggagag

SEQ ID NO: 21416 - DNA, 15 bp, Homo sapiens
gcccatgagtggaga

SEQ ID NO: 21417 - DNA, 15 bp, Homo sapiens
ggcccatgagtggag

SEQ ID NO: 21418 - DNA, 15 bp, Homo sapiens
gggcccatgagtgga

SEQ ID NO: 21419 - DNA, 15 bp, Homo sapiens
agggcccatgagtgg

SEQ ID NO: 21420 - DNA, 15 bp, Homo sapiens
gagggcccatgagtg

SEQ ID NO: 21421 - DNA, 15 bp, Homo sapiens
agagggcccatgagt

SEQ ID NO: 21422 - DNA, 15 bp, Homo sapiens
aagagggcccatgag

SEQ ID NO: 21423 - DNA, 15 bp, Homo sapiens
gaagagggcccatga

SEQ ID NO: 21424 - DNA, 15 bp, Homo sapiens
ggaagagggcccatg

SEQ ID NO: 21425 - DNA, 15 bp, Homo sapiens
aggaagagggcccat

SEQ ID NO: 21426 - DNA, 15 bp, Homo sapiens
aaggaagagggccca

SEQ ID NO: 21427 - DNA, 15 bp, Homo sapiens
caaggaagagggccc

SEQ ID NO: 21428 - DNA, 15 bp, Homo sapiens
gcaaggaagagggcc

SEQ ID NO: 21429 - DNA, 15 bp, Homo sapiens
ggcaaggaagagggc

SEQ ID NO: 21430 - DNA, 15 bp, Homo sapiens
aggcaaggaagaggg

SEQ ID NO: 21431 - DNA, 15 bp, Homo sapiens
caggcaaggaagagg

SEQ ID NO: 21432 - DNA, 15 bp, Homo sapiens
gcaggcaaggaagag

SEQ ID NO: 21433 - DNA, 15 bp, Homo sapiens
agcaggcaaggaaga

SEQ ID NO: 21434 - DNA, 15 bp, Homo sapiens
cagcaggcaaggaag

SEQ ID NO: 21435 - DNA, 15 bp, Homo sapiens
gcagcaggcaaggaa

SEQ ID NO: 21436 - DNA, 15 bp, Homo sapiens
agcagcaggcaagga

SEQ ID NO: 21437 - DNA, 15 bp, Homo sapiens
gagcagcaggcaagg

SEQ ID NO: 21438 - DNA, 15 bp, Homo sapiens
ggagcagcaggcaag

SEQ ID NO: 21439 - DNA, 15 bp, Homo sapiens
aggagcagcaggcaa

SEQ ID NO: 21440 - DNA, 15 bp, Homo sapiens
aaggagcagcaggca

SEQ ID NO: 21441 - DNA, 15 bp, Homo sapiens
caaggagcagcaggc

SEQ ID NO: 21442 - DNA, 15 bp, Homo sapiens
gcaaggagcagcagg

SEQ ID NO: 21443 - DNA, 15 bp, Homo sapiens
agcaaggagcagcag

SEQ ID NO: 21444 - DNA, 15 bp, Homo sapiens
gagcaaggagcagca

SEQ ID NO: 21445 - DNA, 15 bp, Homo sapiens
tgagcaaggagcagc

SEQ ID NO: 21446 - DNA, 15 bp, Homo sapiens
ctgagcaaggagcag

SEQ ID NO: 21447 - DNA, 15 bp, Homo sapiens
gctgagcaaggagca

SEQ ID NO: 21448 - DNA, 15 bp, Homo sapiens
agctgagcaaggagc

SEQ ID NO: 21449 - DNA, 15 bp, Homo sapiens
aagctgagcaaggag

SEQ ID NO: 21450 - DNA, 15 bp, Homo sapiens
caagctgagcaagga

SEQ ID NO: 21451 - DNA, 15 bp, Homo sapiens
gcaagctgagcaagg

SEQ ID NO: 21452 - DNA, 15 bp, Homo sapiens
agcaagctgagcaag

SEQ ID NO: 21453 - DNA, 15 bp, Homo sapiens
gagcaagctgagcaa

SEQ ID NO: 21454 - DNA, 15 bp, Homo sapiens
ggagcaagctgagca

SEQ ID NO: 21455 - DNA, 15 bp, Homo sapiens
tggagcaagctgagc

SEQ ID NO: 21456 - DNA, 15 bp, Homo sapiens
atggagcaagctgag

SEQ ID NO: 21457 - DNA, 15 bp, Homo sapiens
catggagcaagctga

SEQ ID NO: 21458 - DNA, 15 bp, Homo sapiens
tcatggagcaagctg

SEQ ID NO: 21459 - DNA, 15 bp, Homo sapiens
ttcatggagcaagct

SEQ ID NO: 21460 - DNA, 15 bp, Homo sapiens
gttcatggagcaagc

SEQ ID NO: 21461 - DNA, 15 bp, Homo sapiens
tgttcatggagcaag

SEQ ID NO: 21462 - DNA, 15 bp, Homo sapiens
gtgttcatggagcaa

SEQ ID NO: 21463 - DNA, 15 bp, Homo sapiens
agtgttcatggagca

SEQ ID NO: 21464 - DNA, 15 bp, Homo sapiens
aagtgttcatggagc

SEQ ID NO: 21465 - DNA, 15 bp, Homo sapiens
caagtgttcatggag

SEQ ID NO: 21466 - DNA, 15 bp, Homo sapiens
gcaagtgttcatgga

SEQ ID NO: 21467 - DNA, 15 bp, Homo sapiens
agcaagtgttcatgg

SEQ ID NO: 21468 - DNA, 15 bp, Homo sapiens
aagcaagtgttcatg

SEQ ID NO: 21469 - DNA, 15 bp, Homo sapiens
aaagcaagtgttcat

SEQ ID NO: 21470 - DNA, 15 bp, Homo sapiens
aaaagcaagtgttca

SEQ ID NO: 21471 - DNA, 15 bp, Homo sapiens
gaaaagcaagtgttc

SEQ ID NO: 21472 - DNA, 15 bp, Homo sapiens
ggaaaagcaagtgtt

SEQ ID NO: 21473 - DNA, 15 bp, Homo sapiens
tggaaaagcaagtgt

SEQ ID NO: 21474 - DNA, 15 bp, Homo sapiens
gtggaaaagcaagtg

SEQ ID NO: 21475 - DNA, 15 bp, Homo sapiens
tgtggaaaagcaagt

SEQ ID NO: 21476 - DNA, 15 bp, Homo sapiens
atgtggaaaagcaag

SEQ ID NO: 21477 - DNA, 15 bp, Homo sapiens
aatgtggaaaagcaa

SEQ ID NO: 21478 - DNA, 15 bp, Homo sapiens
gaatgtggaaaagca

SEQ ID NO: 21479 - DNA, 15 bp, Homo sapiens
ggaatgtggaaaagc

SEQ ID NO: 21480 - DNA, 15 bp, Homo sapiens
tggaatgtggaaaag

SEQ ID NO: 21481 - DNA, 15 bp, Homo sapiens
atggaatgtggaaaa

SEQ ID NO: 21482 - DNA, 15 bp, Homo sapiens
catggaatgtggaaa

SEQ ID NO: 21483 - DNA, 15 bp, Homo sapiens
tcatggaatgtggaa

SEQ ID NO: 21484 - DNA, 15 bp, Homo sapiens
ttcatggaatgtgga

SEQ ID NO: 21485 - DNA, 15 bp, Homo sapiens
tttcatggaatgtgg

SEQ ID NO: 21486 - DNA, 15 bp, Homo sapiens
atttcatggaatgtg

SEQ ID NO: 21487 - DNA, 15 bp, Homo sapiens
tatttcatggaatgt

SEQ ID NO: 21488 - DNA, 15 bp, Homo sapiens
ttatttcatggaatg

SEQ ID NO: 21489 - DNA, 15 bp, Homo sapiens
attatttcatggaat

SEQ ID NO: 21490 - DNA, 15 bp, Homo sapiens
gattatttcatggaa

SEQ ID NO: 21491 - DNA, 15 bp, Homo sapiens
agattatttcatgga

SEQ ID NO: 21492 - DNA, 15 bp, Homo sapiens
aagattatttcatgg

SEQ ID NO: 21493 - DNA, 15 bp, Homo sapiens
taagattatttcatg

SEQ ID NO: 21494 - DNA, 15 bp, Homo sapiens
ttaagattatttcat

SEQ ID NO: 21495 - DNA, 15 bp, Homo sapiens
gttaagattatttca

SEQ ID NO: 21496 - DNA, 15 bp, Homo sapiens
tgttaagattatttc

SEQ ID NO: 21497 - DNA, 15 bp, Homo sapiens
ctgttaagattattt

SEQ ID NO: 21498 - DNA, 15 bp, Homo sapiens
actgttaagattatt

SEQ ID NO: 21499 - DNA, 15 bp, Homo sapiens
gactgttaagattat

SEQ ID NO: 21500 - DNA, 15 bp, Homo sapiens
tgactgttaagatta

SEQ ID NO: 21501 - DNA, 15 bp, Homo sapiens
atgactgttaagatt

SEQ ID NO: 21502 - DNA, 15 bp, Homo sapiens
gatgactgttaagat

SEQ ID NO: 21503 - DNA, 15 bp, Homo sapiens
tgatgactgttaaga

SEQ ID NO: 21504 - DNA, 15 bp, Homo sapiens
ctgatgactgttaag

SEQ ID NO: 21505 - DNA, 15 bp, Homo sapiens
actgatgactgttaa

SEQ ID NO: 21506 - DNA, 15 bp, Homo sapiens
cactgatgactgtta

SEQ ID NO: 21507 - DNA, 15 bp, Homo sapiens
ccactgatgactgtt

SEQ ID NO: 21508 - DNA, 15 bp, Homo sapiens
gccactgatgactgt

SEQ ID NO: 21509 - DNA, 15 bp, Homo sapiens
agccactgatgactg

SEQ ID NO: 21510 - DNA, 15 bp, Homo sapiens
cagccactgatgact

SEQ ID NO: 21511 - DNA, 15 bp, Homo sapiens
acagccactgatgac

SEQ ID NO: 21512 - DNA, 15 bp, Homo sapiens
gacagccactgatga

SEQ ID NO: 21513 - DNA, 15 bp, Homo sapiens
tgacagccactgatg

SEQ ID NO: 21514 - DNA, 15 bp, Homo sapiens
gtgacagccactgat

SEQ ID NO: 21515 - DNA, 15 bp, Homo sapiens
agtgacagccactga

SEQ ID NO: 21516 - DNA, 15 bp, Homo sapiens
gagtgacagccactg

SEQ ID NO: 21517 - DNA, 15 bp, Homo sapiens
ggagtgacagccact

SEQ ID NO: 21518 - DNA, 15 bp, Homo sapiens
aggagtgacagccac

SEQ ID NO: 21519 - DNA, 15 bp, Homo sapiens
aaggagtgacagcca

SEQ ID NO: 21520 - DNA, 15 bp, Homo sapiens
gaaggagtgacagcc

SEQ ID NO: 21521 - DNA, 15 bp, Homo sapiens
agaaggagtgacagc

SEQ ID NO: 21522 - DNA, 15 bp, Homo sapiens
gagaaggagtgacag

SEQ ID NO: 21523 - DNA, 15 bp, Homo sapiens
tgagaaggagtgaca

SEQ ID NO: 21524 - DNA, 15 bp, Homo sapiens
ctgagaaggagtgac

SEQ ID NO: 21525 - DNA, 15 bp, Homo sapiens
gctgagaaggagtga

SEQ ID NO: 21526 - DNA, 15 bp, Homo sapiens
ggctgagaaggagtg

SEQ ID NO: 21527 - DNA, 15 bp, Homo sapiens
gggctgagaaggagt

SEQ ID NO: 21528 - DNA, 15 bp, Homo sapiens
agggctgagaaggag

SEQ ID NO: 21529 - DNA, 15 bp, Homo sapiens
aagggctgagaagga

SEQ ID NO: 21530 - DNA, 15 bp, Homo sapiens
aaagggctgagaagg

SEQ ID NO: 21531 - DNA, 15 bp, Homo sapiens
gaaagggctgagaag

SEQ ID NO: 21532 - DNA, 15 bp, Homo sapiens
ggaaagggctgagaa

SEQ ID NO: 21533 - DNA, 15 bp, Homo sapiens
aggaaagggctgaga

SEQ ID NO: 21534 - DNA, 15 bp, Homo sapiens
aaggaaagggctgag

SEQ ID NO: 21535 - DNA, 15 bp, Homo sapiens
caaggaaagggctga

SEQ ID NO: 21536 - DNA, 15 bp, Homo sapiens
acaaggaaagggctg

SEQ ID NO: 21537 - DNA, 15 bp, Homo sapiens
cacaaggaaagggct

SEQ ID NO: 21538 - DNA, 15 bp, Homo sapiens
acacaaggaaagggc

SEQ ID NO: 21539 - DNA, 15 bp, Homo sapiens
gacacaaggaaaggg

SEQ ID NO: 21540 - DNA, 15 bp, Homo sapiens
agacacaaggaaagg

SEQ ID NO: 21541 - DNA, 15 bp, Homo sapiens
gagacacaaggaaag

SEQ ID NO: 21542 - DNA, 15 bp, Homo sapiens
agagacacaaggaaa

SEQ ID NO: 21543 - DNA, 15 bp, Homo sapiens
aagagacacaaggaa

SEQ ID NO: 21544 - DNA, 15 bp, Homo sapiens
gaagagacacaagga

SEQ ID NO: 21545 - DNA, 15 bp, Homo sapiens
agaagagacacaagg

SEQ ID NO: 21546 - DNA, 15 bp, Homo sapiens
cagaagagacacaag

SEQ ID NO: 21547 - DNA, 15 bp, Homo sapiens
ccagaagagacacaa

SEQ ID NO: 21548 - DNA, 15 bp, Homo sapiens
accagaagagacaca

SEQ ID NO: 21549 - DNA, 15 bp, Homo sapiens
taccagaagagacac

SEQ ID NO: 21550 - DNA, 15 bp, Homo sapiens
gtaccagaagagaca

SEQ ID NO: 21551 - DNA, 15 bp, Homo sapiens
ggtaccagaagagac

SEQ ID NO: 21552 - DNA, 15 bp, Homo sapiens
aggtaccagaagaga

SEQ ID NO: 21553 - DNA, 15 bp, Homo sapiens
gaggtaccagaagag

SEQ ID NO: 21554 - DNA, 15 bp, Homo sapiens
tgaggtaccagaaga

SEQ ID NO: 21555 - DNA, 15 bp, Homo sapiens
atgaggtaccagaag

SEQ ID NO: 21556 - DNA, 15 bp, Homo sapiens
tatgaggtaccagaa

SEQ ID NO: 21557 - DNA, 15 bp, Homo sapiens
gtatgaggtaccaga

SEQ ID NO: 21558 - DNA, 15 bp, Homo sapiens
agtatgaggtaccag

SEQ ID NO: 21559 - DNA, 15 bp, Homo sapiens
gagtatgaggtacca

SEQ ID NO: 21560 - DNA, 15 bp, Homo sapiens
agagtatgaggtacc

SEQ ID NO: 21561 - DNA, 15 bp, Homo sapiens
gagagtatgaggtac

SEQ ID NO: 21562 - DNA, 15 bp, Homo sapiens
ggagagtatgaggta

SEQ ID NO: 21563 - DNA, 15 bp, Homo sapiens
tggagagtatgaggt

SEQ ID NO: 21564 - DNA, 15 bp, Homo sapiens
ctggagagtatgagg

SEQ ID NO: 21565 - DNA, 15 bp, Homo sapiens
cctggagagtatgag

SEQ ID NO: 21566 - DNA, 15 bp, Homo sapiens
acctggagagtatga

SEQ ID NO: 21567 - DNA, 15 bp, Homo sapiens
cacctggagagtatg

SEQ ID NO: 21568 - DNA, 15 bp, Homo sapiens
ccacctggagagtat

SEQ ID NO: 21569 - DNA, 15 bp, Homo sapiens
gccacctggagagta

SEQ ID NO: 21570 - DNA, 15 bp, Homo sapiens
ggccacctggagagt

SEQ ID NO: 21571 - DNA, 15 bp, Homo sapiens
tggccacctggagag

SEQ ID NO: 21572 - DNA, 15 bp, Homo sapiens
atggccacctggaga

SEQ ID NO: 21573 - DNA, 15 bp, Homo sapiens
gatggccacctggag

SEQ ID NO: 21574 - DNA, 15 bp, Homo sapiens
agatggccacctgga

SEQ ID NO: 21575 - DNA, 15 bp, Homo sapiens
gagatggccacctgg

SEQ ID NO: 21576 - DNA, 15 bp, Homo sapiens
tgagatggccacctg

SEQ ID NO: 21577 - DNA, 15 bp, Homo sapiens
gtgagatggccacct

SEQ ID NO: 21578 - DNA, 15 bp, Homo sapiens
ggtgagatggccacc

SEQ ID NO: 21579 - DNA, 15 bp, Homo sapiens
aggtgagatggccac

SEQ ID NO: 21580 - DNA, 15 bp, Homo sapiens
gaggtgagatggcca

SEQ ID NO: 21581 - DNA, 15 bp, Homo sapiens
tgaggtgagatggcc

SEQ ID NO: 21582 - DNA, 15 bp, Homo sapiens
gtgaggtgagatggc

SEQ ID NO: 21583 - DNA, 15 bp, Homo sapiens
tgtgaggtgagatgg

SEQ ID NO: 21584 - DNA, 15 bp, Homo sapiens
atgtgaggtgagatg

SEQ ID NO: 21585 - DNA, 15 bp, Homo sapiens
gatgtgaggtgagat

SEQ ID NO: 21586 - DNA, 15 bp, Homo sapiens
agatgtgaggtgaga

SEQ ID NO: 21587 - DNA, 15 bp, Homo sapiens
aagatgtgaggtgag

SEQ ID NO: 21588 - DNA, 15 bp, Homo sapiens
caagatgtgaggtga

SEQ ID NO: 21589 - DNA, 15 bp, Homo sapiens
tcaagatgtgaggtg

SEQ ID NO: 21590 - DNA, 15 bp, Homo sapiens
ttcaagatgtgaggt

SEQ ID NO: 21591 - DNA, 15 bp, Homo sapiens
gttcaagatgtgagg

SEQ ID NO: 21592 - DNA, 15 bp, Homo sapiens
ggttcaagatgtgag

SEQ ID NO: 21593 - DNA, 15 bp, Homo sapiens
gggttcaagatgtga

SEQ ID NO: 21594 - DNA, 15 bp, Homo sapiens
agggttcaagatgtg

SEQ ID NO: 21595 - DNA, 15 bp, Homo sapiens
gagggttcaagatgt

SEQ ID NO: 21596 - DNA, 15 bp, Homo sapiens
agagggttcaagatg

SEQ ID NO: 21597 - DNA, 15 bp, Homo sapiens
cagagggttcaagat

SEQ ID NO: 21598 - DNA, 15 bp, Homo sapiens
ccagagggttcaaga

SEQ ID NO: 21599 - DNA, 15 bp, Homo sapiens
cccagagggttcaag

SEQ ID NO: 21600 - DNA, 15 bp, Homo sapiens
acccagagggttcaa

SEQ ID NO: 21601 - DNA, 15 bp, Homo sapiens
aacccagagggttca

SEQ ID NO: 21602 - DNA, 15 bp, Homo sapiens
aaacccagagggttc

SEQ ID NO: 21603 - DNA, 15 bp, Homo sapiens
caaacccagagggtt

SEQ ID NO: 21604 - DNA, 15 bp, Homo sapiens
ccaaacccagagggt

SEQ ID NO: 21605 - DNA, 15 bp, Homo sapiens
cccaaacccagaggg

SEQ ID NO: 21606 - DNA, 15 bp, Homo sapiens
tcccaaacccagagg

SEQ ID NO: 21607 - DNA, 15 bp, Homo sapiens
ctcccaaacccagag

SEQ ID NO: 21608 - DNA, 15 bp, Homo sapiens
tctcccaaacccaga

SEQ ID NO: 21609 - DNA, 15 bp, Homo sapiens
ttctcccaaacccag

SEQ ID NO: 21610 - DNA, 15 bp, Homo sapiens
attctcccaaaccca

SEQ ID NO: 21611 - DNA, 15 bp, Homo sapiens
aattctcccaaaccc

SEQ ID NO: 21612 - DNA, 15 bp, Homo sapiens
gaattctcccaaacc

SEQ ID NO: 21613 - DNA, 15 bp, Homo sapiens
agaattctcccaaac

SEQ ID NO: 21614 - DNA, 15 bp, Homo sapiens
gagaattctcccaaa

SEQ ID NO: 21615 - DNA, 15 bp, Homo sapiens
tgagaattctcccaa

SEQ ID NO: 21616 - DNA, 15 bp, Homo sapiens
gtgagaattctccca

SEQ ID NO: 21617 - DNA, 15 bp, Homo sapiens
ggtgagaattctccc

SEQ ID NO: 21618 - DNA, 15 bp, Homo sapiens
aggtgagaattctcc

SEQ ID NO: 21619 - DNA, 15 bp, Homo sapiens
gaggtgagaattctc

SEQ ID NO: 21620 - DNA, 15 bp, Homo sapiens
tgaggtgagaattct

SEQ ID NO: 21621 - DNA, 15 bp, Homo sapiens
gtgaggtgagaattc

SEQ ID NO: 21622 - DNA, 15 bp, Homo sapiens
cgtgaggtgagaatt

SEQ ID NO: 21623 - DNA, 15 bp, Homo sapiens
tcgtgaggtgagaat

SEQ ID NO: 21624 - DNA, 15 bp, Homo sapiens
ctcgtgaggtgagaa

SEQ ID NO: 21625 - DNA, 15 bp, Homo sapiens
actcgtgaggtgaga

SEQ ID NO: 21626 - DNA, 15 bp, Homo sapiens
aactcgtgaggtgag

SEQ ID NO: 21627 - DNA, 15 bp, Homo sapiens
caactcgtgaggtga

SEQ ID NO: 21628 - DNA, 15 bp, Homo sapiens
tcaactcgtgaggtg

SEQ ID NO: 21629 - DNA, 15 bp, Homo sapiens
atcaactcgtgaggt

SEQ ID NO: 21630 - DNA, 15 bp, Homo sapiens
catcaactcgtgagg

SEQ ID NO: 21631 - DNA, 15 bp, Homo sapiens
ccatcaactcgtgag

SEQ ID NO: 21632 - DNA, 15 bp, Homo sapiens
cccatcaactcgtga

SEQ ID NO: 21633 - DNA, 15 bp, Homo sapiens
tcccatcaactcgtg

SEQ ID NO: 21634 - DNA, 15 bp, Homo sapiens
ctcccatcaactcgt

SEQ ID NO: 21635 - DNA, 15 bp, Homo sapiens
cctcccatcaactcg

SEQ ID NO: 21636 - DNA, 15 bp, Homo sapiens
gcctcccatcaactc

SEQ ID NO: 21637 - DNA, 15 bp, Homo sapiens
ggcctcccatcaact

SEQ ID NO: 21638 - DNA, 15 bp, Homo sapiens
aggcctcccatcaac

SEQ ID NO: 21639 - DNA, 15 bp, Homo sapiens
caggcctcccatcaa

SEQ ID NO: 21640 - DNA, 15 bp, Homo sapiens
ccaggcctcccatca

SEQ ID NO: 21641 - DNA, 15 bp, Homo sapiens
gccaggcctcccatc

SEQ ID NO: 21642 - DNA, 15 bp, Homo sapiens
cgccaggcctcccat

SEQ ID NO: 21643 - DNA, 15 bp, Homo sapiens
tcgccaggcctccca

SEQ ID NO: 21644 - DNA, 15 bp, Homo sapiens
gtcgccaggcctccc

SEQ ID NO: 21645 - DNA, 15 bp, Homo sapiens
ggtcgccaggcctcc

SEQ ID NO: 21646 - DNA, 15 bp, Homo sapiens
aggtcgccaggcctc

SEQ ID NO: 21647 - DNA, 15 bp, Homo sapiens
gaggtcgccaggcct

SEQ ID NO: 21648 - DNA, 15 bp, Homo sapiens
agaggtcgccaggcc

SEQ ID NO: 21649 - DNA, 15 bp, Homo sapiens
cagaggtcgccaggc

SEQ ID NO: 21650 - DNA, 15 bp, Homo sapiens
tcagaggtcgccagg

SEQ ID NO: 21651 - DNA, 15 bp, Homo sapiens
atcagaggtcgccag

SEQ ID NO: 21652 - DNA, 15 bp, Homo sapiens
aatcagaggtcgcca

SEQ ID NO: 21653 - DNA, 15 bp, Homo sapiens
caatcagaggtcgcc

SEQ ID NO: 21654 - DNA, 15 bp, Homo sapiens
acaatcagaggtcgc

SEQ ID NO: 21655 - DNA, 15 bp, Homo sapiens
tacaatcagaggtcg

SEQ ID NO: 21656 - DNA, 15 bp, Homo sapiens
ctacaatcagaggtc

SEQ ID NO: 21657 - DNA, 15 bp, Homo sapiens
actacaatcagaggt

SEQ ID NO: 21658 - DNA, 15 bp, Homo sapiens
gactacaatcagagg

SEQ ID NO: 21659 - DNA, 15 bp, Homo sapiens
tgactacaatcagag

SEQ ID NO: 21660 - DNA, 15 bp, Homo sapiens
gtgactacaatcaga

SEQ ID NO: 21661 - DNA, 15 bp, Homo sapiens
agtgactacaatcag

SEQ ID NO: 21662 - DNA, 15 bp, Homo sapiens
cagtgactacaatca

SEQ ID NO: 21663 - DNA, 15 bp, Homo sapiens
gcagtgactacaatc

SEQ ID NO: 21664 - DNA, 15 bp, Homo sapiens
tgcagtgactacaat

SEQ ID NO: 21665 - DNA, 15 bp, Homo sapiens
ttgcagtgactacaa

SEQ ID NO: 21666 - DNA, 15 bp, Homo sapiens
tttgcagtgactaca

SEQ ID NO: 21667 - DNA, 15 bp, Homo sapiens
atttgcagtgactac

SEQ ID NO: 21668 - DNA, 15 bp, Homo sapiens
catttgcagtgacta

SEQ ID NO: 21669 - DNA, 15 bp, Homo sapiens
gcatttgcagtgact

SEQ ID NO: 21670 - DNA, 15 bp, Homo sapiens
ggcatttgcagtgac

SEQ ID NO: 21671 - DNA, 15 bp, Homo sapiens
tggcatttgcagtga

SEQ ID NO: 21672 - DNA, 15 bp, Homo sapiens
ctggcatttgcagtg

SEQ ID NO: 21673 - DNA, 15 bp, Homo sapiens
tctggcatttgcagt

SEQ ID NO: 21674 - DNA, 15 bp, Homo sapiens
atctggcatttgcag

SEQ ID NO: 21675 - DNA, 15 bp, Homo sapiens
catctggcatttgca

SEQ ID NO: 21676 - DNA, 15 bp, Homo sapiens
gcatctggcatttgc

SEQ ID NO: 21677 - DNA, 15 bp, Homo sapiens
agcatctggcatttg

SEQ ID NO: 21678 - DNA, 15 bp, Homo sapiens
aagcatctggcattt

SEQ ID NO: 21679 - DNA, 15 bp, Homo sapiens
taagcatctggcatt

SEQ ID NO: 21680 - DNA, 15 bp, Homo sapiens
ataagcatctggcat

SEQ ID NO: 21681 - DNA, 15 bp, Homo sapiens
aataagcatctggca

SEQ ID NO: 21682 - DNA, 15 bp, Homo sapiens
aaataagcatctggc

SEQ ID NO: 21683 - DNA, 15 bp, Homo sapiens
caaataagcatctgg

SEQ ID NO: 21684 - DNA, 15 bp, Homo sapiens
gcaaataagcatctg

SEQ ID NO: 21685 - DNA, 15 bp, Homo sapiens
ggcaaataagcatct

SEQ ID NO: 21686 - DNA, 15 bp, Homo sapiens
aggcaaataagcatc

SEQ ID NO: 21687 - DNA, 15 bp, Homo sapiens
taggcaaataagcat

SEQ ID NO: 21688 - DNA, 15 bp, Homo sapiens
ctaggcaaataagca

SEQ ID NO: 21689 - DNA, 15 bp, Homo sapiens
gctaggcaaataagc

SEQ ID NO: 21690 - DNA, 15 bp, Homo sapiens
agctaggcaaataag

SEQ ID NO: 21691 - DNA, 15 bp, Homo sapiens
aagctaggcaaataa

SEQ ID NO: 21692 - DNA, 15 bp, Homo sapiens
gaagctaggcaaata

SEQ ID NO: 21693 - DNA, 15 bp, Homo sapiens
ggaagctaggcaaat

SEQ ID NO: 21694 - DNA, 15 bp, Homo sapiens
gggaagctaggcaaa

SEQ ID NO: 21695 - DNA, 15 bp, Homo sapiens
agggaagctaggcaa

SEQ ID NO: 21696 - DNA, 15 bp, Homo sapiens
aagggaagctaggca

SEQ ID NO: 21697 - DNA, 15 bp, Homo sapiens
aaagggaagctaggc

SEQ ID NO: 21698 - DNA, 15 bp, Homo sapiens
gaaagggaagctagg

SEQ ID NO: 21699 - DNA, 15 bp, Homo sapiens
cgaaagggaagctag

SEQ ID NO: 21700 - DNA, 15 bp, Homo sapiens
ccgaaagggaagcta

SEQ ID NO: 21701 - DNA, 15 bp, Homo sapiens
accgaaagggaagct

SEQ ID NO: 21702 - DNA, 15 bp, Homo sapiens
gaccgaaagggaagc

SEQ ID NO: 21703 - DNA, 15 bp, Homo sapiens
tgaccgaaagggaag

SEQ ID NO: 21704 - DNA, 15 bp, Homo sapiens
ctgaccgaaagggaa

SEQ ID NO: 21705 - DNA, 15 bp, Homo sapiens
cctgaccgaaaggga

SEQ ID NO: 21706 - DNA, 15 bp, Homo sapiens
ccctgaccgaaaggg

SEQ ID NO: 21707 - DNA, 15 bp, Homo sapiens
gccctgaccgaaagg

SEQ ID NO: 21708 - DNA, 15 bp, Homo sapiens
tgccctgaccgaaag

SEQ ID NO: 21709 - DNA, 15 bp, Homo sapiens
ctgccctgaccgaaa

SEQ ID NO: 21710 - DNA, 15 bp, Homo sapiens
gctgccctgaccgaa

SEQ ID NO: 21711 - DNA, 15 bp, Homo sapiens
tgctgccctgaccga

SEQ ID NO: 21712 - DNA, 15 bp, Homo sapiens
ctgctgccctgaccg

SEQ ID NO: 21713 - DNA, 15 bp, Homo sapiens
actgctgccctgacc

SEQ ID NO: 21714 - DNA, 15 bp, Homo sapiens
aactgctgccctgac

SEQ ID NO: 21715 - DNA, 15 bp, Homo sapiens
caactgctgccctga

SEQ ID NO: 21716 - DNA, 15 bp, Homo sapiens
ccaactgctgccctg

SEQ ID NO: 21717 - DNA, 15 bp, Homo sapiens
gccaactgctgccct

SEQ ID NO: 21718 - DNA, 15 bp, Homo sapiens
tgccaactgctgccc

SEQ ID NO: 21719 - DNA, 15 bp, Homo sapiens
ttgccaactgctgcc

SEQ ID NO: 21720 - DNA, 15 bp, Homo sapiens
tttgccaactgctgc

SEQ ID NO: 21721 - DNA, 15 bp, Homo sapiens
gtttgccaactgctg

SEQ ID NO: 21722 - DNA, 15 bp, Homo sapiens
cgtttgccaactgct

SEQ ID NO: 21723 - DNA, 15 bp, Homo sapiens
ccgtttgccaactgc

SEQ ID NO: 21724 - DNA, 15 bp, Homo sapiens
accgtttgccaactg

SEQ ID NO: 21725 - DNA, 15 bp, Homo sapiens
taccgtttgccaact

SEQ ID NO: 21726 - DNA, 15 bp, Homo sapiens
ataccgtttgccaac

SEQ ID NO: 21727 - DNA, 15 bp, Homo sapiens
gataccgtttgccaa

SEQ ID NO: 21728 - DNA, 15 bp, Homo sapiens
agataccgtttgcca

SEQ ID NO: 21729 - DNA, 15 bp, Homo sapiens
gagataccgtttgcc

SEQ ID NO: 21730 - DNA, 15 bp, Homo sapiens
tgagataccgtttgc

SEQ ID NO: 21731 - DNA, 15 bp, Homo sapiens
ttgagataccgtttg

SEQ ID NO: 21732 - DNA, 15 bp, Homo sapiens
cttgagataccgttt

SEQ ID NO: 21733 - DNA, 15 bp, Homo sapiens
ccttgagataccgtt

SEQ ID NO: 21734 - DNA, 15 bp, Homo sapiens
cccttgagataccgt

SEQ ID NO: 21735 - DNA, 15 bp, Homo sapiens
gcccttgagataccg

SEQ ID NO: 21736 - DNA, 15 bp, Homo sapiens
ggcccttgagatacc

SEQ ID NO: 21737 - DNA, 15 bp, Homo sapiens
tggcccttgagatac

SEQ ID NO: 21738 - DNA, 15 bp, Homo sapiens
ttggcccttgagata

SEQ ID NO: 21739 - DNA, 15 bp, Homo sapiens
cttggcccttgagat

SEQ ID NO: 21740 - DNA, 15 bp, Homo sapiens
acttggcccttgaga

SEQ ID NO: 21741 - DNA, 15 bp, Homo sapiens
gacttggcccttgag

SEQ ID NO: 21742 - DNA, 15 bp, Homo sapiens
ggacttggcccttga

SEQ ID NO: 21743 - DNA, 15 bp, Homo sapiens
cggacttggcccttg

SEQ ID NO: 21744 - DNA, 15 bp, Homo sapiens
ccggacttggccctt

SEQ ID NO: 21745 - DNA, 15 bp, Homo sapiens
gccggacttggccct

SEQ ID NO: 21746 - DNA, 15 bp, Homo sapiens
ggccggacttggccc

SEQ ID NO: 21747 - DNA, 15 bp, Homo sapiens
gggccggacttggcc

SEQ ID NO: 21748 - DNA, 15 bp, Homo sapiens
tgggccggacttggc

SEQ ID NO: 21749 - DNA, 15 bp, Homo sapiens
gtgggccggacttgg

SEQ ID NO: 21750 - DNA, 15 bp, Homo sapiens
agtgggccggacttg

SEQ ID NO: 21751 - DNA, 15 bp, Homo sapiens
cagtgggccggactt

SEQ ID NO: 21752 - DNA, 15 bp, Homo sapiens
gcagtgggccggact

SEQ ID NO: 21753 - DNA, 15 bp, Homo sapiens
ggcagtgggccggac

SEQ ID NO: 21754 - DNA, 15 bp, Homo sapiens
aggcagtgggccgga

SEQ ID NO: 21755 - DNA, 15 bp, Homo sapiens
caggcagtgggccgg

SEQ ID NO: 21756 - DNA, 15 bp, Homo sapiens
acaggcagtgggccg

SEQ ID NO: 21757 - DNA, 15 bp, Homo sapiens
aacaggcagtgggcc

SEQ ID NO: 21758 - DNA, 15 bp, Homo sapiens
aaacaggcagtgggc

SEQ ID NO: 21759 - DNA, 15 bp, Homo sapiens
aaaacaggcagtggg

SEQ ID NO: 21760 - DNA, 15 bp, Homo sapiens
gaaaacaggcagtgg

SEQ ID NO: 21761 - DNA, 15 bp, Homo sapiens
cgaaaacaggcagtg

SEQ ID NO: 21762 - DNA, 15 bp, Homo sapiens
acgaaaacaggcagt

SEQ ID NO: 21763 - DNA, 15 bp, Homo sapiens
tacgaaaacaggcag

SEQ ID NO: 21764 - DNA, 15 bp, Homo sapiens
ttacgaaaacaggca

SEQ ID NO: 21765 - DNA, 15 bp, Homo sapiens
tttacgaaaacaggc

SEQ ID NO: 21766 - DNA, 15 bp, Homo sapiens
atttacgaaaacagg

SEQ ID NO: 21767 - DNA, 15 bp, Homo sapiens
catttacgaaaacag

SEQ ID NO: 21768 - DNA, 15 bp, Homo sapiens
tcatttacgaaaaca

SEQ ID NO: 21769 - DNA, 15 bp, Homo sapiens
ttcatttacgaaaac

SEQ ID NO: 21770 - DNA, 15 bp, Homo sapiens
cttcatttacgaaaa

SEQ ID NO: 21771 - DNA, 15 bp, Homo sapiens
gcttcatttacgaaa

SEQ ID NO: 21772 - DNA, 15 bp, Homo sapiens
agcttcatttacgaa

SEQ ID NO: 21773 - DNA, 15 bp, Homo sapiens
aagcttcatttacga

SEQ ID NO: 21774 - DNA, 15 bp, Homo sapiens
aaagcttcatttacg

SEQ ID NO: 21775 - DNA, 15 bp, Homo sapiens
taaagcttcatttac

SEQ ID NO: 21776 - DNA, 15 bp, Homo sapiens
gtaaagcttcattta

SEQ ID NO: 21777 - DNA, 15 bp, Homo sapiens
ggtaaagcttcattt

SEQ ID NO: 21778 - DNA, 15 bp, Homo sapiens
tggtaaagcttcatt

SEQ ID NO: 21779 - DNA, 15 bp, Homo sapiens
ctggtaaagcttcat

SEQ ID NO: 21780 - DNA, 15 bp, Homo sapiens
cctggtaaagcttca

SEQ ID NO: 21781 - DNA, 15 bp, Homo sapiens
tcctggtaaagcttc

SEQ ID NO: 21782 - DNA, 15 bp, Homo sapiens
gtcctggtaaagctt

SEQ ID NO: 21783 - DNA, 15 bp, Homo sapiens
ggtcctggtaaagct

SEQ ID NO: 21784 - DNA, 15 bp, Homo sapiens
gggtcctggtaaagc

SEQ ID NO: 21785 - DNA, 15 bp, Homo sapiens
tgggtcctggtaaag

SEQ ID NO: 21786 - DNA, 15 bp, Homo sapiens
ctgggtcctggtaaa

SEQ ID NO: 21787 - DNA, 15 bp, Homo sapiens
actgggtcctggtaa

SEQ ID NO: 21788 - DNA, 15 bp, Homo sapiens
aactgggtcctggta

SEQ ID NO: 21789 - DNA, 15 bp, Homo sapiens
gaactgggtcctggt

SEQ ID NO: 21790 - DNA, 15 bp, Homo sapiens
ggaactgggtcctgg

SEQ ID NO: 21791 - DNA, 15 bp, Homo sapiens
tggaactgggtcctg

SEQ ID NO: 21792 - DNA, 15 bp, Homo sapiens
gtggaactgggtcct

SEQ ID NO: 21793 - DNA, 15 bp, Homo sapiens
ggtggaactgggtcc

SEQ ID NO: 21794 - DNA, 15 bp, Homo sapiens
gggtggaactgggtc

SEQ ID NO: 21795 - DNA, 15 bp, Homo sapiens
ggggtggaactgggt

SEQ ID NO: 21796 - DNA, 15 bp, Homo sapiens
cggggtggaactggg

SEQ ID NO: 21797 - DNA, 15 bp, Homo sapiens
acggggtggaactgg

SEQ ID NO: 21798 - DNA, 15 bp, Homo sapiens
gacggggtggaactg

SEQ ID NO: 21799 - DNA, 15 bp, Homo sapiens
ggacggggtggaact

SEQ ID NO: 21800 - DNA, 15 bp, Homo sapiens
aggacggggtggaac

SEQ ID NO: 21801 - DNA, 15 bp, Homo sapiens
aaggacggggtggaa

SEQ ID NO: 21802 - DNA, 15 bp, Homo sapiens
aaaggacggggtgga

SEQ ID NO: 21803 - DNA, 15 bp, Homo sapiens
caaaggacggggtgg

SEQ ID NO: 21804 - DNA, 15 bp, Homo sapiens
acaaaggacggggtg

SEQ ID NO: 21805 - DNA, 15 bp, Homo sapiens
cacaaaggacggggt

SEQ ID NO: 21806 - DNA, 15 bp, Homo sapiens
gcacaaaggacgggg

SEQ ID NO: 21807 - DNA, 15 bp, Homo sapiens
tgcacaaaggacggg

SEQ ID NO: 21808 - DNA, 15 bp, Homo sapiens
atgcacaaaggacgg

SEQ ID NO: 21809 - DNA, 15 bp, Homo sapiens
aatgcacaaaggacg

SEQ ID NO: 21810 - DNA, 15 bp, Homo sapiens
caatgcacaaaggac

SEQ ID NO: 21811 - DNA, 15 bp, Homo sapiens
acaatgcacaaagga

SEQ ID NO: 21812 - DNA, 15 bp, Homo sapiens
gacaatgcacaaagg

SEQ ID NO: 21813 - DNA, 15 bp, Homo sapiens
ggacaatgcacaaag

SEQ ID NO: 21814 - DNA, 15 bp, Homo sapiens
tggacaatgcacaaa

SEQ ID NO: 21815 - DNA, 15 bp, Homo sapiens
ttggacaatgcacaa

SEQ ID NO: 21816 - DNA, 15 bp, Homo sapiens
cttggacaatgcaca

SEQ ID NO: 21817 - DNA, 15 bp, Homo sapiens
tcttggacaatgcac

SEQ ID NO: 21818 - DNA, 15 bp, Homo sapiens
gtcttggacaatgca

SEQ ID NO: 21819 - DNA, 15 bp, Homo sapiens
agtcttggacaatgc

SEQ ID NO: 21820 - DNA, 15 bp, Homo sapiens
cagtcttggacaatg

SEQ ID NO: 21821 - DNA, 15 bp, Homo sapiens
gcagtcttggacaat

SEQ ID NO: 21822 - DNA, 15 bp, Homo sapiens
agcagtcttggacaa

SEQ ID NO: 21823 - DNA, 15 bp, Homo sapiens
gagcagtcttggaca

SEQ ID NO: 21824 - DNA, 15 bp, Homo sapiens
agagcagtcttggac

SEQ ID NO: 21825 - DNA, 15 bp, Homo sapiens
gagagcagtcttgga

SEQ ID NO: 21826 - DNA, 15 bp, Homo sapiens
ggagagcagtcttgg

SEQ ID NO: 21827 - DNA, 15 bp, Homo sapiens
aggagagcagtcttg

SEQ ID NO: 21828 - DNA, 15 bp, Homo sapiens
caggagagcagtctt

SEQ ID NO: 21829 - DNA, 15 bp, Homo sapiens
acaggagagcagtct

SEQ ID NO: 21830 - DNA, 15 bp, Homo sapiens
tacaggagagcagtc

SEQ ID NO: 21831 - DNA, 15 bp, Homo sapiens
gtacaggagagcagt

SEQ ID NO: 21832 - DNA, 15 bp, Homo sapiens
tgtacaggagagcag

SEQ ID NO: 21833 - DNA, 15 bp, Homo sapiens
ttgtacaggagagca

SEQ ID NO: 21834 - DNA, 15 bp, Homo sapiens
gttgtacaggagagc

SEQ ID NO: 21835 - DNA, 15 bp, Homo sapiens
tgttgtacaggagag

SEQ ID NO: 21836 - DNA, 15 bp, Homo sapiens
ctgttgtacaggaga

SEQ ID NO: 21837 - DNA, 15 bp, Homo sapiens
gctgttgtacaggag

SEQ ID NO: 21838 - DNA, 15 bp, Homo sapiens
tgctgttgtacagga

SEQ ID NO: 21839 - DNA, 15 bp, Homo sapiens
ctgctgttgtacagg

SEQ ID NO: 21840 - DNA, 15 bp, Homo sapiens
cctgctgttgtacag

SEQ ID NO: 21841 - DNA, 15 bp, Homo sapiens
acctgctgttgtaca

SEQ ID NO: 21842 - DNA, 15 bp, Homo sapiens
cacctgctgttgtac

SEQ ID NO: 21843 - DNA, 15 bp, Homo sapiens
ccacctgctgttgta

SEQ ID NO: 21844 - DNA, 15 bp, Homo sapiens
cccacctgctgttgt

SEQ ID NO: 21845 - DNA, 15 bp, Homo sapiens
gcccacctgctgttg

SEQ ID NO: 21846 - DNA, 15 bp, Homo sapiens
agcccacctgctgtt

SEQ ID NO: 21847 - DNA, 15 bp, Homo sapiens
cagcccacctgctgt

SEQ ID NO: 21848 - DNA, 15 bp, Homo sapiens
ccagcccacctgctg

SEQ ID NO: 21849 - DNA, 15 bp, Homo sapiens
accagcccacctgct

SEQ ID NO: 21850 - DNA, 15 bp, Homo sapiens
aaccagcccacctgc

SEQ ID NO: 21851 - DNA, 15 bp, Homo sapiens
caaccagcccacctg

SEQ ID NO: 21852 - DNA, 15 bp, Homo sapiens
acaaccagcccacct

SEQ ID NO: 21853 - DNA, 15 bp, Homo sapiens
cacaaccagcccacc

SEQ ID NO: 21854 - DNA, 15 bp, Homo sapiens
tcacaaccagcccac

SEQ ID NO: 21855 - DNA, 15 bp, Homo sapiens
gtcacaaccagccca

SEQ ID NO: 21856 - DNA, 15 bp, Homo sapiens
tgtcacaaccagccc

SEQ ID NO: 21857 - DNA, 15 bp, Homo sapiens
ctgtcacaaccagcc

SEQ ID NO: 21858 - DNA, 15 bp, Homo sapiens
tctgtcacaaccagc

SEQ ID NO: 21859 - DNA, 15 bp, Homo sapiens
atctgtcacaaccag

SEQ ID NO: 21860 - DNA, 15 bp, Homo sapiens
tatctgtcacaacca

SEQ ID NO: 21861 - DNA, 15 bp, Homo sapiens
gtatctgtcacaacc

SEQ ID NO: 21862 - DNA, 15 bp, Homo sapiens
agtatctgtcacaac

SEQ ID NO: 21863 - DNA, 15 bp, Homo sapiens
cagtatctgtcacaa

SEQ ID NO: 21864 - DNA, 15 bp, Homo sapiens
acagtatctgtcaca

SEQ ID NO: 21865 - DNA, 15 bp, Homo sapiens
gacagtatctgtcac

SEQ ID NO: 21866 - DNA, 15 bp, Homo sapiens
agacagtatctgtca

SEQ ID NO: 21867 - DNA, 15 bp, Homo sapiens
cagacagtatctgtc

SEQ ID NO: 21868 - DNA, 15 bp, Homo sapiens
ccagacagtatctgt

SEQ ID NO: 21869 - DNA, 15 bp, Homo sapiens
gccagacagtatctg

SEQ ID NO: 21870 - DNA, 15 bp, Homo sapiens
ggccagacagtatct

SEQ ID NO: 21871 - DNA, 15 bp, Homo sapiens
gggccagacagtatc

SEQ ID NO: 21872 - DNA, 15 bp, Homo sapiens
tgggccagacagtat

SEQ ID NO: 21873 - DNA, 15 bp, Homo sapiens
gtgggccagacagta

SEQ ID NO: 21874 - DNA, 15 bp, Homo sapiens
tgtgggccagacagt

SEQ ID NO: 21875 - DNA, 15 bp, Homo sapiens
ttgtgggccagacag

SEQ ID NO: 21876 - DNA, 15 bp, Homo sapiens
cttgtgggccagaca

SEQ ID NO: 21877 - DNA, 15 bp, Homo sapiens
ccttgtgggccagac

SEQ ID NO: 21878 - DNA, 15 bp, Homo sapiens
accttgtgggccaga

SEQ ID NO: 21879 - DNA, 15 bp, Homo sapiens
caccttgtgggccag

SEQ ID NO: 21880 - DNA, 15 bp, Homo sapiens
ccaccttgtgggcca

SEQ ID NO: 21881 - DNA, 15 bp, Homo sapiens
tccaccttgtgggcc

SEQ ID NO: 21882 - DNA, 15 bp, Homo sapiens
ttccaccttgtgggc

SEQ ID NO: 21883 - DNA, 15 bp, Homo sapiens
tttccaccttgtggg

SEQ ID NO: 21884 - DNA, 15 bp, Homo sapiens
ttttccaccttgtgg

SEQ ID NO: 21885 - DNA, 15 bp, Homo sapiens
attttccaccttgtg

SEQ ID NO: 21886 - DNA, 15 bp, Homo sapiens
tattttccaccttgt

SEQ ID NO: 21887 - DNA, 15 bp, Homo sapiens
gtattttccaccttg

SEQ ID NO: 21888 - DNA, 15 bp, Homo sapiens
agtattttccacctt

SEQ ID NO: 21889 - DNA, 15 bp, Homo sapiens
tagtattttccacct

SEQ ID NO: 21890 - DNA, 15 bp, Homo sapiens
atagtattttccacc

SEQ ID NO: 21891 - DNA, 15 bp, Homo sapiens
gatagtattttccac

SEQ ID NO: 21892 - DNA, 15 bp, Homo sapiens
agatagtattttcca

SEQ ID NO: 21893 - DNA, 15 bp, Homo sapiens
cagatagtattttcc

SEQ ID NO: 21894 - DNA, 15 bp, Homo sapiens
ccagatagtattttc

SEQ ID NO: 21895 - DNA, 15 bp, Homo sapiens
gccagatagtatttt

SEQ ID NO: 21896 - DNA, 15 bp, Homo sapiens
ggccagatagtattt

SEQ ID NO: 21897 - DNA, 15 bp, Homo sapiens
gggccagatagtatt

SEQ ID NO: 21898 - DNA, 15 bp, Homo sapiens
ggggccagatagtat

SEQ ID NO: 21899 - DNA, 15 bp, Homo sapiens
aggggccagatagta

SEQ ID NO: 21900 - DNA, 15 bp, Homo sapiens
aaggggccagatagt

SEQ ID NO: 21901 - DNA, 15 bp, Homo sapiens
taaggggccagatag

SEQ ID NO: 21902 - DNA, 15 bp, Homo sapiens
gtaaggggccagata

SEQ ID NO: 21903 - DNA, 15 bp, Homo sapiens
tgtaaggggccagat

SEQ ID NO: 21904 - DNA, 15 bp, Homo sapiens
ctgtaaggggccaga

SEQ ID NO: 21905 - DNA, 15 bp, Homo sapiens
tctgtaaggggccag

SEQ ID NO: 21906 - DNA, 15 bp, Homo sapiens
ttctgtaaggggcca

SEQ ID NO: 21907 - DNA, 15 bp, Homo sapiens
tttctgtaaggggcc

SEQ ID NO: 21908 - DNA, 15 bp, Homo sapiens
ctttctgtaaggggc

SEQ ID NO: 21909 - DNA, 15 bp, Homo sapiens
tctttctgtaagggg

SEQ ID NO: 21910 - DNA, 15 bp, Homo sapiens
ttctttctgtaaggg

SEQ ID NO: 21911 - DNA, 15 bp, Homo sapiens
tttctttctgtaagg

SEQ ID NO: 21912 - DNA, 15 bp, Homo sapiens
atttctttctgtaag

SEQ ID NO: 21913 - DNA, 15 bp, Homo sapiens
aatttctttctgtaa

SEQ ID NO: 21914 - DNA, 15 bp, Homo sapiens
taatttctttctgta

SEQ ID NO: 21915 - DNA, 15 bp, Homo sapiens
gtaatttctttctgt

SEQ ID NO: 21916 - DNA, 15 bp, Homo sapiens
ggtaatttctttctg

SEQ ID NO: 21917 - DNA, 15 bp, Homo sapiens
aggtaatttctttct

SEQ ID NO: 21918 - DNA, 15 bp, Homo sapiens
caggtaatttctttc

SEQ ID NO: 21919 - DNA, 15 bp, Homo sapiens
tcaggtaatttcttt

SEQ ID NO: 21920 - DNA, 15 bp, Homo sapiens
ctcaggtaatttctt

SEQ ID NO: 21921 - DNA, 15 bp, Homo sapiens
actcaggtaatttct

SEQ ID NO: 21922 - DNA, 15 bp, Homo sapiens
aactcaggtaatttc

SEQ ID NO: 21923 - DNA, 15 bp, Homo sapiens
gaactcaggtaattt

SEQ ID NO: 21924 - DNA, 15 bp, Homo sapiens
agaactcaggtaatt

SEQ ID NO: 21925 - DNA, 15 bp, Homo sapiens
tagaactcaggtaat

SEQ ID NO: 21926 - DNA, 15 bp, Homo sapiens
gtagaactcaggtaa

SEQ ID NO: 21927 - DNA, 15 bp, Homo sapiens
tgtagaactcaggta

SEQ ID NO: 21928 - DNA, 15 bp, Homo sapiens
gtgtagaactcaggt

SEQ ID NO: 21929 - DNA, 15 bp, Homo sapiens
cgtgtagaactcagg

SEQ ID NO: 21930 - DNA, 15 bp, Homo sapiens
tcgtgtagaactcag

SEQ ID NO: 21931 - DNA, 15 bp, Homo sapiens
ctcgtgtagaactca

SEQ ID NO: 21932 - DNA, 15 bp, Homo sapiens
cctcgtgtagaactc

SEQ ID NO: 21933 - DNA, 15 bp, Homo sapiens
ccctcgtgtagaact

SEQ ID NO: 21934 - DNA, 15 bp, Homo sapiens
accctcgtgtagaac

SEQ ID NO: 21935 - DNA, 15 bp, Homo sapiens
caccctcgtgtagaa

SEQ ID NO: 21936 - DNA, 15 bp, Homo sapiens
acaccctcgtgtaga

SEQ ID NO: 21937 - DNA, 15 bp, Homo sapiens
tacaccctcgtgtag

SEQ ID NO: 21938 - DNA, 15 bp, Homo sapiens
ctacaccctcgtgta

SEQ ID NO: 21939 - DNA, 15 bp, Homo sapiens
cctacaccctcgtgt

SEQ ID NO: 21940 - DNA, 15 bp, Homo sapiens
acctacaccctcgtg

SEQ ID NO: 21941 - DNA, 15 bp, Homo sapiens
tacctacaccctcgt

SEQ ID NO: 21942 - DNA, 15 bp, Homo sapiens
atacctacaccctcg

SEQ ID NO: 21943 - DNA, 15 bp, Homo sapiens
catacctacaccctc

SEQ ID NO: 21944 - DNA, 15 bp, Homo sapiens
acatacctacaccct

SEQ ID NO: 21945 - DNA, 15 bp, Homo sapiens
tacatacctacaccc

SEQ ID NO: 21946 - DNA, 15 bp, Homo sapiens
gtacatacctacacc

SEQ ID NO: 21947 - DNA, 15 bp, Homo sapiens
ggtacatacctacac

SEQ ID NO: 21948 - DNA, 15 bp, Homo sapiens
gggtacatacctaca

SEQ ID NO: 21949 - DNA, 15 bp, Homo sapiens
agggtacatacctac

SEQ ID NO: 21950 - DNA, 15 bp, Homo sapiens
cagggtacataccta

SEQ ID NO: 21951 - DNA, 15 bp, Homo sapiens
ccagggtacatacct

SEQ ID NO: 21952 - DNA, 15 bp, Homo sapiens
gccagggtacatacc

SEQ ID NO: 21953 - DNA, 15 bp, Homo sapiens
ggccagggtacatac

SEQ ID NO: 21954 - DNA, 15 bp, Homo sapiens
aggccagggtacata

SEQ ID NO: 21955 - DNA, 15 bp, Homo sapiens
gaggccagggtacat

SEQ ID NO: 21956 - DNA, 15 bp, Homo sapiens
agaggccagggtaca

SEQ ID NO: 21957 - DNA, 15 bp, Homo sapiens
cagaggccagggtac

SEQ ID NO: 21958 - DNA, 15 bp, Homo sapiens
gcagaggccagggta

SEQ ID NO: 21959 - DNA, 15 bp, Homo sapiens
ggcagaggccagggt

SEQ ID NO: 21960 - DNA, 15 bp, Homo sapiens
tggcagaggccaggg

SEQ ID NO: 21961 - DNA, 15 bp, Homo sapiens
ctggcagaggccagg

SEQ ID NO: 21962 - DNA, 15 bp, Homo sapiens
actggcagaggccag

SEQ ID NO: 21963 - DNA, 15 bp, Homo sapiens
gactggcagaggcca

SEQ ID NO: 21964 - DNA, 15 bp, Homo sapiens
tgactggcagaggcc

SEQ ID NO: 21965 - DNA, 15 bp, Homo sapiens
ctgactggcagaggc

SEQ ID NO: 21966 - DNA, 15 bp, Homo sapiens
tctgactggcagagg

SEQ ID NO: 21967 - DNA, 15 bp, Homo sapiens
gtctgactggcagag

SEQ ID NO: 21968 - DNA, 15 bp, Homo sapiens
agtctgactggcaga

SEQ ID NO: 21969 - DNA, 15 bp, Homo sapiens
gagtctgactggcag

SEQ ID NO: 21970 - DNA, 15 bp, Homo sapiens
tgagtctgactggca

SEQ ID NO: 21971 - DNA, 15 bp, Homo sapiens
gtgagtctgactggc

SEQ ID NO: 21972 - DNA, 15 bp, Homo sapiens
tgtgagtctgactgg

SEQ ID NO: 21973 - DNA, 15 bp, Homo sapiens
atgtgagtctgactg

SEQ ID NO: 21974 - DNA, 15 bp, Homo sapiens
catgtgagtctgact

SEQ ID NO: 21975 - DNA, 15 bp, Homo sapiens
gcatgtgagtctgac

SEQ ID NO: 21976 - DNA, 15 bp, Homo sapiens
agcatgtgagtctga

SEQ ID NO: 21977 - DNA, 15 bp, Homo sapiens
tagcatgtgagtctg

SEQ ID NO: 21978 - DNA, 15 bp, Homo sapiens
ctagcatgtgagtct

SEQ ID NO: 21979 - DNA, 15 bp, Homo sapiens
cctagcatgtgagtc

SEQ ID NO: 21980 - DNA, 15 bp, Homo sapiens
tcctagcatgtgagt

SEQ ID NO: 21981 - DNA, 15 bp, Homo sapiens
ctcctagcatgtgag

SEQ ID NO: 21982 - DNA, 15 bp, Homo sapiens
cctcctagcatgtga

SEQ ID NO: 21983 - DNA, 15 bp, Homo sapiens
tcctcctagcatgtg

SEQ ID NO: 21984 - DNA, 15 bp, Homo sapiens
ctcctcctagcatgt

SEQ ID NO: 21985 - DNA, 15 bp, Homo sapiens
gctcctcctagcatg

SEQ ID NO: 21986 - DNA, 15 bp, Homo sapiens
tgctcctcctagcat

SEQ ID NO: 21987 - DNA, 15 bp, Homo sapiens
ctgctcctcctagca

SEQ ID NO: 21988 - DNA, 15 bp, Homo sapiens
cctgctcctcctagc

SEQ ID NO: 21989 - DNA, 15 bp, Homo sapiens
ccctgctcctcctag

SEQ ID NO: 21990 - DNA, 15 bp, Homo sapiens
gccctgctcctccta

SEQ ID NO: 21991 - DNA, 15 bp, Homo sapiens
ggccctgctcctcct

SEQ ID NO: 21992 - DNA, 15 bp, Homo sapiens
tggccctgctcctcc

SEQ ID NO: 21993 - DNA, 15 bp, Homo sapiens
ctggccctgctcctc

SEQ ID NO: 21994 - DNA, 15 bp, Homo sapiens
cctggccctgctcct

SEQ ID NO: 21995 - DNA, 15 bp, Homo sapiens
gcctggccctgctcc

SEQ ID NO: 21996 - DNA, 15 bp, Homo sapiens
tgcctggccctgctc

SEQ ID NO: 21997 - DNA, 15 bp, Homo sapiens
ctgcctggccctgct

SEQ ID NO: 21998 - DNA, 15 bp, Homo sapiens
cctgcctggccctgc

SEQ ID NO: 21999 - DNA, 15 bp, Homo sapiens
tcctgcctggccctg

SEQ ID NO: 22000 - DNA, 15 bp, Homo sapiens
ctcctgcctggccct

SEQ ID NO: 22001 - DNA, 15 bp, Homo sapiens
tctcctgcctggccc

SEQ ID NO: 22002 - DNA, 15 bp, Homo sapiens
ctctcctgcctggcc

SEQ ID NO: 22003 - DNA, 15 bp, Homo sapiens
gctctcctgcctggc

SEQ ID NO: 22004 - DNA, 15 bp, Homo sapiens
ggctctcctgcctgg

SEQ ID NO: 22005 - DNA, 15 bp, Homo sapiens
cggctctcctgcctg

SEQ ID NO: 22006 - DNA, 15 bp, Homo sapiens
acggctctcctgcct

SEQ ID NO: 22007 - DNA, 15 bp, Homo sapiens
cacggctctcctgcc

SEQ ID NO: 22008 - DNA, 15 bp, Homo sapiens
acacggctctcctgc

SEQ ID NO: 22009 - DNA, 15 bp, Homo sapiens
gacacggctctcctg

SEQ ID NO: 22010 - DNA, 15 bp, Homo sapiens
agacacggctctcct

SEQ ID NO: 22011 - DNA, 15 bp, Homo sapiens
gagacacggctctcc

SEQ ID NO: 22012 - DNA, 15 bp, Homo sapiens
ggagacacggctctc

SEQ ID NO: 22013 - DNA, 15 bp, Homo sapiens
aggagacacggctct

SEQ ID NO: 22014 - DNA, 15 bp, Homo sapiens
caggagacacggctc

SEQ ID NO: 22015 - DNA, 15 bp, Homo sapiens
ccaggagacacggct

SEQ ID NO: 22016 - DNA, 15 bp, Homo sapiens
gccaggagacacggc

SEQ ID NO: 22017 - DNA, 15 bp, Homo sapiens
tgccaggagacacgg

SEQ ID NO: 22018 - DNA, 15 bp, Homo sapiens
atgccaggagacacg

SEQ ID NO: 22019 - DNA, 15 bp, Homo sapiens
aatgccaggagacac

SEQ ID NO: 22020 - DNA, 15 bp, Homo sapiens
caatgccaggagaca

SEQ ID NO: 22021 - DNA, 15 bp, Homo sapiens
ccaatgccaggagac

SEQ ID NO: 22022 - DNA, 15 bp, Homo sapiens
cccaatgccaggaga

SEQ ID NO: 22023 - DNA, 15 bp, Homo sapiens
ccccaatgccaggag

SEQ ID NO: 22024 - DNA, 15 bp, Homo sapiens
gccccaatgccagga

SEQ ID NO: 22025 - DNA, 15 bp, Homo sapiens
agccccaatgccagg

SEQ ID NO: 22026 - DNA, 15 bp, Homo sapiens
cagccccaatgccag

SEQ ID NO: 22027 - DNA, 15 bp, Homo sapiens
gcagccccaatgcca

SEQ ID NO: 22028 - DNA, 15 bp, Homo sapiens
tgcagccccaatgcc

SEQ ID NO: 22029 - DNA, 15 bp, Homo sapiens
ctgcagccccaatgc

SEQ ID NO: 22030 - DNA, 15 bp, Homo sapiens
cctgcagccccaatg

SEQ ID NO: 22031 - DNA, 15 bp, Homo sapiens
tcctgcagccccaat

SEQ ID NO: 22032 - DNA, 15 bp, Homo sapiens
ttcctgcagccccaa

SEQ ID NO: 22033 - DNA, 15 bp, Homo sapiens
tttcctgcagcccca

SEQ ID NO: 22034 - DNA, 15 bp, Homo sapiens
ctttcctgcagcccc

SEQ ID NO: 22035 - DNA, 15 bp, Homo sapiens
tctttcctgcagccc

SEQ ID NO: 22036 - DNA, 15 bp, Homo sapiens
gtctttcctgcagcc

SEQ ID NO: 22037 - DNA, 15 bp, Homo sapiens
cgtctttcctgcagc

SEQ ID NO: 22038 - DNA, 15 bp, Homo sapiens
tcgtctttcctgcag

SEQ ID NO: 22039 - DNA, 15 bp, Homo sapiens
ctcgtctttcctgca

SEQ ID NO: 22040 - DNA, 15 bp, Homo sapiens
gctcgtctttcctgc

SEQ ID NO: 22041 - DNA, 15 bp, Homo sapiens
agctcgtctttcctg

SEQ ID NO: 22042 - DNA, 15 bp, Homo sapiens
gagctcgtctttcct

SEQ ID NO: 22043 - DNA, 15 bp, Homo sapiens
ggagctcgtctttcc

SEQ ID NO: 22044 - DNA, 15 bp, Homo sapiens
aggagctcgtctttc

SEQ ID NO: 22045 - DNA, 15 bp, Homo sapiens
taggagctcgtcttt

SEQ ID NO: 22046 - DNA, 15 bp, Homo sapiens
ctaggagctcgtctt

SEQ ID NO: 22047 - DNA, 15 bp, Homo sapiens
cctaggagctcgtct

SEQ ID NO: 22048 - DNA, 15 bp, Homo sapiens
gcctaggagctcgtc

SEQ ID NO: 22049 - DNA, 15 bp, Homo sapiens
ggcctaggagctcgt

SEQ ID NO: 22050 - DNA, 15 bp, Homo sapiens
tggcctaggagctcg

SEQ ID NO: 22051 - DNA, 15 bp, Homo sapiens
gtggcctaggagctc

SEQ ID NO: 22052 - DNA, 15 bp, Homo sapiens
tgtggcctaggagct

SEQ ID NO: 22053 - DNA, 15 bp, Homo sapiens
ctgtggcctaggagc

SEQ ID NO: 22054 - DNA, 15 bp, Homo sapiens
actgtggcctaggag

SEQ ID NO: 22055 - DNA, 15 bp, Homo sapiens
cactgtggcctagga

SEQ ID NO: 22056 - DNA, 15 bp, Homo sapiens
gcactgtggcctagg

SEQ ID NO: 22057 - DNA, 15 bp, Homo sapiens
ggcactgtggcctag

SEQ ID NO: 22058 - DNA, 15 bp, Homo sapiens
tggcactgtggccta

SEQ ID NO: 22059 - DNA, 15 bp, Homo sapiens
ctggcactgtggcct

SEQ ID NO: 22060 - DNA, 15 bp, Homo sapiens
actggcactgtggcc

SEQ ID NO: 22061 - DNA, 15 bp, Homo sapiens
cactggcactgtggc

SEQ ID NO: 22062 - DNA, 15 bp, Homo sapiens
ccactggcactgtgg

SEQ ID NO: 22063 - DNA, 15 bp, Homo sapiens
gccactggcactgtg

SEQ ID NO: 22064 - DNA, 15 bp, Homo sapiens
ggccactggcactgt

SEQ ID NO: 22065 - DNA, 15 bp, Homo sapiens
tggccactggcactg

SEQ ID NO: 22066 - DNA, 15 bp, Homo sapiens
ctggccactggcact

SEQ ID NO: 22067 - DNA, 15 bp, Homo sapiens
actggccactggcac

SEQ ID NO: 22068 - DNA, 15 bp, Homo sapiens
cactggccactggca

SEQ ID NO: 22069 - DNA, 15 bp, Homo sapiens
gcactggccactggc

SEQ ID NO: 22070 - DNA, 15 bp, Homo sapiens
agcactggccactgg

SEQ ID NO: 22071 - DNA, 15 bp, Homo sapiens
cagcactggccactg

SEQ ID NO: 22072 - DNA, 15 bp, Homo sapiens
gcagcactggccact

SEQ ID NO: 22073 - DNA, 15 bp, Homo sapiens
agcagcactggccac

SEQ ID NO: 22074 - DNA, 15 bp, Homo sapiens
cagcagcactggcca

SEQ ID NO: 22075 - DNA, 15 bp, Homo sapiens
gcagcagcactggcc

SEQ ID NO: 22076 - DNA, 15 bp, Homo sapiens
ggcagcagcactggc

SEQ ID NO: 22077 - DNA, 15 bp, Homo sapiens
aggcagcagcactgg

SEQ ID NO: 22078 - DNA, 15 bp, Homo sapiens
aaggcagcagcactg

SEQ ID NO: 22079 - DNA, 15 bp, Homo sapiens
caaggcagcagcact

SEQ ID NO: 22080 - DNA, 15 bp, Homo sapiens
gcaaggcagcagcac

SEQ ID NO: 22081 - DNA, 15 bp, Homo sapiens
tgcaaggcagcagca

SEQ ID NO: 22082 - DNA, 15 bp, Homo sapiens
ctgcaaggcagcagc

SEQ ID NO: 22083 - DNA, 15 bp, Homo sapiens
cctgcaaggcagcag

SEQ ID NO: 22084 - DNA, 15 bp, Homo sapiens
ccctgcaaggcagca

SEQ ID NO: 22085 - DNA, 15 bp, Homo sapiens
accctgcaaggcagc

SEQ ID NO: 22086 - DNA, 15 bp, Homo sapiens
gaccctgcaaggcag

SEQ ID NO: 22087 - DNA, 15 bp, Homo sapiens
cgaccctgcaaggca

SEQ ID NO: 22088 - DNA, 15 bp, Homo sapiens
gcgaccctgcaaggc

SEQ ID NO: 22089 - DNA, 15 bp, Homo sapiens
tgcgaccctgcaagg

SEQ ID NO: 22090 - DNA, 15 bp, Homo sapiens
gtgcgaccctgcaag

SEQ ID NO: 22091 - DNA, 15 bp, Homo sapiens
tgtgcgaccctgcaa

SEQ ID NO: 22092 - DNA, 15 bp, Homo sapiens
ctgtgcgaccctgca

SEQ ID NO: 22093 - DNA, 15 bp, Homo sapiens
cctgtgcgaccctgc

SEQ ID NO: 22094 - DNA, 15 bp, Homo sapiens
gcctgtgcgaccctg

SEQ ID NO: 22095 - DNA, 15 bp, Homo sapiens
tgcctgtgcgaccct

SEQ ID NO: 22096 - DNA, 15 bp, Homo sapiens
ctgcctgtgcgaccc

SEQ ID NO: 22097 - DNA, 15 bp, Homo sapiens
actgcctgtgcgacc

SEQ ID NO: 22098 - DNA, 15 bp, Homo sapiens
cactgcctgtgcgac

SEQ ID NO: 22099 - DNA, 15 bp, Homo sapiens
gcactgcctgtgcga

SEQ ID NO: 22100 - DNA, 15 bp, Homo sapiens
agcactgcctgtgcg

SEQ ID NO: 22101 - DNA, 15 bp, Homo sapiens
cagcactgcctgtgc

SEQ ID NO: 22102 - DNA, 15 bp, Homo sapiens
ccagcactgcctgtg

SEQ ID NO: 22103 - DNA, 15 bp, Homo sapiens
gccagcactgcctgt

SEQ ID NO: 22104 - DNA, 15 bp, Homo sapiens
agccagcactgcctg

SEQ ID NO: 22105 - DNA, 15 bp, Homo sapiens
cagccagcactgcct

SEQ ID NO: 22106 - DNA, 15 bp, Homo sapiens
acagccagcactgcc

SEQ ID NO: 22107 - DNA, 15 bp, Homo sapiens
aacagccagcactgc

SEQ ID NO: 22108 - DNA, 15 bp, Homo sapiens
aaacagccagcactg

SEQ ID NO: 22109 - DNA, 15 bp, Homo sapiens
caaacagccagcact

SEQ ID NO: 22110 - DNA, 15 bp, Homo sapiens
ccaaacagccagcac

SEQ ID NO: 22111 - DNA, 15 bp, Homo sapiens
tccaaacagccagca

SEQ ID NO: 22112 - DNA, 15 bp, Homo sapiens
gtccaaacagccagc

SEQ ID NO: 22113 - DNA, 15 bp, Homo sapiens
agtccaaacagccag

SEQ ID NO: 22114 - DNA, 15 bp, Homo sapiens
cagtccaaacagcca

SEQ ID NO: 22115 - DNA, 15 bp, Homo sapiens
ccagtccaaacagcc

SEQ ID NO: 22116 - DNA, 15 bp, Homo sapiens
gccagtccaaacagc

SEQ ID NO: 22117 - DNA, 15 bp, Homo sapiens
agccagtccaaacag

SEQ ID NO: 22118 - DNA, 15 bp, Homo sapiens
aagccagtccaaaca

SEQ ID NO: 22119 - DNA, 15 bp, Homo sapiens
caagccagtccaaac

SEQ ID NO: 22120 - DNA, 15 bp, Homo sapiens
ccaagccagtccaaa

SEQ ID NO: 22121 - DNA, 15 bp, Homo sapiens
gccaagccagtccaa

SEQ ID NO: 22122 - DNA, 15 bp, Homo sapiens
tgccaagccagtcca

SEQ ID NO: 22123 - DNA, 15 bp, Homo sapiens
ctgccaagccagtcc

SEQ ID NO: 22124 - DNA, 15 bp, Homo sapiens
tctgccaagccagtc

SEQ ID NO: 22125 - DNA, 15 bp, Homo sapiens
ttctgccaagccagt

SEQ ID NO: 22126 - DNA, 15 bp, Homo sapiens
cttctgccaagccag

SEQ ID NO: 22127 - DNA, 15 bp, Homo sapiens
ccttctgccaagcca

SEQ ID NO: 22128 - DNA, 15 bp, Homo sapiens
tccttctgccaagcc

SEQ ID NO: 22129 - DNA, 15 bp, Homo sapiens
atccttctgccaagc

SEQ ID NO: 22130 - DNA, 15 bp, Homo sapiens
aatccttctgccaag

SEQ ID NO: 22131 - DNA, 15 bp, Homo sapiens
aaatccttctgccaa

SEQ ID NO: 22132 - DNA, 15 bp, Homo sapiens
caaatccttctgcca

SEQ ID NO: 22133 - DNA, 15 bp, Homo sapiens
tcaaatccttctgcc

SEQ ID NO: 22134 - DNA, 15 bp, Homo sapiens
ttcaaatccttctgc

SEQ ID NO: 22135 - DNA, 15 bp, Homo sapiens
cttcaaatccttctg

SEQ ID NO: 22136 - DNA, 15 bp, Homo sapiens
acttcaaatccttct

SEQ ID NO: 22137 - DNA, 15 bp, Homo sapiens
tacttcaaatccttc

SEQ ID NO: 22138 - DNA, 15 bp, Homo sapiens
atacttcaaatcctt

SEQ ID NO: 22139 - DNA, 15 bp, Homo sapiens
aatacttcaaatcct

SEQ ID NO: 22140 - DNA, 15 bp, Homo sapiens
caatacttcaaatcc

SEQ ID NO: 22141 - DNA, 15 bp, Homo sapiens
acaatacttcaaatc

SEQ ID NO: 22142 - DNA, 15 bp, Homo sapiens
aacaatacttcaaat

SEQ ID NO: 22143 - DNA, 15 bp, Homo sapiens
gaacaatacttcaaa

SEQ ID NO: 22144 - DNA, 15 bp, Homo sapiens
ggaacaatacttcaa

SEQ ID NO: 22145 - DNA, 15 bp, Homo sapiens
aggaacaatacttca

SEQ ID NO: 22146 - DNA, 15 bp, Homo sapiens
taggaacaatacttc

SEQ ID NO: 22147 - DNA, 15 bp, Homo sapiens
ctaggaacaatactt

SEQ ID NO: 22148 - DNA, 15 bp, Homo sapiens
gctaggaacaatact

SEQ ID NO: 22149 - DNA, 15 bp, Homo sapiens
ggctaggaacaatac

SEQ ID NO: 22150 - DNA, 15 bp, Homo sapiens
tggctaggaacaata

SEQ ID NO: 22151 - DNA, 15 bp, Homo sapiens
ttggctaggaacaat

SEQ ID NO: 22152 - DNA, 15 bp, Homo sapiens
gttggctaggaacaa

SEQ ID NO: 22153 - DNA, 15 bp, Homo sapiens
agttggctaggaaca

SEQ ID NO: 22154 - DNA, 15 bp, Homo sapiens
cagttggctaggaac

SEQ ID NO: 22155 - DNA, 15 bp, Homo sapiens
ccagttggctaggaa

SEQ ID NO: 22156 - DNA, 15 bp, Homo sapiens
tccagttggctagga

SEQ ID NO: 22157 - DNA, 15 bp, Homo sapiens
gtccagttggctagg

SEQ ID NO: 22158 - DNA, 15 bp, Homo sapiens
agtccagttggctag

SEQ ID NO: 22159 - DNA, 15 bp, Homo sapiens
gagtccagttggcta

SEQ ID NO: 22160 - DNA, 15 bp, Homo sapiens
tgagtccagttggct

SEQ ID NO: 22161 - DNA, 15 bp, Homo sapiens
ttgagtccagttggc

SEQ ID NO: 22162 - DNA, 15 bp, Homo sapiens
tttgagtccagttgg

SEQ ID NO: 22163 - DNA, 15 bp, Homo sapiens
gtttgagtccagttg

SEQ ID NO: 22164 - DNA, 15 bp, Homo sapiens
ggtttgagtccagtt

SEQ ID NO: 22165 - DNA, 15 bp, Homo sapiens
aggtttgagtccagt

SEQ ID NO: 22166 - DNA, 15 bp, Homo sapiens
caggtttgagtccag

SEQ ID NO: 22167 - DNA, 15 bp, Homo sapiens
acaggtttgagtcca

SEQ ID NO: 22168 - DNA, 15 bp, Homo sapiens
aacaggtttgagtcc

SEQ ID NO: 22169 - DNA, 15 bp, Homo sapiens
gaacaggtttgagtc

SEQ ID NO: 22170 - DNA, 15 bp, Homo sapiens
ggaacaggtttgagt

SEQ ID NO: 22171 - DNA, 15 bp, Homo sapiens
aggaacaggtttgag

SEQ ID NO: 22172 - DNA, 15 bp, Homo sapiens
gaggaacaggtttga

SEQ ID NO: 22173 - DNA, 15 bp, Homo sapiens
ggaggaacaggtttg

SEQ ID NO: 22174 - DNA, 15 bp, Homo sapiens
tggaggaacaggttt

SEQ ID NO: 22175 - DNA, 15 bp, Homo sapiens
ttggaggaacaggtt

SEQ ID NO: 22176 - DNA, 15 bp, Homo sapiens
gttggaggaacaggt

SEQ ID NO: 22177 - DNA, 15 bp, Homo sapiens
ggttggaggaacagg

SEQ ID NO: 22178 - DNA, 15 bp, Homo sapiens
gggttggaggaacag

SEQ ID NO: 22179 - DNA, 15 bp, Homo sapiens
agggttggaggaaca

SEQ ID NO: 22180 - DNA, 15 bp, Homo sapiens
gagggttggaggaac

SEQ ID NO: 22181 - DNA, 15 bp, Homo sapiens
agagggttggaggaa

SEQ ID NO: 22182 - DNA, 15 bp, Homo sapiens
tagagggttggagga

SEQ ID NO: 22183 - DNA, 15 bp, Homo sapiens
ctagagggttggagg

SEQ ID NO: 22184 - DNA, 15 bp, Homo sapiens
cctagagggttggag

SEQ ID NO: 22185 - DNA, 15 bp, Homo sapiens
ccctagagggttgga

SEQ ID NO: 22186 - DNA, 15 bp, Homo sapiens
tccctagagggttgg

SEQ ID NO: 22187 - DNA, 15 bp, Homo sapiens
atccctagagggttg

SEQ ID NO: 22188 - DNA, 15 bp, Homo sapiens
aatccctagagggtt

SEQ ID NO: 22189 - DNA, 15 bp, Homo sapiens
gaatccctagagggt

SEQ ID NO: 22190 - DNA, 15 bp, Homo sapiens
agaatccctagaggg

SEQ ID NO: 22191 - DNA, 15 bp, Homo sapiens
gagaatccctagagg

SEQ ID NO: 22192 - DNA, 15 bp, Homo sapiens
agagaatccctagag

SEQ ID NO: 22193 - DNA, 15 bp, Homo sapiens
aagagaatccctaga

SEQ ID NO: 22194 - DNA, 15 bp, Homo sapiens
taagagaatccctag

SEQ ID NO: 22195 - DNA, 15 bp, Homo sapiens
ataagagaatcccta

SEQ ID NO: 22196 - DNA, 15 bp, Homo sapiens
gataagagaatccct

SEQ ID NO: 22197 - DNA, 15 bp, Homo sapiens
tgataagagaatccc

SEQ ID NO: 22198 - DNA, 15 bp, Homo sapiens
gtgataagagaatcc

SEQ ID NO: 22199 - DNA, 15 bp, Homo sapiens
ggtgataagagaatc

SEQ ID NO: 22200 - DNA, 15 bp, Homo sapiens
gggtgataagagaat

SEQ ID NO: 22201 - DNA, 15 bp, Homo sapiens
tgggtgataagagaa

SEQ ID NO: 22202 - DNA, 15 bp, Homo sapiens
ctgggtgataagaga

SEQ ID NO: 22203 - DNA, 15 bp, Homo sapiens
actgggtgataagag

SEQ ID NO: 22204 - DNA, 15 bp, Homo sapiens
tactgggtgataaga

SEQ ID NO: 22205 - DNA, 15 bp, Homo sapiens
ctactgggtgataag

SEQ ID NO: 22206 - DNA, 15 bp, Homo sapiens
gctactgggtgataa

SEQ ID NO: 22207 - DNA, 15 bp, Homo sapiens
ggctactgggtgata

SEQ ID NO: 22208 - DNA, 15 bp, Homo sapiens
aggctactgggtgat

SEQ ID NO: 22209 - DNA, 15 bp, Homo sapiens
aaggctactgggtga

SEQ ID NO: 22210 - DNA, 15 bp, Homo sapiens
aaaggctactgggtg

SEQ ID NO: 22211 - DNA, 15 bp, Homo sapiens
aaaaggctactgggt

SEQ ID NO: 22212 - DNA, 15 bp, Homo sapiens
gaaaaggctactggg

SEQ ID NO: 22213 - DNA, 15 bp, Homo sapiens
ggaaaaggctactgg

SEQ ID NO: 22214 - DNA, 15 bp, Homo sapiens
gggaaaaggctactg

SEQ ID NO: 22215 - DNA, 15 bp, Homo sapiens
ggggaaaaggctact

SEQ ID NO: 22216 - DNA, 15 bp, Homo sapiens
gggggaaaaggctac

SEQ ID NO: 22217 - DNA, 15 bp, Homo sapiens
agggggaaaaggcta

SEQ ID NO: 22218 - DNA, 15 bp, Homo sapiens
tagggggaaaaggct

SEQ ID NO: 22219 - DNA, 15 bp, Homo sapiens
ctagggggaaaaggc

SEQ ID NO: 22220 - DNA, 15 bp, Homo sapiens
actagggggaaaagg

SEQ ID NO: 22221 - DNA, 15 bp, Homo sapiens
aactagggggaaaag

SEQ ID NO: 22222 - DNA, 15 bp, Homo sapiens
aaactagggggaaaa

SEQ ID NO: 22223 - DNA, 15 bp, Homo sapiens
aaaactagggggaaa

SEQ ID NO: 22224 - DNA, 15 bp, Homo sapiens
taaaactagggggaa

SEQ ID NO: 22225 - DNA, 15 bp, Homo sapiens
ttaaaactaggggga

SEQ ID NO: 22226 - DNA, 15 bp, Homo sapiens
tttaaaactaggggg

SEQ ID NO: 22227 - DNA, 15 bp, Homo sapiens
ttttaaaactagggg

SEQ ID NO: 22228 - DNA, 15 bp, Homo sapiens
tttttaaaactaggg

SEQ ID NO: 22229 - DNA, 15 bp, Homo sapiens
atttttaaaactagg

SEQ ID NO: 22230 - DNA, 15 bp, Homo sapiens
aatttttaaaactag

SEQ ID NO: 22231 - DNA, 15 bp, Homo sapiens
caatttttaaaacta

SEQ ID NO: 22232 - DNA, 15 bp, Homo sapiens
gcaatttttaaaact

SEQ ID NO: 22233 - DNA, 15 bp, Homo sapiens
tgcaatttttaaaac

SEQ ID NO: 22234 - DNA, 15 bp, Homo sapiens
ctgcaatttttaaaa

SEQ ID NO: 22235 - DNA, 15 bp, Homo sapiens
actgcaatttttaaa

SEQ ID NO: 22236 - DNA, 15 bp, Homo sapiens
tactgcaatttttaa

SEQ ID NO: 22237 - DNA, 15 bp, Homo sapiens
ttactgcaattttta

SEQ ID NO: 22238 - DNA, 15 bp, Homo sapiens
tttactgcaattttt

SEQ ID NO: 22239 - DNA, 15 bp, Homo sapiens
ttttactgcaatttt

SEQ ID NO: 22240 - DNA, 15 bp, Homo sapiens
attttactgcaattt

SEQ ID NO: 22241 - DNA, 15 bp, Homo sapiens
tattttactgcaatt

SEQ ID NO: 22242 - DNA, 15 bp, Homo sapiens
gtattttactgcaat

SEQ ID NO: 22243 - DNA, 15 bp, Homo sapiens
tgtattttactgcaa

SEQ ID NO: 22244 - DNA, 15 bp, Homo sapiens
gtgtattttactgca

SEQ ID NO: 22245 - DNA, 15 bp, Homo sapiens
tgtgtattttactgc

SEQ ID NO: 22246 - DNA, 15 bp, Homo sapiens
ttgtgtattttactg

SEQ ID NO: 22247 - DNA, 15 bp, Homo sapiens
tttgtgtattttact

SEQ ID NO: 22248 - DNA, 15 bp, Homo sapiens
ttttgtgtattttac

SEQ ID NO: 22249 - DNA, 15 bp, Homo sapiens
cttttgtgtatttta

SEQ ID NO: 22250 - DNA, 15 bp, Homo sapiens
tcttttgtgtatttt

SEQ ID NO: 22251 - DNA, 15 bp, Homo sapiens
atcttttgtgtattt

SEQ ID NO: 22252 - DNA, 15 bp, Homo sapiens
tatcttttgtgtatt

SEQ ID NO: 22253 - DNA, 15 bp, Homo sapiens
ttatcttttgtgtat

SEQ ID NO: 22254 - DNA, 15 bp, Homo sapiens
tttatcttttgtgta

SEQ ID NO: 22255 - DNA, 15 bp, Homo sapiens
ttttatcttttgtgt

SEQ ID NO: 22256 - DNA, 15 bp, Homo sapiens
attttatcttttgtg

SEQ ID NO: 22257 - DNA, 15 bp, Homo sapiens
cattttatcttttgt

SEQ ID NO: 22258 - DNA, 15 bp, Homo sapiens
acattttatcttttg

SEQ ID NO: 22259 - DNA, 15 bp, Homo sapiens
tacattttatctttt

SEQ ID NO: 22260 - DNA, 15 bp, Homo sapiens
gtacattttatcttt

SEQ ID NO: 22261 - DNA, 15 bp, Homo sapiens
agtacattttatctt

SEQ ID NO: 22262 - DNA, 15 bp, Homo sapiens
cagtacattttatct

SEQ ID NO: 22263 - DNA, 15 bp, Homo sapiens
gcagtacattttatc

SEQ ID NO: 22264 - DNA, 15 bp, Homo sapiens
ggcagtacattttat

SEQ ID NO: 22265 - DNA, 15 bp, Homo sapiens
aggcagtacatttta

SEQ ID NO: 22266 - DNA, 15 bp, Homo sapiens
aaggcagtacatttt

SEQ ID NO: 22267 - DNA, 15 bp, Homo sapiens
taaggcagtacattt

SEQ ID NO: 22268 - DNA, 15 bp, Homo sapiens
ttaaggcagtacatt

SEQ ID NO: 22269 - DNA, 15 bp, Homo sapiens
gttaaggcagtacat

SEQ ID NO: 22270 - DNA, 15 bp, Homo sapiens
ggttaaggcagtaca

SEQ ID NO: 22271 - DNA, 15 bp, Homo sapiens
tggttaaggcagtac

SEQ ID NO: 22272 - DNA, 15 bp, Homo sapiens
atggttaaggcagta

SEQ ID NO: 22273 - DNA, 15 bp, Homo sapiens
aatggttaaggcagt

SEQ ID NO: 22274 - DNA, 15 bp, Homo sapiens
aaatggttaaggcag

SEQ ID NO: 22275 - DNA, 15 bp, Homo sapiens
aaaatggttaaggca

SEQ ID NO: 22276 - DNA, 15 bp, Homo sapiens
aaaaatggttaaggc

SEQ ID NO: 22277 - DNA, 15 bp, Homo sapiens
taaaaatggttaagg

SEQ ID NO: 22278 - DNA, 15 bp, Homo sapiens
ttaaaaatggttaag

SEQ ID NO: 22279 - DNA, 15 bp, Homo sapiens
cttaaaaatggttaa

SEQ ID NO: 22280 - DNA, 15 bp, Homo sapiens
acttaaaaatggtta

SEQ ID NO: 22281 - DNA, 15 bp, Homo sapiens
cacttaaaaatggtt

SEQ ID NO: 22282 - DNA, 15 bp, Homo sapiens
acacttaaaaatggt

SEQ ID NO: 22283 - DNA, 15 bp, Homo sapiens
tacacttaaaaatgg

SEQ ID NO: 22284 - DNA, 15 bp, Homo sapiens
gtacacttaaaaatg

SEQ ID NO: 22285 - DNA, 15 bp, Homo sapiens
tgtacacttaaaaat

SEQ ID NO: 22286 - DNA, 15 bp, Homo sapiens
ttgtacacttaaaaa

SEQ ID NO: 22287 - DNA, 15 bp, Homo sapiens
attgtacacttaaaa

SEQ ID NO: 22288 - DNA, 15 bp, Homo sapiens
aattgtacacttaaa

SEQ ID NO: 22289 - DNA, 15 bp, Homo sapiens
gaattgtacacttaa

SEQ ID NO: 22290 - DNA, 15 bp, Homo sapiens
agaattgtacactta

SEQ ID NO: 22291 - DNA, 15 bp, Homo sapiens
cagaattgtacactt

SEQ ID NO: 22292 - DNA, 15 bp, Homo sapiens
acagaattgtacact

SEQ ID NO: 22293 - DNA, 15 bp, Homo sapiens
cacagaattgtacac

SEQ ID NO: 22294 - DNA, 15 bp, Homo sapiens
ccacagaattgtaca

SEQ ID NO: 22295 - DNA, 15 bp, Homo sapiens
accacagaattgtac

SEQ ID NO: 22296 - DNA, 15 bp, Homo sapiens
taccacagaattgta

SEQ ID NO: 22297 - DNA, 15 bp, Homo sapiens
ataccacagaattgt

SEQ ID NO: 22298 - DNA, 15 bp, Homo sapiens
aataccacagaattg

SEQ ID NO: 22299 - DNA, 15 bp, Homo sapiens
caataccacagaatt

SEQ ID NO: 22300 - DNA, 15 bp, Homo sapiens
tcaataccacagaat

SEQ ID NO: 22301 - DNA, 15 bp, Homo sapiens
ctcaataccacagaa

SEQ ID NO: 22302 - DNA, 15 bp, Homo sapiens
gctcaataccacaga

SEQ ID NO: 22303 - DNA, 15 bp, Homo sapiens
tgctcaataccacag

SEQ ID NO: 22304 - DNA, 15 bp, Homo sapiens
gtgctcaataccaca

SEQ ID NO: 22305 - DNA, 15 bp, Homo sapiens
tgtgctcaataccac

SEQ ID NO: 22306 - DNA, 15 bp, Homo sapiens
atgtgctcaatacca

SEQ ID NO: 22307 - DNA, 15 bp, Homo sapiens
aatgtgctcaatacc

SEQ ID NO: 22308 - DNA, 15 bp, Homo sapiens
aaatgtgctcaatac

SEQ ID NO: 22309 - DNA, 15 bp, Homo sapiens
taaatgtgctcaata

SEQ ID NO: 22310 - DNA, 15 bp, Homo sapiens
ataaatgtgctcaat

SEQ ID NO: 22311 - DNA, 15 bp, Homo sapiens
tataaatgtgctcaa

SEQ ID NO: 22312 - DNA, 15 bp, Homo sapiens
atataaatgtgctca

SEQ ID NO: 22313 - DNA, 15 bp, Homo sapiens
aatataaatgtgctc

SEQ ID NO: 22314 - DNA, 15 bp, Homo sapiens
caatataaatgtgct

SEQ ID NO: 22315 - DNA, 15 bp, Homo sapiens
acaatataaatgtgc

SEQ ID NO: 22316 - DNA, 15 bp, Homo sapiens
cacaatataaatgtg

SEQ ID NO: 22317 - DNA, 15 bp, Homo sapiens
gcacaatataaatgt

SEQ ID NO: 22318 - DNA, 15 bp, Homo sapiens
tgcacaatataaatg

SEQ ID NO: 22319 - DNA, 15 bp, Homo sapiens
ttgcacaatataaat

SEQ ID NO: 22320 - DNA, 15 bp, Homo sapiens
gttgcacaatataaa

SEQ ID NO: 22321 - DNA, 15 bp, Homo sapiens
ggttgcacaatataa

SEQ ID NO: 22322 - DNA, 15 bp, Homo sapiens
tggttgcacaatata

SEQ ID NO: 22323 - DNA, 15 bp, Homo sapiens
atggttgcacaatat

SEQ ID NO: 22324 - DNA, 15 bp, Homo sapiens
gatggttgcacaata

SEQ ID NO: 22325 - DNA, 15 bp, Homo sapiens
tgatggttgcacaat

SEQ ID NO: 22326 - DNA, 15 bp, Homo sapiens
gtgatggttgcacaa

SEQ ID NO: 22327 - DNA, 15 bp, Homo sapiens
ggtgatggttgcaca

SEQ ID NO: 22328 - DNA, 15 bp, Homo sapiens
tggtgatggttgcac

SEQ ID NO: 22329 - DNA, 15 bp, Homo sapiens
gtggtgatggttgca

SEQ ID NO: 22330 - DNA, 15 bp, Homo sapiens
tgtggtgatggttgc

SEQ ID NO: 22331 - DNA, 15 bp, Homo sapiens
atgtggtgatggttg

SEQ ID NO: 22332 - DNA, 15 bp, Homo sapiens
catgtggtgatggtt

SEQ ID NO: 22333 - DNA, 15 bp, Homo sapiens
gcatgtggtgatggt

SEQ ID NO: 22334 - DNA, 15 bp, Homo sapiens
tgcatgtggtgatgg

SEQ ID NO: 22335 - DNA, 15 bp, Homo sapiens
atgcatgtggtgatg

SEQ ID NO: 22336 - DNA, 15 bp, Homo sapiens
gatgcatgtggtgat

SEQ ID NO: 22337 - DNA, 15 bp, Homo sapiens
agatgcatgtggtga

SEQ ID NO: 22338 - DNA, 15 bp, Homo sapiens
aagatgcatgtggtg

SEQ ID NO: 22339 - DNA, 15 bp, Homo sapiens
gaagatgcatgtggt

SEQ ID NO: 22340 - DNA, 15 bp, Homo sapiens
tgaagatgcatgtgg

SEQ ID NO: 22341 - DNA, 15 bp, Homo sapiens
ttgaagatgcatgtg

SEQ ID NO: 22342 - DNA, 15 bp, Homo sapiens
attgaagatgcatgt

SEQ ID NO: 22343 - DNA, 15 bp, Homo sapiens
tattgaagatgcatg

SEQ ID NO: 22344 - DNA, 15 bp, Homo sapiens
ctattgaagatgcat

SEQ ID NO: 22345 - DNA, 15 bp, Homo sapiens
gctattgaagatgca

SEQ ID NO: 22346 - DNA, 15 bp, Homo sapiens
agctattgaagatgc

SEQ ID NO: 22347 - DNA, 15 bp, Homo sapiens
aagctattgaagatg

SEQ ID NO: 22348 - DNA, 15 bp, Homo sapiens
aaagctattgaagat

SEQ ID NO: 22349 - DNA, 15 bp, Homo sapiens
aaaagctattgaaga

SEQ ID NO: 22350 - DNA, 15 bp, Homo sapiens
gaaaagctattgaag

SEQ ID NO: 22351 - DNA, 15 bp, Homo sapiens
tgaaaagctattgaa

SEQ ID NO: 22352 - DNA, 15 bp, Homo sapiens
atgaaaagctattga

SEQ ID NO: 22353 - DNA, 15 bp, Homo sapiens
gatgaaaagctattg

SEQ ID NO: 22354 - DNA, 15 bp, Homo sapiens
tgatgaaaagctatt

SEQ ID NO: 22355 - DNA, 15 bp, Homo sapiens
ctgatgaaaagctat

SEQ ID NO: 22356 - DNA, 15 bp, Homo sapiens
actgatgaaaagcta

SEQ ID NO: 22357 - DNA, 15 bp, Homo sapiens
gactgatgaaaagct

SEQ ID NO: 22358 - DNA, 15 bp, Homo sapiens
ggactgatgaaaagc

SEQ ID NO: 22359 - DNA, 15 bp, Homo sapiens
aggactgatgaaaag

SEQ ID NO: 22360 - DNA, 15 bp, Homo sapiens
aaggactgatgaaaa

SEQ ID NO: 22361 - DNA, 15 bp, Homo sapiens
caaggactgatgaaa

SEQ ID NO: 22362 - DNA, 15 bp, Homo sapiens
acaaggactgatgaa

SEQ ID NO: 22363 - DNA, 15 bp, Homo sapiens
gacaaggactgatga

SEQ ID NO: 22364 - DNA, 15 bp, Homo sapiens
agacaaggactgatg

SEQ ID NO: 22365 - DNA, 15 bp, Homo sapiens
cagacaaggactgat

SEQ ID NO: 22366 - DNA, 15 bp, Homo sapiens
gcagacaaggactga

SEQ ID NO: 22367 - DNA, 15 bp, Homo sapiens
tgcagacaaggactg

SEQ ID NO: 22368 - DNA, 15 bp, Homo sapiens
atgcagacaaggact

SEQ ID NO: 22369 - DNA, 15 bp, Homo sapiens
tatgcagacaaggac

SEQ ID NO: 22370 - DNA, 15 bp, Homo sapiens
ttatgcagacaagga

SEQ ID NO: 22371 - DNA, 15 bp, Homo sapiens
tttatgcagacaagg

SEQ ID NO: 22372 - DNA, 15 bp, Homo sapiens
atttatgcagacaag

SEQ ID NO: 22373 - DNA, 15 bp, Homo sapiens
gatttatgcagacaa

SEQ ID NO: 22374 - DNA, 15 bp, Homo sapiens
tgatttatgcagaca

SEQ ID NO: 22375 - DNA, 15 bp, Homo sapiens
ctgatttatgcagac

SEQ ID NO: 22376 - DNA, 15 bp, Homo sapiens
gctgatttatgcaga

SEQ ID NO: 22377 - DNA, 15 bp, Homo sapiens
agctgatttatgcag

SEQ ID NO: 22378 - DNA, 15 bp, Homo sapiens
tagctgatttatgca

SEQ ID NO: 22379 - DNA, 15 bp, Homo sapiens
ctagctgatttatgc

SEQ ID NO: 22380 - DNA, 15 bp, Homo sapiens
tctagctgatttatg

SEQ ID NO: 22381 - DNA, 15 bp, Homo sapiens
ctctagctgatttat

SEQ ID NO: 22382 - DNA, 15 bp, Homo sapiens
actctagctgattta

SEQ ID NO: 22383 - DNA, 15 bp, Homo sapiens
aactctagctgattt

SEQ ID NO: 22384 - DNA, 15 bp, Homo sapiens
caactctagctgatt

SEQ ID NO: 22385 - DNA, 15 bp, Homo sapiens
ccaactctagctgat

SEQ ID NO: 22386 - DNA, 15 bp, Homo sapiens
accaactctagctga

SEQ ID NO: 22387 - DNA, 15 bp, Homo sapiens
aaccaactctagctg

SEQ ID NO: 22388 - DNA, 15 bp, Homo sapiens
aaaccaactctagct

SEQ ID NO: 22389 - DNA, 15 bp, Homo sapiens
gaaaccaactctagc

SEQ ID NO: 22390 - DNA, 15 bp, Homo sapiens
agaaaccaactctag

SEQ ID NO: 22391 - DNA, 15 bp, Homo sapiens
tagaaaccaactcta

SEQ ID NO: 22392 - DNA, 15 bp, Homo sapiens
atagaaaccaactct

SEQ ID NO: 22393 - DNA, 15 bp, Homo sapiens
aatagaaaccaactc

SEQ ID NO: 22394 - DNA, 15 bp, Homo sapiens
caatagaaaccaact

SEQ ID NO: 22395 - DNA, 15 bp, Homo sapiens
tcaatagaaaccaac

SEQ ID NO: 22396 - DNA, 15 bp, Homo sapiens
atcaatagaaaccaa

SEQ ID NO: 22397 - DNA, 15 bp, Homo sapiens
aatcaatagaaacca

SEQ ID NO: 22398 - DNA, 15 bp, Homo sapiens
caatcaatagaaacc

SEQ ID NO: 22399 - DNA, 15 bp, Homo sapiens
gcaatcaatagaaac

SEQ ID NO: 22400 - DNA, 15 bp, Homo sapiens
ggcaatcaatagaaa

SEQ ID NO: 22401 - DNA, 15 bp, Homo sapiens
tggcaatcaatagaa

SEQ ID NO: 22402 - DNA, 15 bp, Homo sapiens
gtggcaatcaataga

SEQ ID NO: 22403 - DNA, 15 bp, Homo sapiens
ggtggcaatcaatag

SEQ ID NO: 22404 - DNA, 15 bp, Homo sapiens
tggtggcaatcaata

SEQ ID NO: 22405 - DNA, 15 bp, Homo sapiens
ttggtggcaatcaat

SEQ ID NO: 22406 - DNA, 15 bp, Homo sapiens
attggtggcaatcaa

SEQ ID NO: 22407 - DNA, 15 bp, Homo sapiens
tattggtggcaatca

SEQ ID NO: 22408 - DNA, 15 bp, Homo sapiens
ttattggtggcaatc

SEQ ID NO: 22409 - DNA, 15 bp, Homo sapiens
attattggtggcaat

SEQ ID NO: 22410 - DNA, 15 bp, Homo sapiens
gattattggtggcaa

SEQ ID NO: 22411 - DNA, 15 bp, Homo sapiens
agattattggtggca

SEQ ID NO: 22412 - DNA, 15 bp, Homo sapiens
aagattattggtggc

SEQ ID NO: 22413 - DNA, 15 bp, Homo sapiens
caagattattggtgg

SEQ ID NO: 22414 - DNA, 15 bp, Homo sapiens
tcaagattattggtg

SEQ ID NO: 22415 - DNA, 15 bp, Homo sapiens
gtcaagattattggt

SEQ ID NO: 22416 - DNA, 15 bp, Homo sapiens
tgtcaagattattgg

SEQ ID NO: 22417 - DNA, 15 bp, Homo sapiens
ctgtcaagattattg

SEQ ID NO: 22418 - DNA, 15 bp, Homo sapiens
tctgtcaagattatt

SEQ ID NO: 22419 - DNA, 15 bp, Homo sapiens
atctgtcaagattat

SEQ ID NO: 22420 - DNA, 15 bp, Homo sapiens
tatctgtcaagatta

SEQ ID NO: 22421 - DNA, 15 bp, Homo sapiens
atatctgtcaagatt

SEQ ID NO: 22422 - DNA, 15 bp, Homo sapiens
catatctgtcaagat

SEQ ID NO: 22423 - DNA, 15 bp, Homo sapiens
acatatctgtcaaga

SEQ ID NO: 22424 - DNA, 15 bp, Homo sapiens
gacatatctgtcaag

SEQ ID NO: 22425 - DNA, 15 bp, Homo sapiens
agacatatctgtcaa

SEQ ID NO: 22426 - DNA, 15 bp, Homo sapiens
cagacatatctgtca

SEQ ID NO: 22427 - DNA, 15 bp, Homo sapiens
tcagacatatctgtc

SEQ ID NO: 22428 - DNA, 15 bp, Homo sapiens
atcagacatatctgt

SEQ ID NO: 22429 - DNA, 15 bp, Homo sapiens
gatcagacatatctg

SEQ ID NO: 22430 - DNA, 15 bp, Homo sapiens
agatcagacatatct

SEQ ID NO: 22431 - DNA, 15 bp, Homo sapiens
aagatcagacatatc

SEQ ID NO: 22432 - DNA, 15 bp, Homo sapiens
gaagatcagacatat

SEQ ID NO: 22433 - DNA, 15 bp, Homo sapiens
ggaagatcagacata

SEQ ID NO: 22434 - DNA, 15 bp, Homo sapiens
aggaagatcagacat

SEQ ID NO: 22435 - DNA, 15 bp, Homo sapiens
aaggaagatcagaca

SEQ ID NO: 22436 - DNA, 15 bp, Homo sapiens
gaaggaagatcagac

SEQ ID NO: 22437 - DNA, 15 bp, Homo sapiens
agaaggaagatcaga

SEQ ID NO: 22438 - DNA, 15 bp, Homo sapiens
gagaaggaagatcag

SEQ ID NO: 22439 - DNA, 15 bp, Homo sapiens
agagaaggaagatca

SEQ ID NO: 22440 - DNA, 15 bp, Homo sapiens
cagagaaggaagatc

SEQ ID NO: 22441 - DNA, 15 bp, Homo sapiens
gcagagaaggaagat

SEQ ID NO: 22442 - DNA, 15 bp, Homo sapiens
tgcagagaaggaaga

SEQ ID NO: 22443 - DNA, 15 bp, Homo sapiens
gtgcagagaaggaag

SEQ ID NO: 22444 - DNA, 15 bp, Homo sapiens
agtgcagagaaggaa

SEQ ID NO: 22445 - DNA, 15 bp, Homo sapiens
cagtgcagagaagga

SEQ ID NO: 22446 - DNA, 15 bp, Homo sapiens
tcagtgcagagaagg

SEQ ID NO: 22447 - DNA, 15 bp, Homo sapiens
gtcagtgcagagaag

SEQ ID NO: 22448 - DNA, 15 bp, Homo sapiens
agtcagtgcagagaa

SEQ ID NO: 22449 - DNA, 15 bp, Homo sapiens
gagtcagtgcagaga

SEQ ID NO: 22450 - DNA, 15 bp, Homo sapiens
ggagtcagtgcagag

SEQ ID NO: 22451 - DNA, 15 bp, Homo sapiens
aggagtcagtgcaga

SEQ ID NO: 22452 - DNA, 15 bp, Homo sapiens
gaggagtcagtgcag

SEQ ID NO: 22453 - DNA, 15 bp, Homo sapiens
agaggagtcagtgca

SEQ ID NO: 22454 - DNA, 15 bp, Homo sapiens
aagaggagtcagtgc

SEQ ID NO: 22455 - DNA, 15 bp, Homo sapiens
aaagaggagtcagtg

SEQ ID NO: 22456 - DNA, 15 bp, Homo sapiens
gaaagaggagtcagt

SEQ ID NO: 22457 - DNA, 15 bp, Homo sapiens
agaaagaggagtcag

SEQ ID NO: 22458 - DNA, 15 bp, Homo sapiens
gagaaagaggagtca

SEQ ID NO: 22459 - DNA, 15 bp, Homo sapiens
agagaaagaggagtc

SEQ ID NO: 22460 - DNA, 15 bp, Homo sapiens
cagagaaagaggagt

SEQ ID NO: 22461 - DNA, 15 bp, Homo sapiens
acagagaaagaggag

SEQ ID NO: 22462 - DNA, 15 bp, Homo sapiens
gacagagaaagagga

SEQ ID NO: 22463 - DNA, 15 bp, Homo sapiens
agacagagaaagagg

SEQ ID NO: 22464 - DNA, 15 bp, Homo sapiens
gagacagagaaagag

SEQ ID NO: 22465 - DNA, 15 bp, Homo sapiens
ggagacagagaaaga

SEQ ID NO: 22466 - DNA, 15 bp, Homo sapiens
aggagacagagaaag

SEQ ID NO: 22467 - DNA, 15 bp, Homo sapiens
gaggagacagagaaa

SEQ ID NO: 22468 - DNA, 15 bp, Homo sapiens
agaggagacagagaa

SEQ ID NO: 22469 - DNA, 15 bp, Homo sapiens
cagaggagacagaga

SEQ ID NO: 22470 - DNA, 15 bp, Homo sapiens
gcagaggagacagag

SEQ ID NO: 22471 - DNA, 15 bp, Homo sapiens
agcagaggagacaga

SEQ ID NO: 22472 - DNA, 15 bp, Homo sapiens
cagcagaggagacag

SEQ ID NO: 22473 - DNA, 15 bp, Homo sapiens
tcagcagaggagaca

SEQ ID NO: 22474 - DNA, 15 bp, Homo sapiens
atcagcagaggagac

SEQ ID NO: 22475 - DNA, 15 bp, Homo sapiens
aatcagcagaggaga

SEQ ID NO: 22476 - DNA, 15 bp, Homo sapiens
gaatcagcagaggag

SEQ ID NO: 22477 - DNA, 15 bp, Homo sapiens
agaatcagcagagga

SEQ ID NO: 22478 - DNA, 15 bp, Homo sapiens
aagaatcagcagagg

SEQ ID NO: 22479 - DNA, 15 bp, Homo sapiens
aaagaatcagcagag

SEQ ID NO: 22480 - DNA, 15 bp, Homo sapiens
gaaagaatcagcaga

SEQ ID NO: 22481 - DNA, 15 bp, Homo sapiens
agaaagaatcagcag

SEQ ID NO: 22482 - DNA, 15 bp, Homo sapiens
gagaaagaatcagca

SEQ ID NO: 22483 - DNA, 15 bp, Homo sapiens
ggagaaagaatcagc

SEQ ID NO: 22484 - DNA, 15 bp, Homo sapiens
aggagaaagaatcag

SEQ ID NO: 22485 - DNA, 15 bp, Homo sapiens
gaggagaaagaatca

SEQ ID NO: 22486 - DNA, 15 bp, Homo sapiens
tgaggagaaagaatc

SEQ ID NO: 22487 - DNA, 15 bp, Homo sapiens
atgaggagaaagaat

SEQ ID NO: 22488 - DNA, 15 bp, Homo sapiens
gatgaggagaaagaa

SEQ ID NO: 22489 - DNA, 15 bp, Homo sapiens
tgatgaggagaaaga

SEQ ID NO: 22490 - DNA, 15 bp, Homo sapiens
gtgatgaggagaaag

SEQ ID NO: 22491 - DNA, 15 bp, Homo sapiens
tgtgatgaggagaaa

SEQ ID NO: 22492 - DNA, 15 bp, Homo sapiens
ttgtgatgaggagaa

SEQ ID NO: 22493 - DNA, 15 bp, Homo sapiens
gttgtgatgaggaga

SEQ ID NO: 22494 - DNA, 15 bp, Homo sapiens
agttgtgatgaggag

SEQ ID NO: 22495 - DNA, 15 bp, Homo sapiens
gagttgtgatgagga

SEQ ID NO: 22496 - DNA, 15 bp, Homo sapiens
ggagttgtgatgagg

SEQ ID NO: 22497 - DNA, 15 bp, Homo sapiens
tggagttgtgatgag

SEQ ID NO: 22498 - DNA, 15 bp, Homo sapiens
ttggagttgtgatga

SEQ ID NO: 22499 - DNA, 15 bp, Homo sapiens
tttggagttgtgatg

SEQ ID NO: 22500 - DNA, 15 bp, Homo sapiens
atttggagttgtgat

SEQ ID NO: 22501 - DNA, 15 bp, Homo sapiens
tatttggagttgtga

SEQ ID NO: 22502 - DNA, 15 bp, Homo sapiens
ctatttggagttgtg

SEQ ID NO: 22503 - DNA, 15 bp, Homo sapiens
gctatttggagttgt

SEQ ID NO: 22504 - DNA, 15 bp, Homo sapiens
tgctatttggagttg

SEQ ID NO: 22505 - DNA, 15 bp, Homo sapiens
ctgctatttggagtt

SEQ ID NO: 22506 - DNA, 15 bp, Homo sapiens
cctgctatttggagt

SEQ ID NO: 22507 - DNA, 15 bp, Homo sapiens
ccctgctatttggag

SEQ ID NO: 22508 - DNA, 15 bp, Homo sapiens
cccctgctatttgga

SEQ ID NO: 22509 - DNA, 15 bp, Homo sapiens
ccccctgctatttgg

SEQ ID NO: 22510 - DNA, 15 bp, Homo sapiens
tccccctgctatttg

SEQ ID NO: 22511 - DNA, 15 bp, Homo sapiens
ctccccctgctattt

SEQ ID NO: 22512 - DNA, 15 bp, Homo sapiens
cctccccctgctatt

SEQ ID NO: 22513 - DNA, 15 bp, Homo sapiens
ccctccccctgctat

SEQ ID NO: 22514 - DNA, 15 bp, Homo sapiens
accctccccctgcta

SEQ ID NO: 22515 - DNA, 15 bp, Homo sapiens
aaccctccccctgct

SEQ ID NO: 22516 - DNA, 15 bp, Homo sapiens
caaccctccccctgc

SEQ ID NO: 22517 - DNA, 15 bp, Homo sapiens
acaaccctccccctg

SEQ ID NO: 22518 - DNA, 15 bp, Homo sapiens
aacaaccctccccct

SEQ ID NO: 22519 - DNA, 15 bp, Homo sapiens
aaacaaccctccccc

SEQ ID NO: 22520 - DNA, 15 bp, Homo sapiens
taaacaaccctcccc

SEQ ID NO: 22521 - DNA, 15 bp, Homo sapiens
gtaaacaaccctccc

SEQ ID NO: 22522 - DNA, 15 bp, Homo sapiens
tgtaaacaaccctcc

SEQ ID NO: 22523 - DNA, 15 bp, Homo sapiens
gtgtaaacaaccctc

SEQ ID NO: 22524 - DNA, 15 bp, Homo sapiens
agtgtaaacaaccct

SEQ ID NO: 22525 - DNA, 15 bp, Homo sapiens
aagtgtaaacaaccc

SEQ ID NO: 22526 - DNA, 15 bp, Homo sapiens
taagtgtaaacaacc

SEQ ID NO: 22527 - DNA, 15 bp, Homo sapiens
ataagtgtaaacaac

SEQ ID NO: 22528 - DNA, 15 bp, Homo sapiens
tataagtgtaaacaa

SEQ ID NO: 22529 - DNA, 15 bp, Homo sapiens
atataagtgtaaaca

SEQ ID NO: 22530 - DNA, 15 bp, Homo sapiens
aatataagtgtaaac

SEQ ID NO: 22531 - DNA, 15 bp, Homo sapiens
gaatataagtgtaaa

SEQ ID NO: 22532 - DNA, 15 bp, Homo sapiens
tgaatataagtgtaa

SEQ ID NO: 22533 - DNA, 15 bp, Homo sapiens
ctgaatataagtgta

SEQ ID NO: 22534 - DNA, 15 bp, Homo sapiens
gctgaatataagtgt

SEQ ID NO: 22535 - DNA, 15 bp, Homo sapiens
tgctgaatataagtg

SEQ ID NO: 22536 - DNA, 15 bp, Homo sapiens
gtgctgaatataagt

SEQ ID NO: 22537 - DNA, 15 bp, Homo sapiens
cgtgctgaatataag

SEQ ID NO: 22538 - DNA, 15 bp, Homo sapiens
gcgtgctgaatataa

SEQ ID NO: 22539 - DNA, 15 bp, Homo sapiens
ggcgtgctgaatata

SEQ ID NO: 22540 - DNA, 15 bp, Homo sapiens
gggcgtgctgaatat

SEQ ID NO: 22541 - DNA, 15 bp, Homo sapiens
agggcgtgctgaata

SEQ ID NO: 22542 - DNA, 15 bp, Homo sapiens
gagggcgtgctgaat

SEQ ID NO: 22543 - DNA, 15 bp, Homo sapiens
tgagggcgtgctgaa

SEQ ID NO: 22544 - DNA, 15 bp, Homo sapiens
gtgagggcgtgctga

SEQ ID NO: 22545 - DNA, 15 bp, Homo sapiens
cgtgagggcgtgctg

SEQ ID NO: 22546 - DNA, 15 bp, Homo sapiens
gcgtgagggcgtgct

SEQ ID NO: 22547 - DNA, 15 bp, Homo sapiens
tgcgtgagggcgtgc

SEQ ID NO: 22548 - DNA, 15 bp, Homo sapiens
gtgcgtgagggcgtg

SEQ ID NO: 22549 - DNA, 15 bp, Homo sapiens
agtgcgtgagggcgt

SEQ ID NO: 22550 - DNA, 15 bp, Homo sapiens
gagtgcgtgagggcg

SEQ ID NO: 22551 - DNA, 15 bp, Homo sapiens
cgagtgcgtgagggc

SEQ ID NO: 22552 - DNA, 15 bp, Homo sapiens
gcgagtgcgtgaggg

SEQ ID NO: 22553 - DNA, 15 bp, Homo sapiens
ggcgagtgcgtgagg

SEQ ID NO: 22554 - DNA, 15 bp, Homo sapiens
aggcgagtgcgtgag

SEQ ID NO: 22555 - DNA, 15 bp, Homo sapiens
caggcgagtgcgtga

SEQ ID NO: 22556 - DNA, 15 bp, Homo sapiens
ccaggcgagtgcgtg

SEQ ID NO: 22557 - DNA, 15 bp, Homo sapiens
gccaggcgagtgcgt

SEQ ID NO: 22558 - DNA, 15 bp, Homo sapiens
agccaggcgagtgcg

SEQ ID NO: 22559 - DNA, 15 bp, Homo sapiens
gagccaggcgagtgc

SEQ ID NO: 22560 - DNA, 15 bp, Homo sapiens
agagccaggcgagtg

SEQ ID NO: 22561 - DNA, 15 bp, Homo sapiens
aagagccaggcgagt

SEQ ID NO: 22562 - DNA, 15 bp, Homo sapiens
gaagagccaggcgag

SEQ ID NO: 22563 - DNA, 15 bp, Homo sapiens
tgaagagccaggcga

SEQ ID NO: 22564 - DNA, 15 bp, Homo sapiens
ctgaagagccaggcg

SEQ ID NO: 22565 - DNA, 15 bp, Homo sapiens
tctgaagagccaggc

SEQ ID NO: 22566 - DNA, 15 bp, Homo sapiens
gtctgaagagccagg

SEQ ID NO: 22567 - DNA, 15 bp, Homo sapiens
ggtctgaagagccag

SEQ ID NO: 22568 - DNA, 15 bp, Homo sapiens
aggtctgaagagcca

SEQ ID NO: 22569 - DNA, 15 bp, Homo sapiens
gaggtctgaagagcc

SEQ ID NO: 22570 - DNA, 15 bp, Homo sapiens
agaggtctgaagagc

SEQ ID NO: 22571 - DNA, 15 bp, Homo sapiens
gagaggtctgaagag

SEQ ID NO: 22572 - DNA, 15 bp, Homo sapiens
ggagaggtctgaaga

SEQ ID NO: 22573 - DNA, 15 bp, Homo sapiens
gggagaggtctgaag

SEQ ID NO: 22574 - DNA, 15 bp, Homo sapiens
ggggagaggtctgaa

SEQ ID NO: 22575 - DNA, 15 bp, Homo sapiens
aggggagaggtctga

SEQ ID NO: 22576 - DNA, 15 bp, Homo sapiens
caggggagaggtctg

SEQ ID NO: 22577 - DNA, 15 bp, Homo sapiens
tcaggggagaggtct

SEQ ID NO: 22578 - DNA, 15 bp, Homo sapiens
ttcaggggagaggtc

SEQ ID NO: 22579 - DNA, 15 bp, Homo sapiens
gttcaggggagaggt

SEQ ID NO: 22580 - DNA, 15 bp, Homo sapiens
agttcaggggagagg

SEQ ID NO: 22581 - DNA, 15 bp, Homo sapiens
gagttcaggggagag

SEQ ID NO: 22582 - DNA, 15 bp, Homo sapiens
ggagttcaggggaga

SEQ ID NO: 22583 - DNA, 15 bp, Homo sapiens
tggagttcaggggag

SEQ ID NO: 22584 - DNA, 15 bp, Homo sapiens
ctggagttcagggga

SEQ ID NO: 22585 - DNA, 15 bp, Homo sapiens
tctggagttcagggg

SEQ ID NO: 22586 - DNA, 15 bp, Homo sapiens
atctggagttcaggg

SEQ ID NO: 22587 - DNA, 15 bp, Homo sapiens
aatctggagttcagg

SEQ ID NO: 22588 - DNA, 15 bp, Homo sapiens
gaatctggagttcag

SEQ ID NO: 22589 - DNA, 15 bp, Homo sapiens
tgaatctggagttca

SEQ ID NO: 22590 - DNA, 15 bp, Homo sapiens
atgaatctggagttc

SEQ ID NO: 22591 - DNA, 15 bp, Homo sapiens
tatgaatctggagtt

SEQ ID NO: 22592 - DNA, 15 bp, Homo sapiens
gtatgaatctggagt

SEQ ID NO: 22593 - DNA, 15 bp, Homo sapiens
tgtatgaatctggag

SEQ ID NO: 22594 - DNA, 15 bp, Homo sapiens
atgtatgaatctgga

SEQ ID NO: 22595 - DNA, 15 bp, Homo sapiens
gatgtatgaatctgg

SEQ ID NO: 22596 - DNA, 15 bp, Homo sapiens
ggatgtatgaatctg

SEQ ID NO: 22597 - DNA, 15 bp, Homo sapiens
tggatgtatgaatct

SEQ ID NO: 22598 - DNA, 15 bp, Homo sapiens
ctggatgtatgaatc

SEQ ID NO: 22599 - DNA, 15 bp, Homo sapiens
gctggatgtatgaat

SEQ ID NO: 22600 - DNA, 15 bp, Homo sapiens
agctggatgtatgaa

SEQ ID NO: 22601 - DNA, 15 bp, Homo sapiens
cagctggatgtatga

SEQ ID NO: 22602 - DNA, 15 bp, Homo sapiens
gcagctggatgtatg

SEQ ID NO: 22603 - DNA, 15 bp, Homo sapiens
ggcagctggatgtat

SEQ ID NO: 22604 - DNA, 15 bp, Homo sapiens
gggcagctggatgta

SEQ ID NO: 22605 - DNA, 15 bp, Homo sapiens
agggcagctggatgt

SEQ ID NO: 22606 - DNA, 15 bp, Homo sapiens
aagggcagctggatg

SEQ ID NO: 22607 - DNA, 15 bp, Homo sapiens
aaagggcagctggat

SEQ ID NO: 22608 - DNA, 15 bp, Homo sapiens
taaagggcagctgga

SEQ ID NO: 22609 - DNA, 15 bp, Homo sapiens
ctaaagggcagctgg

SEQ ID NO: 22610 - DNA, 15 bp, Homo sapiens
cctaaagggcagctg

SEQ ID NO: 22611 - DNA, 15 bp, Homo sapiens
gcctaaagggcagct

SEQ ID NO: 22612 - DNA, 15 bp, Homo sapiens
ggcctaaagggcagc

SEQ ID NO: 22613 - DNA, 15 bp, Homo sapiens
aggcctaaagggcag

SEQ ID NO: 22614 - DNA, 15 bp, Homo sapiens
gaggcctaaagggca

SEQ ID NO: 22615 - DNA, 15 bp, Homo sapiens
agaggcctaaagggc

SEQ ID NO: 22616 - DNA, 15 bp, Homo sapiens
tagaggcctaaaggg

SEQ ID NO: 22617 - DNA, 15 bp, Homo sapiens
ctagaggcctaaagg

SEQ ID NO: 22618 - DNA, 15 bp, Homo sapiens
tctagaggcctaaag

SEQ ID NO: 22619 - DNA, 15 bp, Homo sapiens
ttctagaggcctaaa

SEQ ID NO: 22620 - DNA, 15 bp, Homo sapiens
tttctagaggcctaa

SEQ ID NO: 22621 - DNA, 15 bp, Homo sapiens
ctttctagaggccta

SEQ ID NO: 22622 - DNA, 15 bp, Homo sapiens
gctttctagaggcct

SEQ ID NO: 22623 - DNA, 15 bp, Homo sapiens
agctttctagaggcc

SEQ ID NO: 22624 - DNA, 15 bp, Homo sapiens
tagctttctagaggc

SEQ ID NO: 22625 - DNA, 15 bp, Homo sapiens
ttagctttctagagg

SEQ ID NO: 22626 - DNA, 15 bp, Homo sapiens
tttagctttctagag

SEQ ID NO: 22627 - DNA, 15 bp, Homo sapiens
atttagctttctaga

SEQ ID NO: 22628 - DNA, 15 bp, Homo sapiens
tatttagctttctag

SEQ ID NO: 22629 - DNA, 15 bp, Homo sapiens
gtatttagctttcta

SEQ ID NO: 22630 - DNA, 15 bp, Homo sapiens
ggtatttagctttct

SEQ ID NO: 22631 - DNA, 15 bp, Homo sapiens
aggtatttagctttc

SEQ ID NO: 22632 - DNA, 15 bp, Homo sapiens
gaggtatttagcttt

SEQ ID NO: 22633 - DNA, 15 bp, Homo sapiens
tgaggtatttagctt

SEQ ID NO: 22634 - DNA, 15 bp, Homo sapiens
ctgaggtatttagct

SEQ ID NO: 22635 - DNA, 15 bp, Homo sapiens
actgaggtatttagc

SEQ ID NO: 22636 - DNA, 15 bp, Homo sapiens
tactgaggtatttag

SEQ ID NO: 22637 - DNA, 15 bp, Homo sapiens
atactgaggtattta

SEQ ID NO: 22638 - DNA, 15 bp, Homo sapiens
gatactgaggtattt

SEQ ID NO: 22639 - DNA, 15 bp, Homo sapiens
tgatactgaggtatt

SEQ ID NO: 22640 - DNA, 15 bp, Homo sapiens
ttgatactgaggtat

SEQ ID NO: 22641 - DNA, 15 bp, Homo sapiens
tttgatactgaggta

SEQ ID NO: 22642 - DNA, 15 bp, Homo sapiens
ttttgatactgaggt

SEQ ID NO: 22643 - DNA, 15 bp, Homo sapiens
tttttgatactgagg

SEQ ID NO: 22644 - DNA, 15 bp, Homo sapiens
gtttttgatactgag

SEQ ID NO: 22645 - DNA, 15 bp, Homo sapiens
tgtttttgatactga

SEQ ID NO: 22646 - DNA, 15 bp, Homo sapiens
atgtttttgatactg

SEQ ID NO: 22647 - DNA, 15 bp, Homo sapiens
catgtttttgatact

SEQ ID NO: 22648 - DNA, 15 bp, Homo sapiens
tcatgtttttgatac

SEQ ID NO: 22649 - DNA, 15 bp, Homo sapiens
ctcatgtttttgata

SEQ ID NO: 22650 - DNA, 15 bp, Homo sapiens
tctcatgtttttgat

SEQ ID NO: 22651 - DNA, 15 bp, Homo sapiens
ttctcatgtttttga

SEQ ID NO: 22652 - DNA, 15 bp, Homo sapiens
tttctcatgtttttg

SEQ ID NO: 22653 - DNA, 15 bp, Homo sapiens
gtttctcatgttttt

SEQ ID NO: 22654 - DNA, 15 bp, Homo sapiens
cgtttctcatgtttt

SEQ ID NO: 22655 - DNA, 15 bp, Homo sapiens
ccgtttctcatgttt

SEQ ID NO: 22656 - DNA, 15 bp, Homo sapiens
tccgtttctcatgtt

SEQ ID NO: 22657 - DNA, 15 bp, Homo sapiens
ttccgtttctcatgt

SEQ ID NO: 22658 - DNA, 15 bp, Homo sapiens
cttccgtttctcatg

SEQ ID NO: 22659 - DNA, 15 bp, Homo sapiens
gcttccgtttctcat

SEQ ID NO: 22660 - DNA, 15 bp, Homo sapiens
ggcttccgtttctca

SEQ ID NO: 22661 - DNA, 15 bp, Homo sapiens
tggcttccgtttctc

SEQ ID NO: 22662 - DNA, 15 bp, Homo sapiens
ctggcttccgtttct

SEQ ID NO: 22663 - DNA, 15 bp, Homo sapiens
tctggcttccgtttc

SEQ ID NO: 22664 - DNA, 15 bp, Homo sapiens
ctctggcttccgttt

SEQ ID NO: 22665 - DNA, 15 bp, Homo sapiens
actctggcttccgtt

SEQ ID NO: 22666 - DNA, 15 bp, Homo sapiens
gactctggcttccgt

SEQ ID NO: 22667 - DNA, 15 bp, Homo sapiens
ggactctggcttccg

SEQ ID NO: 22668 - DNA, 15 bp, Homo sapiens
aggactctggcttcc

SEQ ID NO: 22669 - DNA, 15 bp, Homo sapiens
caggactctggcttc

SEQ ID NO: 22670 - DNA, 15 bp, Homo sapiens
ccaggactctggctt

SEQ ID NO: 22671 - DNA, 15 bp, Homo sapiens
tccaggactctggct

SEQ ID NO: 22672 - DNA, 15 bp, Homo sapiens
atccaggactctggc

SEQ ID NO: 22673 - DNA, 15 bp, Homo sapiens
gatccaggactctgg

SEQ ID NO: 22674 - DNA, 15 bp, Homo sapiens
agatccaggactctg

SEQ ID NO: 22675 - DNA, 15 bp, Homo sapiens
gagatccaggactct

SEQ ID NO: 22676 - DNA, 15 bp, Homo sapiens
agagatccaggactc

SEQ ID NO: 22677 - DNA, 15 bp, Homo sapiens
gagagatccaggact

SEQ ID NO: 22678 - DNA, 15 bp, Homo sapiens
cgagagatccaggac

SEQ ID NO: 22679 - DNA, 15 bp, Homo sapiens
gcgagagatccagga

SEQ ID NO: 22680 - DNA, 15 bp, Homo sapiens
ggcgagagatccagg

SEQ ID NO: 22681 - DNA, 15 bp, Homo sapiens
gggcgagagatccag

SEQ ID NO: 22682 - DNA, 15 bp, Homo sapiens
agggcgagagatcca

SEQ ID NO: 22683 - DNA, 15 bp, Homo sapiens
aagggcgagagatcc

SEQ ID NO: 22684 - DNA, 15 bp, Homo sapiens
aaagggcgagagatc

SEQ ID NO: 22685 - DNA, 15 bp, Homo sapiens
gaaagggcgagagat

SEQ ID NO: 22686 - DNA, 15 bp, Homo sapiens
cgaaagggcgagaga

SEQ ID NO: 22687 - DNA, 15 bp, Homo sapiens
gcgaaagggcgagag

SEQ ID NO: 22688 - DNA, 15 bp, Homo sapiens
agcgaaagggcgaga

SEQ ID NO: 22689 - DNA, 15 bp, Homo sapiens
cagcgaaagggcgag

SEQ ID NO: 22690 - DNA, 15 bp, Homo sapiens
acagcgaaagggcga

SEQ ID NO: 22691 - DNA, 15 bp, Homo sapiens
gacagcgaaagggcg

SEQ ID NO: 22692 - DNA, 15 bp, Homo sapiens
ggacagcgaaagggc

SEQ ID NO: 22693 - DNA, 15 bp, Homo sapiens
gggacagcgaaaggg

SEQ ID NO: 22694 - DNA, 15 bp, Homo sapiens
cgggacagcgaaagg

SEQ ID NO: 22695 - DNA, 15 bp, Homo sapiens
ccgggacagcgaaag

SEQ ID NO: 22696 - DNA, 15 bp, Homo sapiens
accgggacagcgaaa

SEQ ID NO: 22697 - DNA, 15 bp, Homo sapiens
caccgggacagcgaa

SEQ ID NO: 22698 - DNA, 15 bp, Homo sapiens
gcaccgggacagcga

SEQ ID NO: 22699 - DNA, 15 bp, Homo sapiens
ggcaccgggacagcg

SEQ ID NO: 22700 - DNA, 15 bp, Homo sapiens
gggcaccgggacagc

SEQ ID NO: 22701 - DNA, 15 bp, Homo sapiens
tgggcaccgggacag

SEQ ID NO: 22702 - DNA, 15 bp, Homo sapiens
atgggcaccgggaca

SEQ ID NO: 22703 - DNA, 15 bp, Homo sapiens
catgggcaccgggac

SEQ ID NO: 22704 - DNA, 15 bp, Homo sapiens
gcatgggcaccggga

SEQ ID NO: 22705 - DNA, 15 bp, Homo sapiens
ggcatgggcaccggg

SEQ ID NO: 22706 - DNA, 15 bp, Homo sapiens
gggcatgggcaccgg

SEQ ID NO: 22707 - DNA, 15 bp, Homo sapiens
agggcatgggcaccg

SEQ ID NO: 22708 - DNA, 15 bp, Homo sapiens
aagggcatgggcacc

SEQ ID NO: 22709 - DNA, 15 bp, Homo sapiens
gaagggcatgggcac

SEQ ID NO: 22710 - DNA, 15 bp, Homo sapiens
tgaagggcatgggca

SEQ ID NO: 22711 - DNA, 15 bp, Homo sapiens
ctgaagggcatgggc

SEQ ID NO: 22712 - DNA, 15 bp, Homo sapiens
cctgaagggcatggg

SEQ ID NO: 22713 - DNA, 15 bp, Homo sapiens
ccctgaagggcatgg

SEQ ID NO: 22714 - DNA, 15 bp, Homo sapiens
tccctgaagggcatg

SEQ ID NO: 22715 - DNA, 15 bp, Homo sapiens
atccctgaagggcat

SEQ ID NO: 22716 - DNA, 15 bp, Homo sapiens
catccctgaagggca

SEQ ID NO: 22717 - DNA, 15 bp, Homo sapiens
ccatccctgaagggc

SEQ ID NO: 22718 - DNA, 15 bp, Homo sapiens
gccatccctgaaggg

SEQ ID NO: 22719 - DNA, 15 bp, Homo sapiens
tgccatccctgaagg

SEQ ID NO: 22720 - DNA, 15 bp, Homo sapiens
gtgccatccctgaag

SEQ ID NO: 22721 - DNA, 15 bp, Homo sapiens
ggtgccatccctgaa

SEQ ID NO: 22722 - DNA, 15 bp, Homo sapiens
aggtgccatccctga

SEQ ID NO: 22723 - DNA, 15 bp, Homo sapiens
taggtgccatccctg

SEQ ID NO: 22724 - DNA, 15 bp, Homo sapiens
ctaggtgccatccct

SEQ ID NO: 22725 - DNA, 15 bp, Homo sapiens
tctaggtgccatccc

SEQ ID NO: 22726 - DNA, 15 bp, Homo sapiens
gtctaggtgccatcc

SEQ ID NO: 22727 - DNA, 15 bp, Homo sapiens
ggtctaggtgccatc

SEQ ID NO: 22728 - DNA, 15 bp, Homo sapiens
tggtctaggtgccat

SEQ ID NO: 22729 - DNA, 15 bp, Homo sapiens
ctggtctaggtgcca

SEQ ID NO: 22730 - DNA, 15 bp, Homo sapiens
gctggtctaggtgcc

SEQ ID NO: 22731 - DNA, 15 bp, Homo sapiens
agctggtctaggtgc

SEQ ID NO: 22732 - DNA, 15 bp, Homo sapiens
gagctggtctaggtg

SEQ ID NO: 22733 - DNA, 15 bp, Homo sapiens
ggagctggtctaggt

SEQ ID NO: 22734 - DNA, 15 bp, Homo sapiens
gggagctggtctagg

SEQ ID NO: 22735 - DNA, 15 bp, Homo sapiens
agggagctggtctag

SEQ ID NO: 22736 - DNA, 15 bp, Homo sapiens
cagggagctggtcta

SEQ ID NO: 22737 - DNA, 15 bp, Homo sapiens
gcagggagctggtct

SEQ ID NO: 22738 - DNA, 15 bp, Homo sapiens
tgcagggagctggtc

SEQ ID NO: 22739 - DNA, 15 bp, Homo sapiens
atgcagggagctggt

SEQ ID NO: 22740 - DNA, 15 bp, Homo sapiens
gatgcagggagctgg

SEQ ID NO: 22741 - DNA, 15 bp, Homo sapiens
ggatgcagggagctg

SEQ ID NO: 22742 - DNA, 15 bp, Homo sapiens
gggatgcagggagct

SEQ ID NO: 22743 - DNA, 15 bp, Homo sapiens
agggatgcagggagc

SEQ ID NO: 22744 - DNA, 15 bp, Homo sapiens
cagggatgcagggag

SEQ ID NO: 22745 - DNA, 15 bp, Homo sapiens
gcagggatgcaggga

SEQ ID NO: 22746 - DNA, 15 bp, Homo sapiens
ggcagggatgcaggg

SEQ ID NO: 22747 - DNA, 15 bp, Homo sapiens
aggcagggatgcagg

SEQ ID NO: 22748 - DNA, 15 bp, Homo sapiens
taggcagggatgcag

SEQ ID NO: 22749 - DNA, 15 bp, Homo sapiens
ctaggcagggatgca

SEQ ID NO: 22750 - DNA, 15 bp, Homo sapiens
tctaggcagggatgc

SEQ ID NO: 22751 - DNA, 15 bp, Homo sapiens
gtctaggcagggatg

SEQ ID NO: 22752 - DNA, 15 bp, Homo sapiens
agtctaggcagggat

SEQ ID NO: 22753 - DNA, 15 bp, Homo sapiens
gagtctaggcaggga

SEQ ID NO: 22754 - DNA, 15 bp, Homo sapiens
agagtctaggcaggg

SEQ ID NO: 22755 - DNA, 15 bp, Homo sapiens
cagagtctaggcagg

SEQ ID NO: 22756 - DNA, 15 bp, Homo sapiens
gcagagtctaggcag

SEQ ID NO: 22757 - DNA, 15 bp, Homo sapiens
tgcagagtctaggca

SEQ ID NO: 22758 - DNA, 15 bp, Homo sapiens
ctgcagagtctaggc

SEQ ID NO: 22759 - DNA, 15 bp, Homo sapiens
actgcagagtctagg

SEQ ID NO: 22760 - DNA, 15 bp, Homo sapiens
tactgcagagtctag

SEQ ID NO: 22761 - DNA, 15 bp, Homo sapiens
ctactgcagagtcta

SEQ ID NO: 22762 - DNA, 15 bp, Homo sapiens
actactgcagagtct

SEQ ID NO: 22763 - DNA, 15 bp, Homo sapiens
gactactgcagagtc

SEQ ID NO: 22764 - DNA, 15 bp, Homo sapiens
agactactgcagagt

SEQ ID NO: 22765 - DNA, 15 bp, Homo sapiens
gagactactgcagag

SEQ ID NO: 22766 - DNA, 15 bp, Homo sapiens
tgagactactgcaga

SEQ ID NO: 22767 - DNA, 15 bp, Homo sapiens
gtgagactactgcag

SEQ ID NO: 22768 - DNA, 15 bp, Homo sapiens
cgtgagactactgca

SEQ ID NO: 22769 - DNA, 15 bp, Homo sapiens
acgtgagactactgc

SEQ ID NO: 22770 - DNA, 15 bp, Homo sapiens
cacgtgagactactg

SEQ ID NO: 22771 - DNA, 15 bp, Homo sapiens
ccacgtgagactact

SEQ ID NO: 22772 - DNA, 15 bp, Homo sapiens
gccacgtgagactac

SEQ ID NO: 22773 - DNA, 15 bp, Homo sapiens
tgccacgtgagacta

SEQ ID NO: 22774 - DNA, 15 bp, Homo sapiens
ctgccacgtgagact

SEQ ID NO: 22775 - DNA, 15 bp, Homo sapiens
tctgccacgtgagac

SEQ ID NO: 22776 - DNA, 15 bp, Homo sapiens
gtctgccacgtgaga

SEQ ID NO: 22777 - DNA, 15 bp, Homo sapiens
ggtctgccacgtgag

SEQ ID NO: 22778 - DNA, 15 bp, Homo sapiens
gggtctgccacgtga

SEQ ID NO: 22779 - DNA, 15 bp, Homo sapiens
cgggtctgccacgtg

SEQ ID NO: 22780 - DNA, 15 bp, Homo sapiens
ccgggtctgccacgt

SEQ ID NO: 22781 - DNA, 15 bp, Homo sapiens
tccgggtctgccacg

SEQ ID NO: 22782 - DNA, 15 bp, Homo sapiens
ctccgggtctgccac

SEQ ID NO: 22783 - DNA, 15 bp, Homo sapiens
cctccgggtctgcca

SEQ ID NO: 22784 - DNA, 15 bp, Homo sapiens
acctccgggtctgcc

SEQ ID NO: 22785 - DNA, 15 bp, Homo sapiens
gacctccgggtctgc

SEQ ID NO: 22786 - DNA, 15 bp, Homo sapiens
tgacctccgggtctg

SEQ ID NO: 22787 - DNA, 15 bp, Homo sapiens
gtgacctccgggtct

SEQ ID NO: 22788 - DNA, 15 bp, Homo sapiens
agtgacctccgggtc

SEQ ID NO: 22789 - DNA, 15 bp, Homo sapiens
gagtgacctccgggt

SEQ ID NO: 22790 - DNA, 15 bp, Homo sapiens
agagtgacctccggg

SEQ ID NO: 22791 - DNA, 15 bp, Homo sapiens
gagagtgacctccgg

SEQ ID NO: 22792 - DNA, 15 bp, Homo sapiens
ggagagtgacctccg

SEQ ID NO: 22793 - DNA, 15 bp, Homo sapiens
aggagagtgacctcc

SEQ ID NO: 22794 - DNA, 15 bp, Homo sapiens
gaggagagtgacctc

SEQ ID NO: 22795 - DNA, 15 bp, Homo sapiens
agaggagagtgacct

SEQ ID NO: 22796 - DNA, 15 bp, Homo sapiens
gagaggagagtgacc

SEQ ID NO: 22797 - DNA, 15 bp, Homo sapiens
agagaggagagtgac

SEQ ID NO: 22798 - DNA, 15 bp, Homo sapiens
cagagaggagagtga

SEQ ID NO: 22799 - DNA, 15 bp, Homo sapiens
ccagagaggagagtg

SEQ ID NO: 22800 - DNA, 15 bp, Homo sapiens
tccagagaggagagt

SEQ ID NO: 22801 - DNA, 15 bp, Homo sapiens
atccagagaggagag

SEQ ID NO: 22802 - DNA, 15 bp, Homo sapiens
catccagagaggaga

SEQ ID NO: 22803 - DNA, 15 bp, Homo sapiens
gcatccagagaggag

SEQ ID NO: 22804 - DNA, 15 bp, Homo sapiens
ggcatccagagagga

SEQ ID NO: 22805 - DNA, 15 bp, Homo sapiens
gggcatccagagagg

SEQ ID NO: 22806 - DNA, 15 bp, Homo sapiens
agggcatccagagag

SEQ ID NO: 22807 - DNA, 15 bp, Homo sapiens
cagggcatccagaga

SEQ ID NO: 22808 - DNA, 15 bp, Homo sapiens
gcagggcatccagag

SEQ ID NO: 22809 - DNA, 15 bp, Homo sapiens
cgcagggcatccaga

SEQ ID NO: 22810 - DNA, 15 bp, Homo sapiens
ccgcagggcatccag

SEQ ID NO: 22811 - DNA, 15 bp, Homo sapiens
tccgcagggcatcca

SEQ ID NO: 22812 - DNA, 15 bp, Homo sapiens
gtccgcagggcatcc

SEQ ID NO: 22813 - DNA, 15 bp, Homo sapiens
tgtccgcagggcatc

SEQ ID NO: 22814 - DNA, 15 bp, Homo sapiens
gtgtccgcagggcat

SEQ ID NO: 22815 - DNA, 15 bp, Homo sapiens
agtgtccgcagggca

SEQ ID NO: 22816 - DNA, 15 bp, Homo sapiens
gagtgtccgcagggc

SEQ ID NO: 22817 - DNA, 15 bp, Homo sapiens
ggagtgtccgcaggg

SEQ ID NO: 22818 - DNA, 15 bp, Homo sapiens
cggagtgtccgcagg

SEQ ID NO: 22819 - DNA, 15 bp, Homo sapiens
ccggagtgtccgcag

SEQ ID NO: 22820 - DNA, 15 bp, Homo sapiens
accggagtgtccgca

SEQ ID NO: 22821 - DNA, 15 bp, Homo sapiens
aaccggagtgtccgc

SEQ ID NO: 22822 - DNA, 15 bp, Homo sapiens
taaccggagtgtccg

SEQ ID NO: 22823 - DNA, 15 bp, Homo sapiens
ctaaccggagtgtcc

SEQ ID NO: 22824 - DNA, 15 bp, Homo sapiens
gctaaccggagtgtc

SEQ ID NO: 22825 - DNA, 15 bp, Homo sapiens
ggctaaccggagtgt

SEQ ID NO: 22826 - DNA, 15 bp, Homo sapiens
aggctaaccggagtg

SEQ ID NO: 22827 - DNA, 15 bp, Homo sapiens
gaggctaaccggagt

SEQ ID NO: 22828 - DNA, 15 bp, Homo sapiens
tgaggctaaccggag

SEQ ID NO: 22829 - DNA, 15 bp, Homo sapiens
ctgaggctaaccgga

SEQ ID NO: 22830 - DNA, 15 bp, Homo sapiens
gctgaggctaaccgg

SEQ ID NO: 22831 - DNA, 15 bp, Homo sapiens
agctgaggctaaccg

SEQ ID NO: 22832 - DNA, 15 bp, Homo sapiens
cagctgaggctaacc

SEQ ID NO: 22833 - DNA, 15 bp, Homo sapiens
gcagctgaggctaac

SEQ ID NO: 22834 - DNA, 15 bp, Homo sapiens
tgcagctgaggctaa

SEQ ID NO: 22835 - DNA, 15 bp, Homo sapiens
ttgcagctgaggcta

SEQ ID NO: 22836 - DNA, 15 bp, Homo sapiens
cttgcagctgaggct

SEQ ID NO: 22837 - DNA, 15 bp, Homo sapiens
tcttgcagctgaggc

SEQ ID NO: 22838 - DNA, 15 bp, Homo sapiens
ctcttgcagctgagg

SEQ ID NO: 22839 - DNA, 15 bp, Homo sapiens
gctcttgcagctgag

SEQ ID NO: 22840 - DNA, 15 bp, Homo sapiens
ggctcttgcagctga

SEQ ID NO: 22841 - DNA, 15 bp, Homo sapiens
aggctcttgcagctg

SEQ ID NO: 22842 - DNA, 15 bp, Homo sapiens
gaggctcttgcagct

SEQ ID NO: 22843 - DNA, 15 bp, Homo sapiens
ggaggctcttgcagc

SEQ ID NO: 22844 - DNA, 15 bp, Homo sapiens
aggaggctcttgcag

SEQ ID NO: 22845 - DNA, 15 bp, Homo sapiens
gaggaggctcttgca

SEQ ID NO: 22846 - DNA, 15 bp, Homo sapiens
tgaggaggctcttgc

SEQ ID NO: 22847 - DNA, 15 bp, Homo sapiens
gtgaggaggctcttg

SEQ ID NO: 22848 - DNA, 15 bp, Homo sapiens
ggtgaggaggctctt

SEQ ID NO: 22849 - DNA, 15 bp, Homo sapiens
gggtgaggaggctct

SEQ ID NO: 22850 - DNA, 15 bp, Homo sapiens
tgggtgaggaggctc

SEQ ID NO: 22851 - DNA, 15 bp, Homo sapiens
ttgggtgaggaggct

SEQ ID NO: 22852 - DNA, 15 bp, Homo sapiens
cttgggtgaggaggc

SEQ ID NO: 22853 - DNA, 15 bp, Homo sapiens
ccttgggtgaggagg

SEQ ID NO: 22854 - DNA, 15 bp, Homo sapiens
accttgggtgaggag

SEQ ID NO: 22855 - DNA, 15 bp, Homo sapiens
gaccttgggtgagga

SEQ ID NO: 22856 - DNA, 15 bp, Homo sapiens
tgaccttgggtgagg

SEQ ID NO: 22857 - DNA, 15 bp, Homo sapiens
gtgaccttgggtgag

SEQ ID NO: 22858 - DNA, 15 bp, Homo sapiens
cgtgaccttgggtga

SEQ ID NO: 22859 - DNA, 15 bp, Homo sapiens
gcgtgaccttgggtg

SEQ ID NO: 22860 - DNA, 15 bp, Homo sapiens
ggcgtgaccttgggt

SEQ ID NO: 22861 - DNA, 15 bp, Homo sapiens
tggcgtgaccttggg

SEQ ID NO: 22862 - DNA, 15 bp, Homo sapiens
atggcgtgaccttgg

SEQ ID NO: 22863 - DNA, 15 bp, Homo sapiens
aatggcgtgaccttg

SEQ ID NO: 22864 - DNA, 15 bp, Homo sapiens
aaatggcgtgacctt

SEQ ID NO: 22865 - DNA, 15 bp, Homo sapiens
gaaatggcgtgacct

SEQ ID NO: 22866 - DNA, 15 bp, Homo sapiens
ggaaatggcgtgacc

SEQ ID NO: 22867 - DNA, 15 bp, Homo sapiens
tggaaatggcgtgac

SEQ ID NO: 22868 - DNA, 15 bp, Homo sapiens
ctggaaatggcgtga

SEQ ID NO: 22869 - DNA, 15 bp, Homo sapiens
cctggaaatggcgtg

SEQ ID NO: 22870 - DNA, 15 bp, Homo sapiens
tcctggaaatggcgt

SEQ ID NO: 22871 - DNA, 15 bp, Homo sapiens
gtcctggaaatggcg

SEQ ID NO: 22872 - DNA, 15 bp, Homo sapiens
tgtcctggaaatggc

SEQ ID NO: 22873 - DNA, 15 bp, Homo sapiens
ctgtcctggaaatgg

SEQ ID NO: 22874 - DNA, 15 bp, Homo sapiens
gctgtcctggaaatg

SEQ ID NO: 22875 - DNA, 15 bp, Homo sapiens
tgctgtcctggaaat

SEQ ID NO: 22876 - DNA, 15 bp, Homo sapiens
gtgctgtcctggaaa

SEQ ID NO: 22877 - DNA, 15 bp, Homo sapiens
ggtgctgtcctggaa

SEQ ID NO: 22878 - DNA, 15 bp, Homo sapiens
gggtgctgtcctgga

SEQ ID NO: 22879 - DNA, 15 bp, Homo sapiens
agggtgctgtcctgg

SEQ ID NO: 22880 - DNA, 15 bp, Homo sapiens
cagggtgctgtcctg

SEQ ID NO: 22881 - DNA, 15 bp, Homo sapiens
ccagggtgctgtcct

SEQ ID NO: 22882 - DNA, 15 bp, Homo sapiens
accagggtgctgtcc

SEQ ID NO: 22883 - DNA, 15 bp, Homo sapiens
caccagggtgctgtc

SEQ ID NO: 22884 - DNA, 15 bp, Homo sapiens
tcaccagggtgctgt

SEQ ID NO: 22885 - DNA, 15 bp, Homo sapiens
gtcaccagggtgctg

SEQ ID NO: 22886 - DNA, 15 bp, Homo sapiens
agtcaccagggtgct

SEQ ID NO: 22887 - DNA, 15 bp, Homo sapiens
cagtcaccagggtgc

SEQ ID NO: 22888 - DNA, 15 bp, Homo sapiens
tcagtcaccagggtg

SEQ ID NO: 22889 - DNA, 15 bp, Homo sapiens
ctcagtcaccagggt

SEQ ID NO: 22890 - DNA, 15 bp, Homo sapiens
gctcagtcaccaggg

SEQ ID NO: 22891 - DNA, 15 bp, Homo sapiens
cgctcagtcaccagg

SEQ ID NO: 22892 - DNA, 15 bp, Homo sapiens
tcgctcagtcaccag

SEQ ID NO: 22893 - DNA, 15 bp, Homo sapiens
ctcgctcagtcacca

SEQ ID NO: 22894 - DNA, 15 bp, Homo sapiens
cctcgctcagtcacc

SEQ ID NO: 22895 - DNA, 15 bp, Homo sapiens
acctcgctcagtcac

SEQ ID NO: 22896 - DNA, 15 bp, Homo sapiens
tacctcgctcagtca

SEQ ID NO: 22897 - DNA, 15 bp, Homo sapiens
ttacctcgctcagtc

SEQ ID NO: 22898 - DNA, 15 bp, Homo sapiens
cttacctcgctcagt

SEQ ID NO: 22899 - DNA, 15 bp, Homo sapiens
ccttacctcgctcag

SEQ ID NO: 22900 - DNA, 15 bp, Homo sapiens
cccttacctcgctca

SEQ ID NO: 22901 - DNA, 15 bp, Homo sapiens
acccttacctcgctc

SEQ ID NO: 22902 - DNA, 15 bp, Homo sapiens
tacccttacctcgct

SEQ ID NO: 22903 - DNA, 15 bp, Homo sapiens
gtacccttacctcgc

SEQ ID NO: 22904 - DNA, 15 bp, Homo sapiens
tgtacccttacctcg

SEQ ID NO: 22905 - DNA, 15 bp, Homo sapiens
ttgtacccttacctc

SEQ ID NO: 22906 - DNA, 15 bp, Homo sapiens
cttgtacccttacct

SEQ ID NO: 22907 - DNA, 15 bp, Homo sapiens
ccttgtacccttacc

SEQ ID NO: 22908 - DNA, 15 bp, Homo sapiens
gccttgtacccttac

SEQ ID NO: 22909 - DNA, 15 bp, Homo sapiens
ggccttgtaccctta

SEQ ID NO: 22910 - DNA, 15 bp, Homo sapiens
gggccttgtaccctt

SEQ ID NO: 22911 - DNA, 15 bp, Homo sapiens
agggccttgtaccct

SEQ ID NO: 22912 - DNA, 15 bp, Homo sapiens
aagggccttgtaccc

SEQ ID NO: 22913 - DNA, 15 bp, Homo sapiens
taagggccttgtacc

SEQ ID NO: 22914 - DNA, 15 bp, Homo sapiens
ataagggccttgtac

SEQ ID NO: 22915 - DNA, 15 bp, Homo sapiens
tataagggccttgta

SEQ ID NO: 22916 - DNA, 15 bp, Homo sapiens
ctataagggccttgt

SEQ ID NO: 22917 - DNA, 15 bp, Homo sapiens
cctataagggccttg

SEQ ID NO: 22918 - DNA, 15 bp, Homo sapiens
ccctataagggcctt

SEQ ID NO: 22919 - DNA, 15 bp, Homo sapiens
gccctataagggcct

SEQ ID NO: 22920 - DNA, 15 bp, Homo sapiens
ggccctataagggcc

SEQ ID NO: 22921 - DNA, 15 bp, Homo sapiens
aggccctataagggc

SEQ ID NO: 22922 - DNA, 15 bp, Homo sapiens
aaggccctataaggg

SEQ ID NO: 22923 - DNA, 15 bp, Homo sapiens
gaaggccctataagg

SEQ ID NO: 22924 - DNA, 15 bp, Homo sapiens
agaaggccctataag

SEQ ID NO: 22925 - DNA, 15 bp, Homo sapiens
gagaaggccctataa

SEQ ID NO: 22926 - DNA, 15 bp, Homo sapiens
agagaaggccctata

SEQ ID NO: 22927 - DNA, 15 bp, Homo sapiens
aagagaaggccctat

SEQ ID NO: 22928 - DNA, 15 bp, Homo sapiens
aaagagaaggcccta

SEQ ID NO: 22929 - DNA, 15 bp, Homo sapiens
caaagagaaggccct

SEQ ID NO: 22930 - DNA, 15 bp, Homo sapiens
tcaaagagaaggccc

SEQ ID NO: 22931 - DNA, 15 bp, Homo sapiens
gtcaaagagaaggcc

SEQ ID NO: 22932 - DNA, 15 bp, Homo sapiens
agtcaaagagaaggc

SEQ ID NO: 22933 - DNA, 15 bp, Homo sapiens
aagtcaaagagaagg

SEQ ID NO: 22934 - DNA, 15 bp, Homo sapiens
gaagtcaaagagaag

SEQ ID NO: 22935 - DNA, 15 bp, Homo sapiens
agaagtcaaagagaa

SEQ ID NO: 22936 - DNA, 15 bp, Homo sapiens
aagaagtcaaagaga

SEQ ID NO: 22937 - DNA, 15 bp, Homo sapiens
gaagaagtcaaagag

SEQ ID NO: 22938 - DNA, 15 bp, Homo sapiens
ggaagaagtcaaaga

SEQ ID NO: 22939 - DNA, 15 bp, Homo sapiens
gggaagaagtcaaag

SEQ ID NO: 22940 - DNA, 15 bp, Homo sapiens
tgggaagaagtcaaa

SEQ ID NO: 22941 - DNA, 15 bp, Homo sapiens
gtgggaagaagtcaa

SEQ ID NO: 22942 - DNA, 15 bp, Homo sapiens
ggtgggaagaagtca

SEQ ID NO: 22943 - DNA, 15 bp, Homo sapiens
aggtgggaagaagtc

SEQ ID NO: 22944 - DNA, 15 bp, Homo sapiens
gaggtgggaagaagt

SEQ ID NO: 22945 - DNA, 15 bp, Homo sapiens
ggaggtgggaagaag

SEQ ID NO: 22946 - DNA, 15 bp, Homo sapiens
gggaggtgggaagaa

SEQ ID NO: 22947 - DNA, 15 bp, Homo sapiens
agggaggtgggaaga

SEQ ID NO: 22948 - DNA, 15 bp, Homo sapiens
aagggaggtgggaag

SEQ ID NO: 22949 - DNA, 15 bp, Homo sapiens
aaagggaggtgggaa

SEQ ID NO: 22950 - DNA, 15 bp, Homo sapiens
taaagggaggtggga

SEQ ID NO: 22951 - DNA, 15 bp, Homo sapiens
ataaagggaggtggg

SEQ ID NO: 22952 - DNA, 15 bp, Homo sapiens
cataaagggaggtgg

SEQ ID NO: 22953 - DNA, 15 bp, Homo sapiens
ccataaagggaggtg

SEQ ID NO: 22954 - DNA, 15 bp, Homo sapiens
tccataaagggaggt

SEQ ID NO: 22955 - DNA, 15 bp, Homo sapiens
atccataaagggagg

SEQ ID NO: 22956 - DNA, 15 bp, Homo sapiens
catccataaagggag

SEQ ID NO: 22957 - DNA, 15 bp, Homo sapiens
acatccataaaggga

SEQ ID NO: 22958 - DNA, 15 bp, Homo sapiens
gacatccataaaggg

SEQ ID NO: 22959 - DNA, 15 bp, Homo sapiens
tgacatccataaagg

SEQ ID NO: 22960 - DNA, 15 bp, Homo sapiens
ctgacatccataaag

SEQ ID NO: 22961 - DNA, 15 bp, Homo sapiens
actgacatccataaa

SEQ ID NO: 22962 - DNA, 15 bp, Homo sapiens
aactgacatccataa

SEQ ID NO: 22963 - DNA, 15 bp, Homo sapiens
gaactgacatccata

SEQ ID NO: 22964 - DNA, 15 bp, Homo sapiens
ggaactgacatccat

SEQ ID NO: 22965 - DNA, 15 bp, Homo sapiens
aggaactgacatcca

SEQ ID NO: 22966 - DNA, 15 bp, Homo sapiens
caggaactgacatcc

SEQ ID NO: 22967 - DNA, 15 bp, Homo sapiens
tcaggaactgacatc

SEQ ID NO: 22968 - DNA, 15 bp, Homo sapiens
atcaggaactgacat

SEQ ID NO: 22969 - DNA, 15 bp, Homo sapiens
catcaggaactgaca

SEQ ID NO: 22970 - DNA, 15 bp, Homo sapiens
tcatcaggaactgac

SEQ ID NO: 22971 - DNA, 15 bp, Homo sapiens
ttcatcaggaactga

SEQ ID NO: 22972 - DNA, 15 bp, Homo sapiens
gttcatcaggaactg

SEQ ID NO: 22973 - DNA, 15 bp, Homo sapiens
tgttcatcaggaact

SEQ ID NO: 22974 - DNA, 15 bp, Homo sapiens
atgttcatcaggaac

SEQ ID NO: 22975 - DNA, 15 bp, Homo sapiens
gatgttcatcaggaa

SEQ ID NO: 22976 - DNA, 15 bp, Homo sapiens
agatgttcatcagga

SEQ ID NO: 22977 - DNA, 15 bp, Homo sapiens
aagatgttcatcagg

SEQ ID NO: 22978 - DNA, 15 bp, Homo sapiens
taagatgttcatcag

SEQ ID NO: 22979 - DNA, 15 bp, Homo sapiens
gtaagatgttcatca

SEQ ID NO: 22980 - DNA, 15 bp, Homo sapiens
tgtaagatgttcatc

SEQ ID NO: 22981 - DNA, 15 bp, Homo sapiens
gtgtaagatgttcat

SEQ ID NO: 22982 - DNA, 15 bp, Homo sapiens
ggtgtaagatgttca

SEQ ID NO: 22983 - DNA, 15 bp, Homo sapiens
aggtgtaagatgttc

SEQ ID NO: 22984 - DNA, 15 bp, Homo sapiens
gaggtgtaagatgtt

SEQ ID NO: 22985 - DNA, 15 bp, Homo sapiens
tgaggtgtaagatgt

SEQ ID NO: 22986 - DNA, 15 bp, Homo sapiens
ttgaggtgtaagatg

SEQ ID NO: 22987 - DNA, 15 bp, Homo sapiens
tttgaggtgtaagat

SEQ ID NO: 22988 - DNA, 15 bp, Homo sapiens
gtttgaggtgtaaga

SEQ ID NO: 22989 - DNA, 15 bp, Homo sapiens
ggtttgaggtgtaag

SEQ ID NO: 22990 - DNA, 15 bp, Homo sapiens
cggtttgaggtgtaa

SEQ ID NO: 22991 - DNA, 15 bp, Homo sapiens
acggtttgaggtgta

SEQ ID NO: 22992 - DNA, 15 bp, Homo sapiens
cacggtttgaggtgt

SEQ ID NO: 22993 - DNA, 15 bp, Homo sapiens
tcacggtttgaggtg

SEQ ID NO: 22994 - DNA, 15 bp, Homo sapiens
gtcacggtttgaggt

SEQ ID NO: 22995 - DNA, 15 bp, Homo sapiens
ggtcacggtttgagg

SEQ ID NO: 22996 - DNA, 15 bp, Homo sapiens
gggtcacggtttgag

SEQ ID NO: 22997 - DNA, 15 bp, Homo sapiens
tgggtcacggtttga

SEQ ID NO: 22998 - DNA, 15 bp, Homo sapiens
ttgggtcacggtttg

SEQ ID NO: 22999 - DNA, 15 bp, Homo sapiens
gttgggtcacggttt

SEQ ID NO: 23000 - DNA, 15 bp, Homo sapiens
tgttgggtcacggtt

SEQ ID NO: 23001 - DNA, 15 bp, Homo sapiens
atgttgggtcacggt

SEQ ID NO: 23002 - DNA, 15 bp, Homo sapiens
gatgttgggtcacgg

SEQ ID NO: 23003 - DNA, 15 bp, Homo sapiens
agatgttgggtcacg

SEQ ID NO: 23004 - DNA, 15 bp, Homo sapiens
cagatgttgggtcac

SEQ ID NO: 23005 - DNA, 15 bp, Homo sapiens
gcagatgttgggtca

SEQ ID NO: 23006 - DNA, 15 bp, Homo sapiens
agcagatgttgggtc

SEQ ID NO: 23007 - DNA, 15 bp, Homo sapiens
aagcagatgttgggt

SEQ ID NO: 23008 - DNA, 15 bp, Homo sapiens
gaagcagatgttggg

SEQ ID NO: 23009 - DNA, 15 bp, Homo sapiens
agaagcagatgttgg

SEQ ID NO: 23010 - DNA, 15 bp, Homo sapiens
cagaagcagatgttg

SEQ ID NO: 23011 - DNA, 15 bp, Homo sapiens
gcagaagcagatgtt

SEQ ID NO: 23012 - DNA, 15 bp, Homo sapiens
tgcagaagcagatgt

SEQ ID NO: 23013 - DNA, 15 bp, Homo sapiens
ctgcagaagcagatg

SEQ ID NO: 23014 - DNA, 15 bp, Homo sapiens
tctgcagaagcagat

SEQ ID NO: 23015 - DNA, 15 bp, Homo sapiens
ctctgcagaagcaga

SEQ ID NO: 23016 - DNA, 15 bp, Homo sapiens
gctctgcagaagcag

SEQ ID NO: 23017 - DNA, 15 bp, Homo sapiens
ggctctgcagaagca

SEQ ID NO: 23018 - DNA, 15 bp, Homo sapiens
gggctctgcagaagc

SEQ ID NO: 23019 - DNA, 15 bp, Homo sapiens
ggggctctgcagaag

SEQ ID NO: 23020 - DNA, 15 bp, Homo sapiens
gggggctctgcagaa

SEQ ID NO: 23021 - DNA, 15 bp, Homo sapiens
ggggggctctgcaga

SEQ ID NO: 23022 - DNA, 15 bp, Homo sapiens
aggggggctctgcag

SEQ ID NO: 23023 - DNA, 15 bp, Homo sapiens
caggggggctctgca

SEQ ID NO: 23024 - DNA, 15 bp, Homo sapiens
acaggggggctctgc

SEQ ID NO: 23025 - DNA, 15 bp, Homo sapiens
cacaggggggctctg

SEQ ID NO: 23026 - DNA, 15 bp, Homo sapiens
ccacaggggggctct

SEQ ID NO: 23027 - DNA, 15 bp, Homo sapiens
gccacaggggggctc

SEQ ID NO: 23028 - DNA, 15 bp, Homo sapiens
tgccacaggggggct

SEQ ID NO: 23029 - DNA, 15 bp, Homo sapiens
atgccacaggggggc

SEQ ID NO: 23030 - DNA, 15 bp, Homo sapiens
gatgccacagggggg

SEQ ID NO: 23031 - DNA, 15 bp, Homo sapiens
agatgccacaggggg

SEQ ID NO: 23032 - DNA, 15 bp, Homo sapiens
aagatgccacagggg

SEQ ID NO: 23033 - DNA, 15 bp, Homo sapiens
caagatgccacaggg

SEQ ID NO: 23034 - DNA, 15 bp, Homo sapiens
acaagatgccacagg

SEQ ID NO: 23035 - DNA, 15 bp, Homo sapiens
cacaagatgccacag

SEQ ID NO: 23036 - DNA, 15 bp, Homo sapiens
gcacaagatgccaca

SEQ ID NO: 23037 - DNA, 15 bp, Homo sapiens
ggcacaagatgccac

SEQ ID NO: 23038 - DNA, 15 bp, Homo sapiens
gggcacaagatgcca

SEQ ID NO: 23039 - DNA, 15 bp, Homo sapiens
agggcacaagatgcc

SEQ ID NO: 23040 - DNA, 15 bp, Homo sapiens
gagggcacaagatgc

SEQ ID NO: 23041 - DNA, 15 bp, Homo sapiens
ggagggcacaagatg

SEQ ID NO: 23042 - DNA, 15 bp, Homo sapiens
aggagggcacaagat

SEQ ID NO: 23043 - DNA, 15 bp, Homo sapiens
caggagggcacaaga

SEQ ID NO: 23044 - DNA, 15 bp, Homo sapiens
gcaggagggcacaag

SEQ ID NO: 23045 - DNA, 15 bp, Homo sapiens
ggcaggagggcacaa

SEQ ID NO: 23046 - DNA, 15 bp, Homo sapiens
gggcaggagggcaca

SEQ ID NO: 23047 - DNA, 15 bp, Homo sapiens
ggggcaggagggcac

SEQ ID NO: 23048 - DNA, 15 bp, Homo sapiens
tggggcaggagggca

SEQ ID NO: 23049 - DNA, 15 bp, Homo sapiens
gtggggcaggagggc

SEQ ID NO: 23050 - DNA, 15 bp, Homo sapiens
agtggggcaggaggg

SEQ ID NO: 23051 - DNA, 15 bp, Homo sapiens
gagtggggcaggagg

SEQ ID NO: 23052 - DNA, 15 bp, Homo sapiens
ggagtggggcaggag

SEQ ID NO: 23053 - DNA, 15 bp, Homo sapiens
gggagtggggcagga

SEQ ID NO: 23054 - DNA, 15 bp, Homo sapiens
agggagtggggcagg

SEQ ID NO: 23055 - DNA, 15 bp, Homo sapiens
gagggagtggggcag

SEQ ID NO: 23056 - DNA, 15 bp, Homo sapiens
agagggagtggggca

SEQ ID NO: 23057 - DNA, 15 bp, Homo sapiens
tagagggagtggggc

SEQ ID NO: 23058 - DNA, 15 bp, Homo sapiens
gtagagggagtgggg

SEQ ID NO: 23059 - DNA, 15 bp, Homo sapiens
agtagagggagtggg

SEQ ID NO: 23060 - DNA, 15 bp, Homo sapiens
gagtagagggagtgg

SEQ ID NO: 23061 - DNA, 15 bp, Homo sapiens
agagtagagggagtg

SEQ ID NO: 23062 - DNA, 15 bp, Homo sapiens
tagagtagagggagt

SEQ ID NO: 23063 - DNA, 15 bp, Homo sapiens
atagagtagagggag

SEQ ID NO: 23064 - DNA, 15 bp, Homo sapiens
tatagagtagaggga

SEQ ID NO: 23065 - DNA, 15 bp, Homo sapiens
atatagagtagaggg

SEQ ID NO: 23066 - DNA, 15 bp, Homo sapiens
gatatagagtagagg

SEQ ID NO: 23067 - DNA, 15 bp, Homo sapiens
agatatagagtagag

SEQ ID NO: 23068 - DNA, 15 bp, Homo sapiens
aagatatagagtaga

SEQ ID NO: 23069 - DNA, 15 bp, Homo sapiens
gaagatatagagtag

SEQ ID NO: 23070 - DNA, 15 bp, Homo sapiens
ggaagatatagagta

SEQ ID NO: 23071 - DNA, 15 bp, Homo sapiens
gggaagatatagagt

SEQ ID NO: 23072 - DNA, 15 bp, Homo sapiens
tgggaagatatagag

SEQ ID NO: 23073 - DNA, 15 bp, Homo sapiens
atgggaagatataga

SEQ ID NO: 23074 - DNA, 15 bp, Homo sapiens
tatgggaagatatag

SEQ ID NO: 23075 - DNA, 15 bp, Homo sapiens
ctatgggaagatata

SEQ ID NO: 23076 - DNA, 15 bp, Homo sapiens
actatgggaagatat

SEQ ID NO: 23077 - DNA, 15 bp, Homo sapiens
aactatgggaagata

SEQ ID NO: 23078 - DNA, 15 bp, Homo sapiens
taactatgggaagat

SEQ ID NO: 23079 - DNA, 15 bp, Homo sapiens
ctaactatgggaaga

SEQ ID NO: 23080 - DNA, 15 bp, Homo sapiens
tctaactatgggaag

SEQ ID NO: 23081 - DNA, 15 bp, Homo sapiens
ttctaactatgggaa

SEQ ID NO: 23082 - DNA, 15 bp, Homo sapiens
attctaactatggga

SEQ ID NO: 23083 - DNA, 15 bp, Homo sapiens
cattctaactatggg

SEQ ID NO: 23084 - DNA, 15 bp, Homo sapiens
ccattctaactatgg

SEQ ID NO: 23085 - DNA, 15 bp, Homo sapiens
cccattctaactatg

SEQ ID NO: 23086 - DNA, 15 bp, Homo sapiens
gcccattctaactat

SEQ ID NO: 23087 - DNA, 15 bp, Homo sapiens
agcccattctaacta

SEQ ID NO: 23088 - DNA, 15 bp, Homo sapiens
aagcccattctaact

SEQ ID NO: 23089 - DNA, 15 bp, Homo sapiens
aaagcccattctaac

SEQ ID NO: 23090 - DNA, 15 bp, Homo sapiens
aaaagcccattctaa

SEQ ID NO: 23091 - DNA, 15 bp, Homo sapiens
aaaaagcccattcta

SEQ ID NO: 23092 - DNA, 15 bp, Homo sapiens
aaaaaagcccattct

SEQ ID NO: 23093 - DNA, 15 bp, Homo sapiens
aaaaaaagcccattc

SEQ ID NO: 23094 - DNA, 15 bp, Homo sapiens
aaaaaaaagcccatt

SEQ ID NO: 23095 - DNA, 15 bp, Homo sapiens
aaaaaaaaagcccat

SEQ ID NO: 23096 - DNA, 15 bp, Homo sapiens
aaaaaaaaaagccca

SEQ ID NO: 23097 - DNA, 15 bp, Homo sapiens
aaaaaaaaaaagccc

SEQ ID NO: 23098 - DNA, 15 bp, Homo sapiens
aaaaaaaaaaaagcc

SEQ ID NO: 23099 - DNA, 15 bp, Homo sapiens
aaaaaaaaaaaaagc

SEQ ID NO: 23100 - DNA, 15 bp, Homo sapiens
tatctcaaaaaaaaa

SEQ ID NO: 23101 - DNA, 15 bp, Homo sapiens
ttatctcaaaaaaaa

SEQ ID NO: 23102 - DNA, 15 bp, Homo sapiens
cttatctcaaaaaaa

SEQ ID NO: 23103 - DNA, 15 bp, Homo sapiens
ccttatctcaaaaaa

SEQ ID NO: 23104 - DNA, 15 bp, Homo sapiens
accttatctcaaaaa

SEQ ID NO: 23105 - DNA, 15 bp, Homo sapiens
gaccttatctcaaaa

SEQ ID NO: 23106 - DNA, 15 bp, Homo sapiens
agaccttatctcaaa

SEQ ID NO: 23107 - DNA, 15 bp, Homo sapiens
gagaccttatctcaa

SEQ ID NO: 23108 - DNA, 15 bp, Homo sapiens
ggagaccttatctca

SEQ ID NO: 23109 - DNA, 15 bp, Homo sapiens
gggagaccttatctc

SEQ ID NO: 23110 - DNA, 15 bp, Homo sapiens
agggagaccttatct

SEQ ID NO: 23111 - DNA, 15 bp, Homo sapiens
aagggagaccttatc

SEQ ID NO: 23112 - DNA, 15 bp, Homo sapiens
aaagggagaccttat

SEQ ID NO: 23113 - DNA, 15 bp, Homo sapiens
caaagggagacctta

SEQ ID NO: 23114 - DNA, 15 bp, Homo sapiens
acaaagggagacctt

SEQ ID NO: 23115 - DNA, 15 bp, Homo sapiens
gacaaagggagacct

SEQ ID NO: 23116 - DNA, 15 bp, Homo sapiens
tgacaaagggagacc

SEQ ID NO: 23117 - DNA, 15 bp, Homo sapiens
gtgacaaagggagac

SEQ ID NO: 23118 - DNA, 15 bp, Homo sapiens
ggtgacaaagggaga

SEQ ID NO: 23119 - DNA, 15 bp, Homo sapiens
gggtgacaaagggag

SEQ ID NO: 23120 - DNA, 15 bp, Homo sapiens
tgggtgacaaaggga

SEQ ID NO: 23121 - DNA, 15 bp, Homo sapiens
ctgggtgacaaaggg

SEQ ID NO: 23122 - DNA, 15 bp, Homo sapiens
cctgggtgacaaagg

SEQ ID NO: 23123 - DNA, 15 bp, Homo sapiens
gcctgggtgacaaag

SEQ ID NO: 23124 - DNA, 15 bp, Homo sapiens
agcctgggtgacaaa

SEQ ID NO: 23125 - DNA, 15 bp, Homo sapiens
cagcctgggtgacaa

SEQ ID NO: 23126 - DNA, 15 bp, Homo sapiens
ttccagcctgggtga

SEQ ID NO: 23127 - DNA, 15 bp, Homo sapiens
attccagcctgggtg

SEQ ID NO: 23128 - DNA, 15 bp, Homo sapiens
cattccagcctgggt

SEQ ID NO: 23129 - DNA, 15 bp, Homo sapiens
gcattccagcctggg

SEQ ID NO: 23130 - DNA, 15 bp, Homo sapiens
tgcattccagcctgg

SEQ ID NO: 23131 - DNA, 15 bp, Homo sapiens
ttgcattccagcctg

SEQ ID NO: 23132 - DNA, 15 bp, Homo sapiens
attgcattccagcct

SEQ ID NO: 23133 - DNA, 15 bp, Homo sapiens
tgtgccattgcattc

SEQ ID NO: 23134 - DNA, 15 bp, Homo sapiens
ctgtgccattgcatt

SEQ ID NO: 23135 - DNA, 15 bp, Homo sapiens
actgtgccattgcat

SEQ ID NO: 23136 - DNA, 15 bp, Homo sapiens
gactgtgccattgca

SEQ ID NO: 23137 - DNA, 15 bp, Homo sapiens
tgactgtgccattgc

SEQ ID NO: 23138 - DNA, 15 bp, Homo sapiens
gtgactgtgccattg

SEQ ID NO: 23139 - DNA, 15 bp, Homo sapiens
cgtgactgtgccatt

SEQ ID NO: 23140 - DNA, 15 bp, Homo sapiens
tcgtgactgtgccat

SEQ ID NO: 23141 - DNA, 15 bp, Homo sapiens
gtcgtgactgtgcca

SEQ ID NO: 23142 - DNA, 15 bp, Homo sapiens
agtcgtgactgtgcc

SEQ ID NO: 23143 - DNA, 15 bp, Homo sapiens
gagtcgtgactgtgc

SEQ ID NO: 23144 - DNA, 15 bp, Homo sapiens
tgagtcgtgactgtg

SEQ ID NO: 23145 - DNA, 15 bp, Homo sapiens
gtgagtcgtgactgt

SEQ ID NO: 23146 - DNA, 15 bp, Homo sapiens
agtgagtcgtgactg

SEQ ID NO: 23147 - DNA, 15 bp, Homo sapiens
cagtgagtcgtgact

SEQ ID NO: 23148 - DNA, 15 bp, Homo sapiens
gcagtgagtcgtgac

SEQ ID NO: 23149 - DNA, 15 bp, Homo sapiens
tgcagtgagtcgtga

SEQ ID NO: 23150 - DNA, 15 bp, Homo sapiens
ctgcagtgagtcgtg

SEQ ID NO: 23151 - DNA, 15 bp, Homo sapiens
gctgcagtgagtcgt

SEQ ID NO: 23152 - DNA, 15 bp, Homo sapiens
ggctgcagtgagtcg

SEQ ID NO: 23153 - DNA, 15 bp, Homo sapiens
aggctgcagtgagtc

SEQ ID NO: 23154 - DNA, 15 bp, Homo sapiens
gaggctgcagtgagt

SEQ ID NO: 23155 - DNA, 15 bp, Homo sapiens
gttgaggctgcagtg

SEQ ID NO: 23156 - DNA, 15 bp, Homo sapiens
ggttgaggctgcagt

SEQ ID NO: 23157 - DNA, 15 bp, Homo sapiens
aggttgaggctgcag

SEQ ID NO: 23158 - DNA, 15 bp, Homo sapiens
aggaggttgaggctg

SEQ ID NO: 23159 - DNA, 15 bp, Homo sapiens
caggaggttgaggct

SEQ ID NO: 23160 - DNA, 15 bp, Homo sapiens
ccaggaggttgaggc

SEQ ID NO: 23161 - DNA, 15 bp, Homo sapiens
cccaggaggttgagg

SEQ ID NO: 23162 - DNA, 15 bp, Homo sapiens
gcccaggaggttgag

SEQ ID NO: 23163 - DNA, 15 bp, Homo sapiens
agcccaggaggttga

SEQ ID NO: 23164 - DNA, 15 bp, Homo sapiens
gagcccaggaggttg

SEQ ID NO: 23165 - DNA, 15 bp, Homo sapiens
tgagcccaggaggtt

SEQ ID NO: 23166 - DNA, 15 bp, Homo sapiens
ttgagcccaggaggt

SEQ ID NO: 23167 - DNA, 15 bp, Homo sapiens
gactgcttgagccca

SEQ ID NO: 23168 - DNA, 15 bp, Homo sapiens
ggactgcttgagccc

SEQ ID NO: 23169 - DNA, 15 bp, Homo sapiens
aggactgcttgagcc

SEQ ID NO: 23170 - DNA, 15 bp, Homo sapiens
gaggactgcttgagc

SEQ ID NO: 23171 - DNA, 15 bp, Homo sapiens
ggaggactgcttgag

SEQ ID NO: 23172 - DNA, 15 bp, Homo sapiens
gggaggactgcttga

SEQ ID NO: 23173 - DNA, 15 bp, Homo sapiens
tgggaggactgcttg

SEQ ID NO: 23174 - DNA, 15 bp, Homo sapiens
gtgggaggactgctt

SEQ ID NO: 23175 - DNA, 15 bp, Homo sapiens
ggtgggaggactgct

SEQ ID NO: 23176 - DNA, 15 bp, Homo sapiens
aggtgggaggactgc

SEQ ID NO: 23177 - DNA, 15 bp, Homo sapiens
gaggtgggaggactg

SEQ ID NO: 23178 - DNA, 15 bp, Homo sapiens
tgaggtgggaggact

SEQ ID NO: 23179 - DNA, 15 bp, Homo sapiens
tcagctacttgggag

SEQ ID NO: 23180 - DNA, 15 bp, Homo sapiens
ctcagctacttggga

SEQ ID NO: 23181 - DNA, 15 bp, Homo sapiens
tctcagctacttggg

SEQ ID NO: 23182 - DNA, 15 bp, Homo sapiens
gtctcagctacttgg

SEQ ID NO: 23183 - DNA, 15 bp, Homo sapiens
agtctcagctacttg

SEQ ID NO: 23184 - DNA, 15 bp, Homo sapiens
tagtctcagctactt

SEQ ID NO: 23185 - DNA, 15 bp, Homo sapiens
gtagtctcagctact

SEQ ID NO: 23186 - DNA, 15 bp, Homo sapiens
tgtagtctcagctac

SEQ ID NO: 23187 - DNA, 15 bp, Homo sapiens
ctgtagtctcagcta

SEQ ID NO: 23188 - DNA, 15 bp, Homo sapiens
cctgtagtctcagct

SEQ ID NO: 23189 - DNA, 15 bp, Homo sapiens
acctgtagtctcagc

SEQ ID NO: 23190 - DNA, 15 bp, Homo sapiens
tacctgtagtctcag

SEQ ID NO: 23191 - DNA, 15 bp, Homo sapiens
atacctgtagtctca

SEQ ID NO: 23192 - DNA, 15 bp, Homo sapiens
catacctgtagtctc

SEQ ID NO: 23193 - DNA, 15 bp, Homo sapiens
gcatacctgtagtct

SEQ ID NO: 23194 - DNA, 15 bp, Homo sapiens
tgcatacctgtagtc

SEQ ID NO: 23195 - DNA, 15 bp, Homo sapiens
gtgcatacctgtagt

SEQ ID NO: 23196 - DNA, 15 bp, Homo sapiens
ggtgcatacctgtag

SEQ ID NO: 23197 - DNA, 15 bp, Homo sapiens
tggtgcatacctgta

SEQ ID NO: 23198 - DNA, 15 bp, Homo sapiens
gtggtgcatacctgt

SEQ ID NO: 23199 - DNA, 15 bp, Homo sapiens
ggtggtgcatacctg

SEQ ID NO: 23200 - DNA, 15 bp, Homo sapiens
tggtggtgcatacct

SEQ ID NO: 23201 - DNA, 15 bp, Homo sapiens
gtggtggtgcatacc

SEQ ID NO: 23202 - DNA, 15 bp, Homo sapiens
tgtggtggtgcatac

SEQ ID NO: 23203 - DNA, 15 bp, Homo sapiens
gtgtggtggtgcata

SEQ ID NO: 23204 - DNA, 15 bp, Homo sapiens
ggtgtggtggtgcat

SEQ ID NO: 23205 - DNA, 15 bp, Homo sapiens
aggtgtggtggtgca

SEQ ID NO: 23206 - DNA, 15 bp, Homo sapiens
caggtgtggtggtgc

SEQ ID NO: 23207 - DNA, 15 bp, Homo sapiens
ccaggtgtggtggtg

SEQ ID NO: 23208 - DNA, 15 bp, Homo sapiens
gccaggtgtggtggt

SEQ ID NO: 23209 - DNA, 15 bp, Homo sapiens
agccaggtgtggtgg

SEQ ID NO: 23210 - DNA, 15 bp, Homo sapiens
tagccaggtgtggtg

SEQ ID NO: 23211 - DNA, 15 bp, Homo sapiens
ttagccaggtgtggt

SEQ ID NO: 23212 - DNA, 15 bp, Homo sapiens
attagccaggtgtgg

SEQ ID NO: 23213 - DNA, 15 bp, Homo sapiens
aattagccaggtgtg

SEQ ID NO: 23214 - DNA, 15 bp, Homo sapiens
aaattagccaggtgt

SEQ ID NO: 23215 - DNA, 15 bp, Homo sapiens
aaaattagccaggtg

SEQ ID NO: 23216 - DNA, 15 bp, Homo sapiens
aaaaattagccaggt

SEQ ID NO: 23217 - DNA, 15 bp, Homo sapiens
ataaaaattagccag

SEQ ID NO: 23218 - DNA, 15 bp, Homo sapiens
tataaaaattagcca

SEQ ID NO: 23219 - DNA, 15 bp, Homo sapiens
atataaaaattagcc

SEQ ID NO: 23220 - DNA, 15 bp, Homo sapiens
caaaaaatataaaaa

SEQ ID NO: 23221 - DNA, 15 bp, Homo sapiens
acaaaaaatataaaa

SEQ ID NO: 23222 - DNA, 15 bp, Homo sapiens
tacaaaaaatataaa

SEQ ID NO: 23223 - DNA, 15 bp, Homo sapiens
ctacaaaaaatataa

SEQ ID NO: 23224 - DNA, 15 bp, Homo sapiens
tctacaaaaaatata

SEQ ID NO: 23225 - DNA, 15 bp, Homo sapiens
ctctacaaaaaatat

SEQ ID NO: 23226 - DNA, 15 bp, Homo sapiens
tctctacaaaaaata

SEQ ID NO: 23227 - DNA, 15 bp, Homo sapiens
gtctctacaaaaaat

SEQ ID NO: 23228 - DNA, 15 bp, Homo sapiens
agtctctacaaaaaa

SEQ ID NO: 23229 - DNA, 15 bp, Homo sapiens
cagtctctacaaaaa

SEQ ID NO: 23230 - DNA, 15 bp, Homo sapiens
ccagtctctacaaaa

SEQ ID NO: 23231 - DNA, 15 bp, Homo sapiens
cccagtctctacaaa

SEQ ID NO: 23232 - DNA, 15 bp, Homo sapiens
ccccagtctctacaa

SEQ ID NO: 23233 - DNA, 15 bp, Homo sapiens
accccagtctctaca

SEQ ID NO: 23234 - DNA, 15 bp, Homo sapiens
gaccccagtctctac

SEQ ID NO: 23235 - DNA, 15 bp, Homo sapiens
agaccccagtctcta

SEQ ID NO: 23236 - DNA, 15 bp, Homo sapiens
gagaccccagtctct

SEQ ID NO: 23237 - DNA, 15 bp, Homo sapiens
ggagaccccagtctc

SEQ ID NO: 23238 - DNA, 15 bp, Homo sapiens
gggagaccccagtct

SEQ ID NO: 23239 - DNA, 15 bp, Homo sapiens
agggagaccccagtc

SEQ ID NO: 23240 - DNA, 15 bp, Homo sapiens
tagggagaccccagt

SEQ ID NO: 23241 - DNA, 15 bp, Homo sapiens
atagggagaccccag

SEQ ID NO: 23242 - DNA, 15 bp, Homo sapiens
catagggagacccca

SEQ ID NO: 23243 - DNA, 15 bp, Homo sapiens
acatagggagacccc

SEQ ID NO: 23244 - DNA, 15 bp, Homo sapiens
aacatagggagaccc

SEQ ID NO: 23245 - DNA, 15 bp, Homo sapiens
caacatagggagacc

SEQ ID NO: 23246 - DNA, 15 bp, Homo sapiens
gcaacatagggagac

SEQ ID NO: 23247 - DNA, 15 bp, Homo sapiens
ggcaacatagggaga

SEQ ID NO: 23248 - DNA, 15 bp, Homo sapiens
gggcaacatagggag

SEQ ID NO: 23249 - DNA, 15 bp, Homo sapiens
cgggcaacataggga

SEQ ID NO: 23250 - DNA, 15 bp, Homo sapiens
ccgggcaacataggg

SEQ ID NO: 23251 - DNA, 15 bp, Homo sapiens
cccgggcaacatagg

SEQ ID NO: 23252 - DNA, 15 bp, Homo sapiens
gcccgggcaacatag

SEQ ID NO: 23253 - DNA, 15 bp, Homo sapiens
agcccgggcaacata

SEQ ID NO: 23254 - DNA, 15 bp, Homo sapiens
cagcccgggcaacat

SEQ ID NO: 23255 - DNA, 15 bp, Homo sapiens
ccagcccgggcaaca

SEQ ID NO: 23256 - DNA, 15 bp, Homo sapiens
accagcccgggcaac

SEQ ID NO: 23257 - DNA, 15 bp, Homo sapiens
gaccagcccgggcaa

SEQ ID NO: 23258 - DNA, 15 bp, Homo sapiens
agaccagcccgggca

SEQ ID NO: 23259 - DNA, 15 bp, Homo sapiens
gagaccagcccgggc

SEQ ID NO: 23260 - DNA, 15 bp, Homo sapiens
cgagaccagcccggg

SEQ ID NO: 23261 - DNA, 15 bp, Homo sapiens
tcgagaccagcccgg

SEQ ID NO: 23262 - DNA, 15 bp, Homo sapiens
ttcgagaccagcccg

SEQ ID NO: 23263 - DNA, 15 bp, Homo sapiens
gttcgagaccagccc

SEQ ID NO: 23264 - DNA, 15 bp, Homo sapiens
gggagttcgagacca

SEQ ID NO: 23265 - DNA, 15 bp, Homo sapiens
tgggagttcgagacc

SEQ ID NO: 23266 - DNA, 15 bp, Homo sapiens
ctgggagttcgagac

SEQ ID NO: 23267 - DNA, 15 bp, Homo sapiens
cctgggagttcgaga

SEQ ID NO: 23268 - DNA, 15 bp, Homo sapiens
gcctgggagttcgag

SEQ ID NO: 23269 - DNA, 15 bp, Homo sapiens
agcctgggagttcga

SEQ ID NO: 23270 - DNA, 15 bp, Homo sapiens
gagcctgggagttcg

SEQ ID NO: 23271 - DNA, 15 bp, Homo sapiens
tgagcctgggagttc

SEQ ID NO: 23272 - DNA, 15 bp, Homo sapiens
tgcttgagcctggga

SEQ ID NO: 23273 - DNA, 15 bp, Homo sapiens
ttgcttgagcctggg

SEQ ID NO: 23274 - DNA, 15 bp, Homo sapiens
attgcttgagcctgg

SEQ ID NO: 23275 - DNA, 15 bp, Homo sapiens
gattgcttgagcctg

SEQ ID NO: 23276 - DNA, 15 bp, Homo sapiens
ggattgcttgagcct

SEQ ID NO: 23277 - DNA, 15 bp, Homo sapiens
aggattgcttgagcc

SEQ ID NO: 23278 - DNA, 15 bp, Homo sapiens
gaggattgcttgagc

SEQ ID NO: 23279 - DNA, 15 bp, Homo sapiens
ggaggattgcttgag

SEQ ID NO: 23280 - DNA, 15 bp, Homo sapiens
gggaggattgcttga

SEQ ID NO: 23281 - DNA, 15 bp, Homo sapiens
cgggaggattgcttg

SEQ ID NO: 23282 - DNA, 15 bp, Homo sapiens
gcgggaggattgctt

SEQ ID NO: 23283 - DNA, 15 bp, Homo sapiens
ggcgggaggattgct

SEQ ID NO: 23284 - DNA, 15 bp, Homo sapiens
aggcgggaggattgc

SEQ ID NO: 23285 - DNA, 15 bp, Homo sapiens
aaggcgggaggattg

SEQ ID NO: 23286 - DNA, 15 bp, Homo sapiens
caaggcgggaggatt

SEQ ID NO: 23287 - DNA, 15 bp, Homo sapiens
ccaaggcgggaggat

SEQ ID NO: 23288 - DNA, 15 bp, Homo sapiens
gccaaggcgggagga

SEQ ID NO: 23289 - DNA, 15 bp, Homo sapiens
ggccaaggcgggagg

SEQ ID NO: 23290 - DNA, 15 bp, Homo sapiens
aggccaaggcgggag

SEQ ID NO: 23291 - DNA, 15 bp, Homo sapiens
gaggccaaggcggga

SEQ ID NO: 23292 - DNA, 15 bp, Homo sapiens
ttttgggaggccaag

SEQ ID NO: 23293 - DNA, 15 bp, Homo sapiens
attttgggaggccaa

SEQ ID NO: 23294 - DNA, 15 bp, Homo sapiens
cattttgggaggcca

SEQ ID NO: 23295 - DNA, 15 bp, Homo sapiens
gcattttgggaggcc

SEQ ID NO: 23296 - DNA, 15 bp, Homo sapiens
tgcattttgggaggc

SEQ ID NO: 23297 - DNA, 15 bp, Homo sapiens
ctgcattttgggagg

SEQ ID NO: 23298 - DNA, 15 bp, Homo sapiens
cctgcattttgggag

SEQ ID NO: 23299 - DNA, 15 bp, Homo sapiens
tcctgcattttggga

SEQ ID NO: 23300 - DNA, 15 bp, Homo sapiens
atcctgcattttggg

SEQ ID NO: 23301 - DNA, 15 bp, Homo sapiens
aatcctgcattttgg

SEQ ID NO: 23302 - DNA, 15 bp, Homo sapiens
taatcctgcattttg

SEQ ID NO: 23303 - DNA, 15 bp, Homo sapiens
gtaatcctgcatttt

SEQ ID NO: 23304 - DNA, 15 bp, Homo sapiens
tgtaatcctgcattt

SEQ ID NO: 23305 - DNA, 15 bp, Homo sapiens
ctgtaatcctgcatt

SEQ ID NO: 23306 - DNA, 15 bp, Homo sapiens
cctgtaatcctgcat

SEQ ID NO: 23307 - DNA, 15 bp, Homo sapiens
gcctgtaatcctgca

SEQ ID NO: 23308 - DNA, 15 bp, Homo sapiens
cgcctgtaatcctgc

SEQ ID NO: 23309 - DNA, 15 bp, Homo sapiens
acgcctgtaatcctg

SEQ ID NO: 23310 - DNA, 15 bp, Homo sapiens
cacgcctgtaatcct

SEQ ID NO: 23311 - DNA, 15 bp, Homo sapiens
acacgcctgtaatcc

SEQ ID NO: 23312 - DNA, 15 bp, Homo sapiens
tacacgcctgtaatc

SEQ ID NO: 23313 - DNA, 15 bp, Homo sapiens
gtacacgcctgtaat

SEQ ID NO: 23314 - DNA, 15 bp, Homo sapiens
ggtacacgcctgtaa

SEQ ID NO: 23315 - DNA, 15 bp, Homo sapiens
tggtacacgcctgta

SEQ ID NO: 23316 - DNA, 15 bp, Homo sapiens
ctggtacacgcctgt

SEQ ID NO: 23317 - DNA, 15 bp, Homo sapiens
actggtacacgcctg

SEQ ID NO: 23318 - DNA, 15 bp, Homo sapiens
cactggtacacgcct

SEQ ID NO: 23319 - DNA, 15 bp, Homo sapiens
acactggtacacgcc

SEQ ID NO: 23320 - DNA, 15 bp, Homo sapiens
cacactggtacacgc

SEQ ID NO: 23321 - DNA, 15 bp, Homo sapiens
gcacactggtacacg

SEQ ID NO: 23322 - DNA, 15 bp, Homo sapiens
ggcacactggtacac

SEQ ID NO: 23323 - DNA, 15 bp, Homo sapiens
gggcacactggtaca

SEQ ID NO: 23324 - DNA, 15 bp, Homo sapiens
tgggcacactggtac

SEQ ID NO: 23325 - DNA, 15 bp, Homo sapiens
ctgggcacactggta

SEQ ID NO: 23326 - DNA, 15 bp, Homo sapiens
gctgggcacactggt

SEQ ID NO: 23327 - DNA, 15 bp, Homo sapiens
ggctgggcacactgg

SEQ ID NO: 23328 - DNA, 15 bp, Homo sapiens
aggctgggcacactg

SEQ ID NO: 23329 - DNA, 15 bp, Homo sapiens
gaggctgggcacact

SEQ ID NO: 23330 - DNA, 15 bp, Homo sapiens
tgaggctgggcacac

SEQ ID NO: 23331 - DNA, 15 bp, Homo sapiens
ctgaggctgggcaca

SEQ ID NO: 23332 - DNA, 15 bp, Homo sapiens
tctgaggctgggcac

SEQ ID NO: 23333 - DNA, 15 bp, Homo sapiens
atctgaggctgggca

SEQ ID NO: 23334 - DNA, 15 bp, Homo sapiens
catctgaggctgggc

SEQ ID NO: 23335 - DNA, 15 bp, Homo sapiens
ccatctgaggctggg

SEQ ID NO: 23336 - DNA, 15 bp, Homo sapiens
cccatctgaggctgg

SEQ ID NO: 23337 - DNA, 15 bp, Homo sapiens
gcccatctgaggctg

SEQ ID NO: 23338 - DNA, 15 bp, Homo sapiens
agcccatctgaggct

SEQ ID NO: 23339 - DNA, 15 bp, Homo sapiens
gagcccatctgaggc

SEQ ID NO: 23340 - DNA, 15 bp, Homo sapiens
agagcccatctgagg

SEQ ID NO: 23341 - DNA, 15 bp, Homo sapiens
aagagcccatctgag

SEQ ID NO: 23342 - DNA, 15 bp, Homo sapiens
aaagagcccatctga

SEQ ID NO: 23343 - DNA, 15 bp, Homo sapiens
caaagagcccatctg

SEQ ID NO: 23344 - DNA, 15 bp, Homo sapiens
tcaaagagcccatct

SEQ ID NO: 23345 - DNA, 15 bp, Homo sapiens
ttcaaagagcccatc

SEQ ID NO: 23346 - DNA, 15 bp, Homo sapiens
tttcaaagagcccat

SEQ ID NO: 23347 - DNA, 15 bp, Homo sapiens
ttttcaaagagccca

SEQ ID NO: 23348 - DNA, 15 bp, Homo sapiens
tttttcaaagagccc

SEQ ID NO: 23349 - DNA, 15 bp, Homo sapiens
atttttcaaagagcc

SEQ ID NO: 23350 - DNA, 15 bp, Homo sapiens
catttttcaaagagc

SEQ ID NO: 23351 - DNA, 15 bp, Homo sapiens
acatttttcaaagag

SEQ ID NO: 23352 - DNA, 15 bp, Homo sapiens
gtgcccagccagagc

SEQ ID NO: 23353 - DNA, 15 bp, Homo sapiens
cgtgcccagccagag

SEQ ID NO: 23354 - DNA, 15 bp, Homo sapiens
ccgtgcccagccaga

SEQ ID NO: 23355 - DNA, 15 bp, Homo sapiens
accgtgcccagccag

SEQ ID NO: 23356 - DNA, 15 bp, Homo sapiens
caccgtgcccagcca

SEQ ID NO: 23357 - DNA, 15 bp, Homo sapiens
ccaccgtgcccagcc

SEQ ID NO: 23358 - DNA, 15 bp, Homo sapiens
gagccaccgtgccca

SEQ ID NO: 23359 - DNA, 15 bp, Homo sapiens
gacccgcctcagcct

SEQ ID NO: 23360 - DNA, 15 bp, Homo sapiens
cgacccgcctcagcc

SEQ ID NO: 23361 - DNA, 15 bp, Homo sapiens
tcgacccgcctcagc

SEQ ID NO: 23362 - DNA, 15 bp, Homo sapiens
atcgacccgcctcag

SEQ ID NO: 23363 - DNA, 15 bp, Homo sapiens
gatcgacccgcctca

SEQ ID NO: 23364 - DNA, 15 bp, Homo sapiens
gcaggctggtctcga

SEQ ID NO: 23365 - DNA, 15 bp, Homo sapiens
ggcaggctggtctcg

SEQ ID NO: 23366 - DNA, 15 bp, Homo sapiens
gggcaggctggtctc

SEQ ID NO: 23367 - DNA, 15 bp, Homo sapiens
tgggcaggctggtct

SEQ ID NO: 23368 - DNA, 15 bp, Homo sapiens
ttgggcaggctggtc

SEQ ID NO: 23369 - DNA, 15 bp, Homo sapiens
gttgggcaggctggt

SEQ ID NO: 23370 - DNA, 15 bp, Homo sapiens
tgttgggcaggctgg

SEQ ID NO: 23371 - DNA, 15 bp, Homo sapiens
atgttgggcaggctg

SEQ ID NO: 23372 - DNA, 15 bp, Homo sapiens
catgttgggcaggct

SEQ ID NO: 23373 - DNA, 15 bp, Homo sapiens
ccatgttgggcaggc

SEQ ID NO: 23374 - DNA, 15 bp, Homo sapiens
accatgttgggcagg

SEQ ID NO: 23375 - DNA, 15 bp, Homo sapiens
caccatgttgggcag

SEQ ID NO: 23376 - DNA, 15 bp, Homo sapiens
tcaccatgttgggca

SEQ ID NO: 23377 - DNA, 15 bp, Homo sapiens
ttcaccatgttgggc

SEQ ID NO: 23378 - DNA, 15 bp, Homo sapiens
tttcaccatgttggg

SEQ ID NO: 23379 - DNA, 15 bp, Homo sapiens
ggtttcaccatgttg

SEQ ID NO: 23380 - DNA, 15 bp, Homo sapiens
gggtttcaccatgtt

SEQ ID NO: 23381 - DNA, 15 bp, Homo sapiens
ggggtttcaccatgt

SEQ ID NO: 23382 - DNA, 15 bp, Homo sapiens
ggagacggggtttca

SEQ ID NO: 23383 - DNA, 15 bp, Homo sapiens
tggagacggggtttc

SEQ ID NO: 23384 - DNA, 15 bp, Homo sapiens
gtggagacggggttt

SEQ ID NO: 23385 - DNA, 15 bp, Homo sapiens
agtggagacggggtt

SEQ ID NO: 23386 - DNA, 15 bp, Homo sapiens
tagtggagacggggt

SEQ ID NO: 23387 - DNA, 15 bp, Homo sapiens
ttagtggagacgggg

SEQ ID NO: 23388 - DNA, 15 bp, Homo sapiens
tttagtggagacggg

SEQ ID NO: 23389 - DNA, 15 bp, Homo sapiens
gtttagtggagacgg

SEQ ID NO: 23390 - DNA, 15 bp, Homo sapiens
tgtttagtggagacg

SEQ ID NO: 23391 - DNA, 15 bp, Homo sapiens
atgtttagtggagac

SEQ ID NO: 23392 - DNA, 15 bp, Homo sapiens
tatgtttagtggaga

SEQ ID NO: 23393 - DNA, 15 bp, Homo sapiens
gtatgtttagtggag

SEQ ID NO: 23394 - DNA, 15 bp, Homo sapiens
tgtatgtttagtgga

SEQ ID NO: 23395 - DNA, 15 bp, Homo sapiens
ttgtatgtttagtgg

SEQ ID NO: 23396 - DNA, 15 bp, Homo sapiens
tttgtatgtttagtg

SEQ ID NO: 23397 - DNA, 15 bp, Homo sapiens
ttttgtatgtttagt

SEQ ID NO: 23398 - DNA, 15 bp, Homo sapiens
tttttgtatgtttag

SEQ ID NO: 23399 - DNA, 15 bp, Homo sapiens
atttttgtatgttta

SEQ ID NO: 23400 - DNA, 15 bp, Homo sapiens
aatttttgtatgttt

SEQ ID NO: 23401 - DNA, 15 bp, Homo sapiens
taatttttgtatgtt

SEQ ID NO: 23402 - DNA, 15 bp, Homo sapiens
ctaatttttgtatgt

SEQ ID NO: 23403 - DNA, 15 bp, Homo sapiens
gctaatttttgtatg

SEQ ID NO: 23404 - DNA, 15 bp, Homo sapiens
aggctaatttttgta

SEQ ID NO: 23405 - DNA, 15 bp, Homo sapiens
caggctaatttttgt

SEQ ID NO: 23406 - DNA, 15 bp, Homo sapiens
ccaggctaatttttg

SEQ ID NO: 23407 - DNA, 15 bp, Homo sapiens
gccaggctaattttt

SEQ ID NO: 23408 - DNA, 15 bp, Homo sapiens
cgccaggctaatttt

SEQ ID NO: 23409 - DNA, 15 bp, Homo sapiens
acgccaggctaattt

SEQ ID NO: 23410 - DNA, 15 bp, Homo sapiens
cacgccaggctaatt

SEQ ID NO: 23411 - DNA, 15 bp, Homo sapiens
ccacgccaggctaat

SEQ ID NO: 23412 - DNA, 15 bp, Homo sapiens
accacgccaggctaa

SEQ ID NO: 23413 - DNA, 15 bp, Homo sapiens
taccacgccaggcta

SEQ ID NO: 23414 - DNA, 15 bp, Homo sapiens
ctaccacgccaggct

SEQ ID NO: 23415 - DNA, 15 bp, Homo sapiens
gctaccacgccaggc

SEQ ID NO: 23416 - DNA, 15 bp, Homo sapiens
tgctaccacgccagg

SEQ ID NO: 23417 - DNA, 15 bp, Homo sapiens
gtgctaccacgccag

SEQ ID NO: 23418 - DNA, 15 bp, Homo sapiens
tgtgctaccacgcca

SEQ ID NO: 23419 - DNA, 15 bp, Homo sapiens
gtgtgctaccacgcc

SEQ ID NO: 23420 - DNA, 15 bp, Homo sapiens
cgtgtgctaccacgc

SEQ ID NO: 23421 - DNA, 15 bp, Homo sapiens
gcgtgtgctaccacg

SEQ ID NO: 23422 - DNA, 15 bp, Homo sapiens
ggcgtgtgctaccac

SEQ ID NO: 23423 - DNA, 15 bp, Homo sapiens
aggcgtgtgctacca

SEQ ID NO: 23424 - DNA, 15 bp, Homo sapiens
caggcgtgtgctacc

SEQ ID NO: 23425 - DNA, 15 bp, Homo sapiens
acaggcgtgtgctac

SEQ ID NO: 23426 - DNA, 15 bp, Homo sapiens
cacaggcgtgtgcta

SEQ ID NO: 23427 - DNA, 15 bp, Homo sapiens
tcacaggcgtgtgct

SEQ ID NO: 23428 - DNA, 15 bp, Homo sapiens
atcacaggcgtgtgc

SEQ ID NO: 23429 - DNA, 15 bp, Homo sapiens
gatcacaggcgtgtg

SEQ ID NO: 23430 - DNA, 15 bp, Homo sapiens
ggatcacaggcgtgt

SEQ ID NO: 23431 - DNA, 15 bp, Homo sapiens
gggatcacaggcgtg

SEQ ID NO: 23432 - DNA, 15 bp, Homo sapiens
tgggatcacaggcgt

SEQ ID NO: 23433 - DNA, 15 bp, Homo sapiens
ctgggatcacaggcg

SEQ ID NO: 23434 - DNA, 15 bp, Homo sapiens
gctgggatcacaggc

SEQ ID NO: 23435 - DNA, 15 bp, Homo sapiens
agctgggatcacagg

SEQ ID NO: 23436 - DNA, 15 bp, Homo sapiens
tagctgggatcacag

SEQ ID NO: 23437 - DNA, 15 bp, Homo sapiens
gtagctgggatcaca

SEQ ID NO: 23438 - DNA, 15 bp, Homo sapiens
agtagctgggatcac

SEQ ID NO: 23439 - DNA, 15 bp, Homo sapiens
gagtagctgggatca

SEQ ID NO: 23440 - DNA, 15 bp, Homo sapiens
ggagtagctgggatc

SEQ ID NO: 23441 - DNA, 15 bp, Homo sapiens
tattctcctgcctca

SEQ ID NO: 23442 - DNA, 15 bp, Homo sapiens
ttattctcctgcctc

SEQ ID NO: 23443 - DNA, 15 bp, Homo sapiens
gttattctcctgcct

SEQ ID NO: 23444 - DNA, 15 bp, Homo sapiens
agttattctcctgcc

SEQ ID NO: 23445 - DNA, 15 bp, Homo sapiens
aagttattctcctgc

SEQ ID NO: 23446 - DNA, 15 bp, Homo sapiens
caagttattctcctg

SEQ ID NO: 23447 - DNA, 15 bp, Homo sapiens
tcaagttattctcct

SEQ ID NO: 23448 - DNA, 15 bp, Homo sapiens
ttcaagttattctcc

SEQ ID NO: 23449 - DNA, 15 bp, Homo sapiens
gttcaagttattctc

SEQ ID NO: 23450 - DNA, 15 bp, Homo sapiens
ggttcaagttattct

SEQ ID NO: 23451 - DNA, 15 bp, Homo sapiens
gggttcaagttattc

SEQ ID NO: 23452 - DNA, 15 bp, Homo sapiens
cgggttcaagttatt

SEQ ID NO: 23453 - DNA, 15 bp, Homo sapiens
ccgggttcaagttat

SEQ ID NO: 23454 - DNA, 15 bp, Homo sapiens
gccgggttcaagtta

SEQ ID NO: 23455 - DNA, 15 bp, Homo sapiens
tgccgggttcaagtt

SEQ ID NO: 23456 - DNA, 15 bp, Homo sapiens
ctgccgggttcaagt

SEQ ID NO: 23457 - DNA, 15 bp, Homo sapiens
cctgccgggttcaag

SEQ ID NO: 23458 - DNA, 15 bp, Homo sapiens
gcctgccgggttcaa

SEQ ID NO: 23459 - DNA, 15 bp, Homo sapiens
cgcctgccgggttca

SEQ ID NO: 23460 - DNA, 15 bp, Homo sapiens
ccgcctgccgggttc

SEQ ID NO: 23461 - DNA, 15 bp, Homo sapiens
tccgcctgccgggtt

SEQ ID NO: 23462 - DNA, 15 bp, Homo sapiens
ctccgcctgccgggt

SEQ ID NO: 23463 - DNA, 15 bp, Homo sapiens
cctccgcctgccggg

SEQ ID NO: 23464 - DNA, 15 bp, Homo sapiens
acctccgcctgccgg

SEQ ID NO: 23465 - DNA, 15 bp, Homo sapiens
aacctccgcctgccg

SEQ ID NO: 23466 - DNA, 15 bp, Homo sapiens
caacctccgcctgcc

SEQ ID NO: 23467 - DNA, 15 bp, Homo sapiens
gcaacctccgcctgc

SEQ ID NO: 23468 - DNA, 15 bp, Homo sapiens
cgcaacctccgcctg

SEQ ID NO: 23469 - DNA, 15 bp, Homo sapiens
tcgcaacctccgcct

SEQ ID NO: 23470 - DNA, 15 bp, Homo sapiens
atcgcaacctccgcc

SEQ ID NO: 23471 - DNA, 15 bp, Homo sapiens
catcgcaacctccgc

SEQ ID NO: 23472 - DNA, 15 bp, Homo sapiens
tcatcgcaacctccg

SEQ ID NO: 23473 - DNA, 15 bp, Homo sapiens
ctcatcgcaacctcc

SEQ ID NO: 23474 - DNA, 15 bp, Homo sapiens
gctcatcgcaacctc

SEQ ID NO: 23475 - DNA, 15 bp, Homo sapiens
ggctcatcgcaacct

SEQ ID NO: 23476 - DNA, 15 bp, Homo sapiens
cggctcatcgcaacc

SEQ ID NO: 23477 - DNA, 15 bp, Homo sapiens
tcggctcatcgcaac

SEQ ID NO: 23478 - DNA, 15 bp, Homo sapiens
atcggctcatcgcaa

SEQ ID NO: 23479 - DNA, 15 bp, Homo sapiens
tatcggctcatcgca

SEQ ID NO: 23480 - DNA, 15 bp, Homo sapiens
atatcggctcatcgc

SEQ ID NO: 23481 - DNA, 15 bp, Homo sapiens
aatatcggctcatcg

SEQ ID NO: 23482 - DNA, 15 bp, Homo sapiens
taatatcggctcatc

SEQ ID NO: 23483 - DNA, 15 bp, Homo sapiens
ataatatcggctcat

SEQ ID NO: 23484 - DNA, 15 bp, Homo sapiens
cataatatcggctca

SEQ ID NO: 23485 - DNA, 15 bp, Homo sapiens
gcataatatcggctc

SEQ ID NO: 23486 - DNA, 15 bp, Homo sapiens
ggcataatatcggct

SEQ ID NO: 23487 - DNA, 15 bp, Homo sapiens
tggcataatatcggc

SEQ ID NO: 23488 - DNA, 15 bp, Homo sapiens
atggcataatatcgg

SEQ ID NO: 23489 - DNA, 15 bp, Homo sapiens
gatggcataatatcg

SEQ ID NO: 23490 - DNA, 15 bp, Homo sapiens
cgatggcataatatc

SEQ ID NO: 23491 - DNA, 15 bp, Homo sapiens
ccgatggcataatat

SEQ ID NO: 23492 - DNA, 15 bp, Homo sapiens
gccgatggcataata

SEQ ID NO: 23493 - DNA, 15 bp, Homo sapiens
tgccgatggcataat

SEQ ID NO: 23494 - DNA, 15 bp, Homo sapiens
ttgccgatggcataa

SEQ ID NO: 23495 - DNA, 15 bp, Homo sapiens
gttgccgatggcata

SEQ ID NO: 23496 - DNA, 15 bp, Homo sapiens
tgttgccgatggcat

SEQ ID NO: 23497 - DNA, 15 bp, Homo sapiens
ctgttgccgatggca

SEQ ID NO: 23498 - DNA, 15 bp, Homo sapiens
tctgttgccgatggc

SEQ ID NO: 23499 - DNA, 15 bp, Homo sapiens
ctctgttgccgatgg

SEQ ID NO: 23500 - DNA, 15 bp, Homo sapiens
gctctgttgccgatg

SEQ ID NO: 23501 - DNA, 15 bp, Homo sapiens
cgctctgttgccgat

SEQ ID NO: 23502 - DNA, 15 bp, Homo sapiens
tcgctctgttgccga

SEQ ID NO: 23503 - DNA, 15 bp, Homo sapiens
ctcgctctgttgccg

SEQ ID NO: 23504 - DNA, 15 bp, Homo sapiens
tctcgctctgttgcc

SEQ ID NO: 23505 - DNA, 15 bp, Homo sapiens
gtctcgctctgttgc

SEQ ID NO: 23506 - DNA, 15 bp, Homo sapiens
agtctcgctctgttg

SEQ ID NO: 23507 - DNA, 15 bp, Homo sapiens
gagtctcgctctgtt

SEQ ID NO: 23508 - DNA, 15 bp, Homo sapiens
ggagtctcgctctgt

SEQ ID NO: 23509 - DNA, 15 bp, Homo sapiens
tggagtctcgctctg

SEQ ID NO: 23510 - DNA, 15 bp, Homo sapiens
atggagtctcgctct

SEQ ID NO: 23511 - DNA, 15 bp, Homo sapiens
gatggagtctcgctc

SEQ ID NO: 23512 - DNA, 15 bp, Homo sapiens
agatggagtctcgct

SEQ ID NO: 23513 - DNA, 15 bp, Homo sapiens
gagatggagtctcgc

SEQ ID NO: 23514 - DNA, 15 bp, Homo sapiens
tgagatggagtctcg

SEQ ID NO: 23515 - DNA, 15 bp, Homo sapiens
gttttttttttgaga

SEQ ID NO: 23516 - DNA, 15 bp, Homo sapiens
tgttttttttttgag

SEQ ID NO: 23517 - DNA, 15 bp, Homo sapiens
ttgttttttttttga

SEQ ID NO: 23518 - DNA, 15 bp, Homo sapiens
tttgttttttttttg

SEQ ID NO: 23519 - DNA, 15 bp, Homo sapiens
ttttgtttttttttt

SEQ ID NO: 23520 - DNA, 15 bp, Homo sapiens
tttttgttttttttt

SEQ ID NO: 23521 - DNA, 15 bp, Homo sapiens
ttttttgtttttttt

SEQ ID NO: 23522 - DNA, 15 bp, Homo sapiens
gttttttgttttttt

SEQ ID NO: 23523 - DNA, 15 bp, Homo sapiens
tgttttttgtttttt

SEQ ID NO: 23524 - DNA, 15 bp, Homo sapiens
ttgttttttgttttt

SEQ ID NO: 23525 - DNA, 15 bp, Homo sapiens
tttgttttttgtttt

SEQ ID NO: 23526 - DNA, 15 bp, Homo sapiens
ttttgttttttgttt

SEQ ID NO: 23527 - DNA, 15 bp, Homo sapiens
gttttgttttttgtt

SEQ ID NO: 23528 - DNA, 15 bp, Homo sapiens
tgttttgttttttgt

SEQ ID NO: 23529 - DNA, 15 bp, Homo sapiens
ttgttttgttttttg

SEQ ID NO: 23530 - DNA, 15 bp, Homo sapiens
cttgttttgtttttt

SEQ ID NO: 23531 - DNA, 15 bp, Homo sapiens
ccttgttttgttttt

SEQ ID NO: 23532 - DNA, 15 bp, Homo sapiens
gccttgttttgtttt

SEQ ID NO: 23533 - DNA, 15 bp, Homo sapiens
cgccttgttttgttt

SEQ ID NO: 23534 - DNA, 15 bp, Homo sapiens
tcgccttgttttgtt

SEQ ID NO: 23535 - DNA, 15 bp, Homo sapiens
ctcgccttgttttgt

SEQ ID NO: 23536 - DNA, 15 bp, Homo sapiens
gctcgccttgttttg

SEQ ID NO: 23537 - DNA, 15 bp, Homo sapiens
agctcgccttgtttt

SEQ ID NO: 23538 - DNA, 15 bp, Homo sapiens
gagctcgccttgttt

SEQ ID NO: 23539 - DNA, 15 bp, Homo sapiens
agagctcgccttgtt

SEQ ID NO: 23540 - DNA, 15 bp, Homo sapiens
cagagctcgccttgt

SEQ ID NO: 23541 - DNA, 15 bp, Homo sapiens
acagagctcgccttg

SEQ ID NO: 23542 - DNA, 15 bp, Homo sapiens
cacagagctcgcctt

SEQ ID NO: 23543 - DNA, 15 bp, Homo sapiens
gcacagagctcgcct

SEQ ID NO: 23544 - DNA, 15 bp, Homo sapiens
agcacagagctcgcc

SEQ ID NO: 23545 - DNA, 15 bp, Homo sapiens
cagcacagagctcgc

SEQ ID NO: 23546 - DNA, 15 bp, Homo sapiens
ccagcacagagctcg

SEQ ID NO: 23547 - DNA, 15 bp, Homo sapiens
cccagcacagagctc

SEQ ID NO: 23548 - DNA, 15 bp, Homo sapiens
tcccagcacagagct

SEQ ID NO: 23549 - DNA, 15 bp, Homo sapiens
gtcccagcacagagc

SEQ ID NO: 23550 - DNA, 15 bp, Homo sapiens
tgtcccagcacagag

SEQ ID NO: 23551 - DNA, 15 bp, Homo sapiens
ctgtcccagcacaga

SEQ ID NO: 23552 - DNA, 15 bp, Homo sapiens
tctgtcccagcacag

SEQ ID NO: 23553 - DNA, 15 bp, Homo sapiens
atctgtcccagcaca

SEQ ID NO: 23554 - DNA, 15 bp, Homo sapiens
aatctgtcccagcac

SEQ ID NO: 23555 - DNA, 15 bp, Homo sapiens
taatctgtcccagca

SEQ ID NO: 23556 - DNA, 15 bp, Homo sapiens
ctaatctgtcccagc

SEQ ID NO: 23557 - DNA, 15 bp, Homo sapiens
cctaatctgtcccag

SEQ ID NO: 23558 - DNA, 15 bp, Homo sapiens
ccctaatctgtccca

SEQ ID NO: 23559 - DNA, 15 bp, Homo sapiens
tccctaatctgtccc

SEQ ID NO: 23560 - DNA, 15 bp, Homo sapiens
gtccctaatctgtcc

SEQ ID NO: 23561 - DNA, 15 bp, Homo sapiens
ggtccctaatctgtc

SEQ ID NO: 23562 - DNA, 15 bp, Homo sapiens
gggtccctaatctgt

SEQ ID NO: 23563 - DNA, 15 bp, Homo sapiens
ggggtccctaatctg

SEQ ID NO: 23564 - DNA, 15 bp, Homo sapiens
aggggtccctaatct

SEQ ID NO: 23565 - DNA, 15 bp, Homo sapiens
gaggggtccctaatc

SEQ ID NO: 23566 - DNA, 15 bp, Homo sapiens
agaggggtccctaat

SEQ ID NO: 23567 - DNA, 15 bp, Homo sapiens
aagaggggtccctaa

SEQ ID NO: 23568 - DNA, 15 bp, Homo sapiens
aaagaggggtcccta

SEQ ID NO: 23569 - DNA, 15 bp, Homo sapiens
taaagaggggtccct

SEQ ID NO: 23570 - DNA, 15 bp, Homo sapiens
gtaaagaggggtccc

SEQ ID NO: 23571 - DNA, 15 bp, Homo sapiens
tgtaaagaggggtcc

SEQ ID NO: 23572 - DNA, 15 bp, Homo sapiens
ctgtaaagaggggtc

SEQ ID NO: 23573 - DNA, 15 bp, Homo sapiens
gctgtaaagaggggt

SEQ ID NO: 23574 - DNA, 15 bp, Homo sapiens
tgctgtaaagagggg

SEQ ID NO: 23575 - DNA, 15 bp, Homo sapiens
ttgctgtaaagaggg

SEQ ID NO: 23576 - DNA, 15 bp, Homo sapiens
cttgctgtaaagagg

SEQ ID NO: 23577 - DNA, 15 bp, Homo sapiens
tcttgctgtaaagag

SEQ ID NO: 23578 - DNA, 15 bp, Homo sapiens
ttcttgctgtaaaga

SEQ ID NO: 23579 - DNA, 15 bp, Homo sapiens
tttcttgctgtaaag

SEQ ID NO: 23580 - DNA, 15 bp, Homo sapiens
ctttcttgctgtaaa

SEQ ID NO: 23581 - DNA, 15 bp, Homo sapiens
tctttcttgctgtaa

SEQ ID NO: 23582 - DNA, 15 bp, Homo sapiens
gtctttcttgctgta

SEQ ID NO: 23583 - DNA, 15 bp, Homo sapiens
agtctttcttgctgt

SEQ ID NO: 23584 - DNA, 15 bp, Homo sapiens
cagtctttcttgctg

SEQ ID NO: 23585 - DNA, 15 bp, Homo sapiens
gcagtctttcttgct

SEQ ID NO: 23586 - DNA, 15 bp, Homo sapiens
agcagtctttcttgc

SEQ ID NO: 23587 - DNA, 15 bp, Homo sapiens
gagcagtctttcttg

SEQ ID NO: 23588 - DNA, 15 bp, Homo sapiens
agagcagtctttctt

SEQ ID NO: 23589 - DNA, 15 bp, Homo sapiens
cagagcagtctttct

SEQ ID NO: 23590 - DNA, 15 bp, Homo sapiens
acagagcagtctttc

SEQ ID NO: 23591 - DNA, 15 bp, Homo sapiens
cacagagcagtcttt

SEQ ID NO: 23592 - DNA, 15 bp, Homo sapiens
ccacagagcagtctt

SEQ ID NO: 23593 - DNA, 15 bp, Homo sapiens
cccacagagcagtct

SEQ ID NO: 23594 - DNA, 15 bp, Homo sapiens
acccacagagcagtc

SEQ ID NO: 23595 - DNA, 15 bp, Homo sapiens
aacccacagagcagt

SEQ ID NO: 23596 - DNA, 15 bp, Homo sapiens
caacccacagagcag

SEQ ID NO: 23597 - DNA, 15 bp, Homo sapiens
acaacccacagagca

SEQ ID NO: 23598 - DNA, 15 bp, Homo sapiens
tacaacccacagagc

SEQ ID NO: 23599 - DNA, 15 bp, Homo sapiens
ctacaacccacagag

SEQ ID NO: 23600 - DNA, 15 bp, Homo sapiens
cctacaacccacaga

SEQ ID NO: 23601 - DNA, 15 bp, Homo sapiens
tcctacaacccacag

SEQ ID NO: 23602 - DNA, 15 bp, Homo sapiens
atcctacaacccaca

SEQ ID NO: 23603 - DNA, 15 bp, Homo sapiens
catcctacaacccac

SEQ ID NO: 23604 - DNA, 15 bp, Homo sapiens
gcatcctacaaccca

SEQ ID NO: 23605 - DNA, 15 bp, Homo sapiens
ggcatcctacaaccc

SEQ ID NO: 23606 - DNA, 15 bp, Homo sapiens
aggcatcctacaacc

SEQ ID NO: 23607 - DNA, 15 bp, Homo sapiens
aaggcatcctacaac

SEQ ID NO: 23608 - DNA, 15 bp, Homo sapiens
aaaggcatcctacaa

SEQ ID NO: 23609 - DNA, 15 bp, Homo sapiens
caaaggcatcctaca

SEQ ID NO: 23610 - DNA, 15 bp, Homo sapiens
acaaaggcatcctac

SEQ ID NO: 23611 - DNA, 15 bp, Homo sapiens
cacaaaggcatccta

SEQ ID NO: 23612 - DNA, 15 bp, Homo sapiens
acacaaaggcatcct

SEQ ID NO: 23613 - DNA, 15 bp, Homo sapiens
tacacaaaggcatcc

SEQ ID NO: 23614 - DNA, 15 bp, Homo sapiens
atacacaaaggcatc

SEQ ID NO: 23615 - DNA, 15 bp, Homo sapiens
catacacaaaggcat

SEQ ID NO: 23616 - DNA, 15 bp, Homo sapiens
gcatacacaaaggca

SEQ ID NO: 23617 - DNA, 15 bp, Homo sapiens
tgcatacacaaaggc

SEQ ID NO: 23618 - DNA, 15 bp, Homo sapiens
ctgcatacacaaagg

SEQ ID NO: 23619 - DNA, 15 bp, Homo sapiens
actgcatacacaaag

SEQ ID NO: 23620 - DNA, 15 bp, Homo sapiens
cactgcatacacaaa

SEQ ID NO: 23621 - DNA, 15 bp, Homo sapiens
ccactgcatacacaa

SEQ ID NO: 23622 - DNA, 15 bp, Homo sapiens
gccactgcatacaca

SEQ ID NO: 23623 - DNA, 15 bp, Homo sapiens
agccactgcatacac

SEQ ID NO: 23624 - DNA, 15 bp, Homo sapiens
gagccactgcataca

SEQ ID NO: 23625 - DNA, 15 bp, Homo sapiens
agagccactgcatac

SEQ ID NO: 23626 - DNA, 15 bp, Homo sapiens
tagagccactgcata

SEQ ID NO: 23627 - DNA, 15 bp, Homo sapiens
ctagagccactgcat

SEQ ID NO: 23628 - DNA, 15 bp, Homo sapiens
cctagagccactgca

SEQ ID NO: 23629 - DNA, 15 bp, Homo sapiens
acctagagccactgc

SEQ ID NO: 23630 - DNA, 15 bp, Homo sapiens
cacctagagccactg

SEQ ID NO: 23631 - DNA, 15 bp, Homo sapiens
tcacctagagccact

SEQ ID NO: 23632 - DNA, 15 bp, Homo sapiens
gtcacctagagccac

SEQ ID NO: 23633 - DNA, 15 bp, Homo sapiens
agtcacctagagcca

SEQ ID NO: 23634 - DNA, 15 bp, Homo sapiens
gagtcacctagagcc

SEQ ID NO: 23635 - DNA, 15 bp, Homo sapiens
agagtcacctagagc

SEQ ID NO: 23636 - DNA, 15 bp, Homo sapiens
cagagtcacctagag

SEQ ID NO: 23637 - DNA, 15 bp, Homo sapiens
ccagagtcacctaga

SEQ ID NO: 23638 - DNA, 15 bp, Homo sapiens
gccagagtcacctag

SEQ ID NO: 23639 - DNA, 15 bp, Homo sapiens
tgccagagtcaccta

SEQ ID NO: 23640 - DNA, 15 bp, Homo sapiens
ctgccagagtcacct

SEQ ID NO: 23641 - DNA, 15 bp, Homo sapiens
gctgccagagtcacc

SEQ ID NO: 23642 - DNA, 15 bp, Homo sapiens
ggctgccagagtcac

SEQ ID NO: 23643 - DNA, 15 bp, Homo sapiens
tggctgccagagtca

SEQ ID NO: 23644 - DNA, 15 bp, Homo sapiens
gtggctgccagagtc

SEQ ID NO: 23645 - DNA, 15 bp, Homo sapiens
tgtggctgccagagt

SEQ ID NO: 23646 - DNA, 15 bp, Homo sapiens
gtgtggctgccagag

SEQ ID NO: 23647 - DNA, 15 bp, Homo sapiens
agtgtggctgccaga

SEQ ID NO: 23648 - DNA, 15 bp, Homo sapiens
gagtgtggctgccag

SEQ ID NO: 23649 - DNA, 15 bp, Homo sapiens
agagtgtggctgcca

SEQ ID NO: 23650 - DNA, 15 bp, Homo sapiens
cagagtgtggctgcc

SEQ ID NO: 23651 - DNA, 15 bp, Homo sapiens
ccagagtgtggctgc

SEQ ID NO: 23652 - DNA, 15 bp, Homo sapiens
cccagagtgtggctg

SEQ ID NO: 23653 - DNA, 15 bp, Homo sapiens
gcccagagtgtggct

SEQ ID NO: 23654 - DNA, 15 bp, Homo sapiens
ggcccagagtgtggc

SEQ ID NO: 23655 - DNA, 15 bp, Homo sapiens
gggcccagagtgtgg

SEQ ID NO: 23656 - DNA, 15 bp, Homo sapiens
agggcccagagtgtg

SEQ ID NO: 23657 - DNA, 15 bp, Homo sapiens
tagggcccagagtgt

SEQ ID NO: 23658 - DNA, 15 bp, Homo sapiens
ttagggcccagagtg

SEQ ID NO: 23659 - DNA, 15 bp, Homo sapiens
tttagggcccagagt

SEQ ID NO: 23660 - DNA, 15 bp, Homo sapiens
gtttagggcccagag

SEQ ID NO: 23661 - DNA, 15 bp, Homo sapiens
agtttagggcccaga

SEQ ID NO: 23662 - DNA, 15 bp, Homo sapiens
aagtttagggcccag

SEQ ID NO: 23663 - DNA, 15 bp, Homo sapiens
gaagtttagggccca

SEQ ID NO: 23664 - DNA, 15 bp, Homo sapiens
agaagtttagggccc

SEQ ID NO: 23665 - DNA, 15 bp, Homo sapiens
cagaagtttagggcc

SEQ ID NO: 23666 - DNA, 15 bp, Homo sapiens
ccagaagtttagggc

SEQ ID NO: 23667 - DNA, 15 bp, Homo sapiens
tccagaagtttaggg

SEQ ID NO: 23668 - DNA, 15 bp, Homo sapiens
ctccagaagtttagg

SEQ ID NO: 23669 - DNA, 15 bp, Homo sapiens
cctccagaagtttag

SEQ ID NO: 23670 - DNA, 15 bp, Homo sapiens
tcctccagaagttta

SEQ ID NO: 23671 - DNA, 15 bp, Homo sapiens
ttcctccagaagttt

SEQ ID NO: 23672 - DNA, 15 bp, Homo sapiens
cttcctccagaagtt

SEQ ID NO: 23673 - DNA, 15 bp, Homo sapiens
tcttcctccagaagt

SEQ ID NO: 23674 - DNA, 15 bp, Homo sapiens
atcttcctccagaag

SEQ ID NO: 23675 - DNA, 15 bp, Homo sapiens
tatcttcctccagaa

SEQ ID NO: 23676 - DNA, 15 bp, Homo sapiens
gtatcttcctccaga

SEQ ID NO: 23677 - DNA, 15 bp, Homo sapiens
tgtatcttcctccag

SEQ ID NO: 23678 - DNA, 15 bp, Homo sapiens
ctgtatcttcctcca

SEQ ID NO: 23679 - DNA, 15 bp, Homo sapiens
cctgtatcttcctcc

SEQ ID NO: 23680 - DNA, 15 bp, Homo sapiens
tcctgtatcttcctc

SEQ ID NO: 23681 - DNA, 15 bp, Homo sapiens
atcctgtatcttcct

SEQ ID NO: 23682 - DNA, 15 bp, Homo sapiens
tatcctgtatcttcc

SEQ ID NO: 23683 - DNA, 15 bp, Homo sapiens
ctatcctgtatcttc

SEQ ID NO: 23684 - DNA, 15 bp, Homo sapiens
cctatcctgtatctt

SEQ ID NO: 23685 - DNA, 15 bp, Homo sapiens
ccctatcctgtatct

SEQ ID NO: 23686 - DNA, 15 bp, Homo sapiens
tccctatcctgtatc

SEQ ID NO: 23687 - DNA, 15 bp, Homo sapiens
ctccctatcctgtat

SEQ ID NO: 23688 - DNA, 15 bp, Homo sapiens
cctccctatcctgta

SEQ ID NO: 23689 - DNA, 15 bp, Homo sapiens
tcctccctatcctgt

SEQ ID NO: 23690 - DNA, 15 bp, Homo sapiens
ttcctccctatcctg

SEQ ID NO: 23691 - DNA, 15 bp, Homo sapiens
gttcctccctatcct

SEQ ID NO: 23692 - DNA, 15 bp, Homo sapiens
agttcctccctatcc

SEQ ID NO: 23693 - DNA, 15 bp, Homo sapiens
gagttcctccctatc

SEQ ID NO: 23694 - DNA, 15 bp, Homo sapiens
tgagttcctccctat

SEQ ID NO: 23695 - DNA, 15 bp, Homo sapiens
ctgagttcctcccta

SEQ ID NO: 23696 - DNA, 15 bp, Homo sapiens
cctgagttcctccct

SEQ ID NO: 23697 - DNA, 15 bp, Homo sapiens
ccctgagttcctccc

SEQ ID NO: 23698 - DNA, 15 bp, Homo sapiens
cccctgagttcctcc

SEQ ID NO: 23699 - DNA, 15 bp, Homo sapiens
acccctgagttcctc

SEQ ID NO: 23700 - DNA, 15 bp, Homo sapiens
cacccctgagttcct

SEQ ID NO: 23701 - DNA, 15 bp, Homo sapiens
tcacccctgagttcc

SEQ ID NO: 23702 - DNA, 15 bp, Homo sapiens
ctcacccctgagttc

SEQ ID NO: 23703 - DNA, 15 bp, Homo sapiens
actcacccctgagtt

SEQ ID NO: 23704 - DNA, 15 bp, Homo sapiens
gactcacccctgagt

SEQ ID NO: 23705 - DNA, 15 bp, Homo sapiens
tgactcacccctgag

SEQ ID NO: 23706 - DNA, 15 bp, Homo sapiens
atgactcacccctga

SEQ ID NO: 23707 - DNA, 15 bp, Homo sapiens
catgactcacccctg

SEQ ID NO: 23708 - DNA, 15 bp, Homo sapiens
ccatgactcacccct

SEQ ID NO: 23709 - DNA, 15 bp, Homo sapiens
accatgactcacccc

SEQ ID NO: 23710 - DNA, 15 bp, Homo sapiens
caccatgactcaccc

SEQ ID NO: 23711 - DNA, 15 bp, Homo sapiens
ccaccatgactcacc

SEQ ID NO: 23712 - DNA, 15 bp, Homo sapiens
cccaccatgactcac

SEQ ID NO: 23713 - DNA, 15 bp, Homo sapiens
ccccaccatgactca

SEQ ID NO: 23714 - DNA, 15 bp, Homo sapiens
tccccaccatgactc

SEQ ID NO: 23715 - DNA, 15 bp, Homo sapiens
gtccccaccatgact

SEQ ID NO: 23716 - DNA, 15 bp, Homo sapiens
tgtccccaccatgac

SEQ ID NO: 23717 - DNA, 15 bp, Homo sapiens
ttgtccccaccatga

SEQ ID NO: 23718 - DNA, 15 bp, Homo sapiens
cttgtccccaccatg

SEQ ID NO: 23719 - DNA, 15 bp, Homo sapiens
tcttgtccccaccat

SEQ ID NO: 23720 - DNA, 15 bp, Homo sapiens
gtcttgtccccacca

SEQ ID NO: 23721 - DNA, 15 bp, Homo sapiens
tgtcttgtccccacc

SEQ ID NO: 23722 - DNA, 15 bp, Homo sapiens
atgtcttgtccccac

SEQ ID NO: 23723 - DNA, 15 bp, Homo sapiens
aatgtcttgtcccca

SEQ ID NO: 23724 - DNA, 15 bp, Homo sapiens
gaatgtcttgtcccc

SEQ ID NO: 23725 - DNA, 15 bp, Homo sapiens
ggaatgtcttgtccc

SEQ ID NO: 23726 - DNA, 15 bp, Homo sapiens
gggaatgtcttgtcc

SEQ ID NO: 23727 - DNA, 15 bp, Homo sapiens
agggaatgtcttgtc

SEQ ID NO: 23728 - DNA, 15 bp, Homo sapiens
gagggaatgtcttgt

SEQ ID NO: 23729 - DNA, 15 bp, Homo sapiens
tgagggaatgtcttg

SEQ ID NO: 23730 - DNA, 15 bp, Homo sapiens
gtgagggaatgtctt

SEQ ID NO: 23731 - DNA, 15 bp, Homo sapiens
agtgagggaatgtct

SEQ ID NO: 23732 - DNA, 15 bp, Homo sapiens
gagtgagggaatgtc

SEQ ID NO: 23733 - DNA, 15 bp, Homo sapiens
agagtgagggaatgt

SEQ ID NO: 23734 - DNA, 15 bp, Homo sapiens
tagagtgagggaatg

SEQ ID NO: 23735 - DNA, 15 bp, Homo sapiens
ttagagtgagggaat

SEQ ID NO: 23736 - DNA, 15 bp, Homo sapiens
cttagagtgagggaa

SEQ ID NO: 23737 - DNA, 15 bp, Homo sapiens
tcttagagtgaggga

SEQ ID NO: 23738 - DNA, 15 bp, Homo sapiens
gtcttagagtgaggg

SEQ ID NO: 23739 - DNA, 15 bp, Homo sapiens
ggtcttagagtgagg

SEQ ID NO: 23740 - DNA, 15 bp, Homo sapiens
aggtcttagagtgag

SEQ ID NO: 23741 - DNA, 15 bp, Homo sapiens
aaggtcttagagtga

SEQ ID NO: 23742 - DNA, 15 bp, Homo sapiens
caaggtcttagagtg

SEQ ID NO: 23743 - DNA, 15 bp, Homo sapiens
acaaggtcttagagt

SEQ ID NO: 23744 - DNA, 15 bp, Homo sapiens
gacaaggtcttagag

SEQ ID NO: 23745 - DNA, 15 bp, Homo sapiens
tgacaaggtcttaga

SEQ ID NO: 23746 - DNA, 15 bp, Homo sapiens
gtgacaaggtcttag

SEQ ID NO: 23747 - DNA, 15 bp, Homo sapiens
agtgacaaggtctta

SEQ ID NO: 23748 - DNA, 15 bp, Homo sapiens
tagtgacaaggtctt

SEQ ID NO: 23749 - DNA, 15 bp, Homo sapiens
ctagtgacaaggtct

SEQ ID NO: 23750 - DNA, 15 bp, Homo sapiens
tctagtgacaaggtc

SEQ ID NO: 23751 - DNA, 15 bp, Homo sapiens
atctagtgacaaggt

SEQ ID NO: 23752 - DNA, 15 bp, Homo sapiens
aatctagtgacaagg

SEQ ID NO: 23753 - DNA, 15 bp, Homo sapiens
caatctagtgacaag

SEQ ID NO: 23754 - DNA, 15 bp, Homo sapiens
ccaatctagtgacaa

SEQ ID NO: 23755 - DNA, 15 bp, Homo sapiens
tccaatctagtgaca

SEQ ID NO: 23756 - DNA, 15 bp, Homo sapiens
ttccaatctagtgac

SEQ ID NO: 23757 - DNA, 15 bp, Homo sapiens
gttccaatctagtga

SEQ ID NO: 23758 - DNA, 15 bp, Homo sapiens
tgttccaatctagtg

SEQ ID NO: 23759 - DNA, 15 bp, Homo sapiens
atgttccaatctagt

SEQ ID NO: 23760 - DNA, 15 bp, Homo sapiens
gatgttccaatctag

SEQ ID NO: 23761 - DNA, 15 bp, Homo sapiens
agatgttccaatcta

SEQ ID NO: 23762 - DNA, 15 bp, Homo sapiens
gagatgttccaatct

SEQ ID NO: 23763 - DNA, 15 bp, Homo sapiens
agagatgttccaatc

SEQ ID NO: 23764 - DNA, 15 bp, Homo sapiens
aagagatgttccaat

SEQ ID NO: 23765 - DNA, 15 bp, Homo sapiens
caagagatgttccaa

SEQ ID NO: 23766 - DNA, 15 bp, Homo sapiens
gcaagagatgttcca

SEQ ID NO: 23767 - DNA, 15 bp, Homo sapiens
ggcaagagatgttcc

SEQ ID NO: 23768 - DNA, 15 bp, Homo sapiens
aggcaagagatgttc

SEQ ID NO: 23769 - DNA, 15 bp, Homo sapiens
gaggcaagagatgtt

SEQ ID NO: 23770 - DNA, 15 bp, Homo sapiens
ggaggcaagagatgt

SEQ ID NO: 23771 - DNA, 15 bp, Homo sapiens
gggaggcaagagatg

SEQ ID NO: 23772 - DNA, 15 bp, Homo sapiens
agggaggcaagagat

SEQ ID NO: 23773 - DNA, 15 bp, Homo sapiens
tagggaggcaagaga

SEQ ID NO: 23774 - DNA, 15 bp, Homo sapiens
gtagggaggcaagag

SEQ ID NO: 23775 - DNA, 15 bp, Homo sapiens
tgtagggaggcaaga

SEQ ID NO: 23776 - DNA, 15 bp, Homo sapiens
gtgtagggaggcaag

SEQ ID NO: 23777 - DNA, 15 bp, Homo sapiens
ggtgtagggaggcaa

SEQ ID NO: 23778 - DNA, 15 bp, Homo sapiens
aggtgtagggaggca

SEQ ID NO: 23779 - DNA, 15 bp, Homo sapiens
caggtgtagggaggc

SEQ ID NO: 23780 - DNA, 15 bp, Homo sapiens
tcaggtgtagggagg

SEQ ID NO: 23781 - DNA, 15 bp, Homo sapiens
gtcaggtgtagggag

SEQ ID NO: 23782 - DNA, 15 bp, Homo sapiens
ggtcaggtgtaggga

SEQ ID NO: 23783 - DNA, 15 bp, Homo sapiens
aggtcaggtgtaggg

SEQ ID NO: 23784 - DNA, 15 bp, Homo sapiens
caggtcaggtgtagg

SEQ ID NO: 23785 - DNA, 15 bp, Homo sapiens
tcaggtcaggtgtag

SEQ ID NO: 23786 - DNA, 15 bp, Homo sapiens
atcaggtcaggtgta

SEQ ID NO: 23787 - DNA, 15 bp, Homo sapiens
catcaggtcaggtgt

SEQ ID NO: 23788 - DNA, 15 bp, Homo sapiens
ccatcaggtcaggtg

SEQ ID NO: 23789 - DNA, 15 bp, Homo sapiens
accatcaggtcaggt

SEQ ID NO: 23790 - DNA, 15 bp, Homo sapiens
aaccatcaggtcagg

SEQ ID NO: 23791 - DNA, 15 bp, Homo sapiens
gaaccatcaggtcag

SEQ ID NO: 23792 - DNA, 15 bp, Homo sapiens
agaaccatcaggtca

SEQ ID NO: 23793 - DNA, 15 bp, Homo sapiens
cagaaccatcaggtc

SEQ ID NO: 23794 - DNA, 15 bp, Homo sapiens
ccagaaccatcaggt

SEQ ID NO: 23795 - DNA, 15 bp, Homo sapiens
tccagaaccatcagg

SEQ ID NO: 23796 - DNA, 15 bp, Homo sapiens
ctccagaaccatcag

SEQ ID NO: 23797 - DNA, 15 bp, Homo sapiens
tctccagaaccatca

SEQ ID NO: 23798 - DNA, 15 bp, Homo sapiens
ctctccagaaccatc

SEQ ID NO: 23799 - DNA, 15 bp, Homo sapiens
tctctccagaaccat

SEQ ID NO: 23800 - DNA, 15 bp, Homo sapiens
atctctccagaacca

SEQ ID NO: 23801 - DNA, 15 bp, Homo sapiens
tatctctccagaacc

SEQ ID NO: 23802 - DNA, 15 bp, Homo sapiens
gtatctctccagaac

SEQ ID NO: 23803 - DNA, 15 bp, Homo sapiens
cgtatctctccagaa

SEQ ID NO: 23804 - DNA, 15 bp, Homo sapiens
acgtatctctccaga

SEQ ID NO: 23805 - DNA, 15 bp, Homo sapiens
gacgtatctctccag

SEQ ID NO: 23806 - DNA, 15 bp, Homo sapiens
ggacgtatctctcca

SEQ ID NO: 23807 - DNA, 15 bp, Homo sapiens
aggacgtatctctcc

SEQ ID NO: 23808 - DNA, 15 bp, Homo sapiens
aaggacgtatctctc

SEQ ID NO: 23809 - DNA, 15 bp, Homo sapiens
caaggacgtatctct

SEQ ID NO: 23810 - DNA, 15 bp, Homo sapiens
gcaaggacgtatctc

SEQ ID NO: 23811 - DNA, 15 bp, Homo sapiens
tgcaaggacgtatct

SEQ ID NO: 23812 - DNA, 15 bp, Homo sapiens
ctgcaaggacgtatc

SEQ ID NO: 23813 - DNA, 15 bp, Homo sapiens
gctgcaaggacgtat

SEQ ID NO: 23814 - DNA, 15 bp, Homo sapiens
agctgcaaggacgta

SEQ ID NO: 23815 - DNA, 15 bp, Homo sapiens
aagctgcaaggacgt

SEQ ID NO: 23816 - DNA, 15 bp, Homo sapiens
gaagctgcaaggacg

SEQ ID NO: 23817 - DNA, 15 bp, Homo sapiens
agaagctgcaaggac

SEQ ID NO: 23818 - DNA, 15 bp, Homo sapiens
cagaagctgcaagga

SEQ ID NO: 23819 - DNA, 15 bp, Homo sapiens
tcagaagctgcaagg

SEQ ID NO: 23820 - DNA, 15 bp, Homo sapiens
ctcagaagctgcaag

SEQ ID NO: 23821 - DNA, 15 bp, Homo sapiens
actcagaagctgcaa

SEQ ID NO: 23822 - DNA, 15 bp, Homo sapiens
gactcagaagctgca

SEQ ID NO: 23823 - DNA, 15 bp, Homo sapiens
ggactcagaagctgc

SEQ ID NO: 23824 - DNA, 15 bp, Homo sapiens
gggactcagaagctg

SEQ ID NO: 23825 - DNA, 15 bp, Homo sapiens
tgggactcagaagct

SEQ ID NO: 23826 - DNA, 15 bp, Homo sapiens
ctgggactcagaagc

SEQ ID NO: 23827 - DNA, 15 bp, Homo sapiens
gctgggactcagaag

SEQ ID NO: 23828 - DNA, 15 bp, Homo sapiens
tgctgggactcagaa

SEQ ID NO: 23829 - DNA, 15 bp, Homo sapiens
gtgctgggactcaga

SEQ ID NO: 23830 - DNA, 15 bp, Homo sapiens
agtgctgggactcag

SEQ ID NO: 23831 - DNA, 15 bp, Homo sapiens
tagtgctgggactca

SEQ ID NO: 23832 - DNA, 15 bp, Homo sapiens
ttagtgctgggactc

SEQ ID NO: 23833 - DNA, 15 bp, Homo sapiens
cttagtgctgggact

SEQ ID NO: 23834 - DNA, 15 bp, Homo sapiens
gcttagtgctgggac

SEQ ID NO: 23835 - DNA, 15 bp, Homo sapiens
tgcttagtgctggga

SEQ ID NO: 23836 - DNA, 15 bp, Homo sapiens
ctgcttagtgctggg

SEQ ID NO: 23837 - DNA, 15 bp, Homo sapiens
gctgcttagtgctgg

SEQ ID NO: 23838 - DNA, 15 bp, Homo sapiens
ggctgcttagtgctg

SEQ ID NO: 23839 - DNA, 15 bp, Homo sapiens
aggctgcttagtgct

SEQ ID NO: 23840 - DNA, 15 bp, Homo sapiens
aaggctgcttagtgc

SEQ ID NO: 23841 - DNA, 15 bp, Homo sapiens
aaaggctgcttagtg

SEQ ID NO: 23842 - DNA, 15 bp, Homo sapiens
caaaggctgcttagt

SEQ ID NO: 23843 - DNA, 15 bp, Homo sapiens
ccaaaggctgcttag

SEQ ID NO: 23844 - DNA, 15 bp, Homo sapiens
accaaaggctgctta

SEQ ID NO: 23845 - DNA, 15 bp, Homo sapiens
taccaaaggctgctt

SEQ ID NO: 23846 - DNA, 15 bp, Homo sapiens
ttaccaaaggctgct

SEQ ID NO: 23847 - DNA, 15 bp, Homo sapiens
gttaccaaaggctgc

SEQ ID NO: 23848 - DNA, 15 bp, Homo sapiens
agttaccaaaggctg

SEQ ID NO: 23849 - DNA, 15 bp, Homo sapiens
aagttaccaaaggct

SEQ ID NO: 23850 - DNA, 15 bp, Homo sapiens
gaagttaccaaaggc

SEQ ID NO: 23851 - DNA, 15 bp, Homo sapiens
ggaagttaccaaagg

SEQ ID NO: 23852 - DNA, 15 bp, Homo sapiens
gggaagttaccaaag

SEQ ID NO: 23853 - DNA, 15 bp, Homo sapiens
agggaagttaccaaa

SEQ ID NO: 23854 - DNA, 15 bp, Homo sapiens
tagggaagttaccaa

SEQ ID NO: 23855 - DNA, 15 bp, Homo sapiens
gtagggaagttacca

SEQ ID NO: 23856 - DNA, 15 bp, Homo sapiens
tgtagggaagttacc

SEQ ID NO: 23857 - DNA, 15 bp, Homo sapiens
atgtagggaagttac

SEQ ID NO: 23858 - DNA, 15 bp, Homo sapiens
gatgtagggaagtta

SEQ ID NO: 23859 - DNA, 15 bp, Homo sapiens
tgatgtagggaagtt

SEQ ID NO: 23860 - DNA, 15 bp, Homo sapiens
atgatgtagggaagt

SEQ ID NO: 23861 - DNA, 15 bp, Homo sapiens
aatgatgtagggaag

SEQ ID NO: 23862 - DNA, 15 bp, Homo sapiens
aaatgatgtagggaa

SEQ ID NO: 23863 - DNA, 15 bp, Homo sapiens
caaatgatgtaggga

SEQ ID NO: 23864 - DNA, 15 bp, Homo sapiens
tcaaatgatgtaggg

SEQ ID NO: 23865 - DNA, 15 bp, Homo sapiens
ctcaaatgatgtagg

SEQ ID NO: 23866 - DNA, 15 bp, Homo sapiens
actcaaatgatgtag

SEQ ID NO: 23867 - DNA, 15 bp, Homo sapiens
aactcaaatgatgta

SEQ ID NO: 23868 - DNA, 15 bp, Homo sapiens
gaactcaaatgatgt

SEQ ID NO: 23869 - DNA, 15 bp, Homo sapiens
agaactcaaatgatg

SEQ ID NO: 23870 - DNA, 15 bp, Homo sapiens
cagaactcaaatgat

SEQ ID NO: 23871 - DNA, 15 bp, Homo sapiens
ccagaactcaaatga

SEQ ID NO: 23872 - DNA, 15 bp, Homo sapiens
accagaactcaaatg

SEQ ID NO: 23873 - DNA, 15 bp, Homo sapiens
aaccagaactcaaat

SEQ ID NO: 23874 - DNA, 15 bp, Homo sapiens
aaaccagaactcaaa

SEQ ID NO: 23875 - DNA, 15 bp, Homo sapiens
gaaaccagaactcaa

SEQ ID NO: 23876 - DNA, 15 bp, Homo sapiens
ggaaaccagaactca

SEQ ID NO: 23877 - DNA, 15 bp, Homo sapiens
aggaaaccagaactc

SEQ ID NO: 23878 - DNA, 15 bp, Homo sapiens
taggaaaccagaact

SEQ ID NO: 23879 - DNA, 15 bp, Homo sapiens
ttaggaaaccagaac

SEQ ID NO: 23880 - DNA, 15 bp, Homo sapiens
cttaggaaaccagaa

SEQ ID NO: 23881 - DNA, 15 bp, Homo sapiens
ccttaggaaaccaga

SEQ ID NO: 23882 - DNA, 15 bp, Homo sapiens
tccttaggaaaccag

SEQ ID NO: 23883 - DNA, 15 bp, Homo sapiens
atccttaggaaacca

SEQ ID NO: 23884 - DNA, 15 bp, Homo sapiens
catccttaggaaacc

SEQ ID NO: 23885 - DNA, 15 bp, Homo sapiens
gcatccttaggaaac

SEQ ID NO: 23886 - DNA, 15 bp, Homo sapiens
agcatccttaggaaa

SEQ ID NO: 23887 - DNA, 15 bp, Homo sapiens
aagcatccttaggaa

SEQ ID NO: 23888 - DNA, 15 bp, Homo sapiens
caagcatccttagga

SEQ ID NO: 23889 - DNA, 15 bp, Homo sapiens
gcaagcatccttagg

SEQ ID NO: 23890 - DNA, 15 bp, Homo sapiens
ggcaagcatccttag

SEQ ID NO: 23891 - DNA, 15 bp, Homo sapiens
tggcaagcatcctta

SEQ ID NO: 23892 - DNA, 15 bp, Homo sapiens
ctggcaagcatcctt

SEQ ID NO: 23893 - DNA, 15 bp, Homo sapiens
actggcaagcatcct

SEQ ID NO: 23894 - DNA, 15 bp, Homo sapiens
cactggcaagcatcc

SEQ ID NO: 23895 - DNA, 15 bp, Homo sapiens
tcactggcaagcatc

SEQ ID NO: 23896 - DNA, 15 bp, Homo sapiens
ctcactggcaagcat

SEQ ID NO: 23897 - DNA, 15 bp, Homo sapiens
actcactggcaagca

SEQ ID NO: 23898 - DNA, 15 bp, Homo sapiens
cactcactggcaagc

SEQ ID NO: 23899 - DNA, 15 bp, Homo sapiens
gcactcactggcaag

SEQ ID NO: 23900 - DNA, 15 bp, Homo sapiens
ggcactcactggcaa

SEQ ID NO: 23901 - DNA, 15 bp, Homo sapiens
tggcactcactggca

SEQ ID NO: 23902 - DNA, 15 bp, Homo sapiens
atggcactcactggc

SEQ ID NO: 23903 - DNA, 15 bp, Homo sapiens
catggcactcactgg

SEQ ID NO: 23904 - DNA, 15 bp, Homo sapiens
ccatggcactcactg

SEQ ID NO: 23905 - DNA, 15 bp, Homo sapiens
accatggcactcact

SEQ ID NO: 23906 - DNA, 15 bp, Homo sapiens
caccatggcactcac

SEQ ID NO: 23907 - DNA, 15 bp, Homo sapiens
gcaccatggcactca

SEQ ID NO: 23908 - DNA, 15 bp, Homo sapiens
ggcaccatggcactc

SEQ ID NO: 23909 - DNA, 15 bp, Homo sapiens
gggcaccatggcact

SEQ ID NO: 23910 - DNA, 15 bp, Homo sapiens
agggcaccatggcac

SEQ ID NO: 23911 - DNA, 15 bp, Homo sapiens
gagggcaccatggca

SEQ ID NO: 23912 - DNA, 15 bp, Homo sapiens
tgagggcaccatggc

SEQ ID NO: 23913 - DNA, 15 bp, Homo sapiens
atgagggcaccatgg

SEQ ID NO: 23914 - DNA, 15 bp, Homo sapiens
aatgagggcaccatg

SEQ ID NO: 23915 - DNA, 15 bp, Homo sapiens
caatgagggcaccat

SEQ ID NO: 23916 - DNA, 15 bp, Homo sapiens
gcaatgagggcacca

SEQ ID NO: 23917 - DNA, 15 bp, Homo sapiens
tgcaatgagggcacc

SEQ ID NO: 23918 - DNA, 15 bp, Homo sapiens
gtgcaatgagggcac

SEQ ID NO: 23919 - DNA, 15 bp, Homo sapiens
tgtgcaatgagggca

SEQ ID NO: 23920 - DNA, 15 bp, Homo sapiens
ctgtgcaatgagggc

SEQ ID NO: 23921 - DNA, 15 bp, Homo sapiens
actgtgcaatgaggg

SEQ ID NO: 23922 - DNA, 15 bp, Homo sapiens
gactgtgcaatgagg

SEQ ID NO: 23923 - DNA, 15 bp, Homo sapiens
agactgtgcaatgag

SEQ ID NO: 23924 - DNA, 15 bp, Homo sapiens
cagactgtgcaatga

SEQ ID NO: 23925 - DNA, 15 bp, Homo sapiens
acagactgtgcaatg

SEQ ID NO: 23926 - DNA, 15 bp, Homo sapiens
cacagactgtgcaat

SEQ ID NO: 23927 - DNA, 15 bp, Homo sapiens
gcacagactgtgcaa

SEQ ID NO: 23928 - DNA, 15 bp, Homo sapiens
tgcacagactgtgca

SEQ ID NO: 23929 - DNA, 15 bp, Homo sapiens
ctgcacagactgtgc

SEQ ID NO: 23930 - DNA, 15 bp, Homo sapiens
actgcacagactgtg

SEQ ID NO: 23931 - DNA, 15 bp, Homo sapiens
cactgcacagactgt

SEQ ID NO: 23932 - DNA, 15 bp, Homo sapiens
acactgcacagactg

SEQ ID NO: 23933 - DNA, 15 bp, Homo sapiens
tacactgcacagact

SEQ ID NO: 23934 - DNA, 15 bp, Homo sapiens
ctacactgcacagac

SEQ ID NO: 23935 - DNA, 15 bp, Homo sapiens
tctacactgcacaga

SEQ ID NO: 23936 - DNA, 15 bp, Homo sapiens
gtctacactgcacag

SEQ ID NO: 23937 - DNA, 15 bp, Homo sapiens
tgtctacactgcaca

SEQ ID NO: 23938 - DNA, 15 bp, Homo sapiens
ttgtctacactgcac

SEQ ID NO: 23939 - DNA, 15 bp, Homo sapiens
cttgtctacactgca

SEQ ID NO: 23940 - DNA, 15 bp, Homo sapiens
tcttgtctacactgc

SEQ ID NO: 23941 - DNA, 15 bp, Homo sapiens
ctcttgtctacactg

SEQ ID NO: 23942 - DNA, 15 bp, Homo sapiens
cctcttgtctacact

SEQ ID NO: 23943 - DNA, 15 bp, Homo sapiens
ccctcttgtctacac

SEQ ID NO: 23944 - DNA, 15 bp, Homo sapiens
cccctcttgtctaca

SEQ ID NO: 23945 - DNA, 15 bp, Homo sapiens
tcccctcttgtctac

SEQ ID NO: 23946 - DNA, 15 bp, Homo sapiens
ttcccctcttgtcta

SEQ ID NO: 23947 - DNA, 15 bp, Homo sapiens
cttcccctcttgtct

SEQ ID NO: 23948 - DNA, 15 bp, Homo sapiens
acttcccctcttgtc

SEQ ID NO: 23949 - DNA, 15 bp, Homo sapiens
gacttcccctcttgt

SEQ ID NO: 23950 - DNA, 15 bp, Homo sapiens
agacttcccctcttg

SEQ ID NO: 23951 - DNA, 15 bp, Homo sapiens
gagacttcccctctt

SEQ ID NO: 23952 - DNA, 15 bp, Homo sapiens
agagacttcccctct

SEQ ID NO: 23953 - DNA, 15 bp, Homo sapiens
aagagacttcccctc

SEQ ID NO: 23954 - DNA, 15 bp, Homo sapiens
caagagacttcccct

SEQ ID NO: 23955 - DNA, 15 bp, Homo sapiens
ccaagagacttcccc

SEQ ID NO: 23956 - DNA, 15 bp, Homo sapiens
cccaagagacttccc

SEQ ID NO: 23957 - DNA, 15 bp, Homo sapiens
ccccaagagacttcc

SEQ ID NO: 23958 - DNA, 15 bp, Homo sapiens
accccaagagacttc

SEQ ID NO: 23959 - DNA, 15 bp, Homo sapiens
taccccaagagactt

SEQ ID NO: 23960 - DNA, 15 bp, Homo sapiens
ctaccccaagagact

SEQ ID NO: 23961 - DNA, 15 bp, Homo sapiens
tctaccccaagagac

SEQ ID NO: 23962 - DNA, 15 bp, Homo sapiens
gtctaccccaagaga

SEQ ID NO: 23963 - DNA, 15 bp, Homo sapiens
ggtctaccccaagag

SEQ ID NO: 23964 - DNA, 15 bp, Homo sapiens
tggtctaccccaaga

SEQ ID NO: 23965 - DNA, 15 bp, Homo sapiens
ctggtctaccccaag

SEQ ID NO: 23966 - DNA, 15 bp, Homo sapiens
gctggtctaccccaa

SEQ ID NO: 23967 - DNA, 15 bp, Homo sapiens
ggctggtctacccca

SEQ ID NO: 23968 - DNA, 15 bp, Homo sapiens
cggctggtctacccc

SEQ ID NO: 23969 - DNA, 15 bp, Homo sapiens
gcggctggtctaccc

SEQ ID NO: 23970 - DNA, 15 bp, Homo sapiens
tgcggctggtctacc

SEQ ID NO: 23971 - DNA, 15 bp, Homo sapiens
ttgcggctggtctac

SEQ ID NO: 23972 - DNA, 15 bp, Homo sapiens
cttgcggctggtcta

SEQ ID NO: 23973 - DNA, 15 bp, Homo sapiens
ccttgcggctggtct

SEQ ID NO: 23974 - DNA, 15 bp, Homo sapiens
gccttgcggctggtc

SEQ ID NO: 23975 - DNA, 15 bp, Homo sapiens
cgccttgcggctggt

SEQ ID NO: 23976 - DNA, 15 bp, Homo sapiens
ccgccttgcggctgg

SEQ ID NO: 23977 - DNA, 15 bp, Homo sapiens
accgccttgcggctg

SEQ ID NO: 23978 - DNA, 15 bp, Homo sapiens
caccgccttgcggct

SEQ ID NO: 23979 - DNA, 15 bp, Homo sapiens
tcaccgccttgcggc

SEQ ID NO: 23980 - DNA, 15 bp, Homo sapiens
gtcaccgccttgcgg

SEQ ID NO: 23981 - DNA, 15 bp, Homo sapiens
agtcaccgccttgcg

SEQ ID NO: 23982 - DNA, 15 bp, Homo sapiens
tagtcaccgccttgc

SEQ ID NO: 23983 - DNA, 15 bp, Homo sapiens
ctagtcaccgccttg

SEQ ID NO: 23984 - DNA, 15 bp, Homo sapiens
gctagtcaccgcctt

SEQ ID NO: 23985 - DNA, 15 bp, Homo sapiens
tgctagtcaccgcct

SEQ ID NO: 23986 - DNA, 15 bp, Homo sapiens
gtgctagtcaccgcc

SEQ ID NO: 23987 - DNA, 15 bp, Homo sapiens
agtgctagtcaccgc

SEQ ID NO: 23988 - DNA, 15 bp, Homo sapiens
cagtgctagtcaccg

SEQ ID NO: 23989 - DNA, 15 bp, Homo sapiens
tcagtgctagtcacc

SEQ ID NO: 23990 - DNA, 15 bp, Homo sapiens
atcagtgctagtcac

SEQ ID NO: 23991 - DNA, 15 bp, Homo sapiens
catcagtgctagtca

SEQ ID NO: 23992 - DNA, 15 bp, Homo sapiens
acatcagtgctagtc

SEQ ID NO: 23993 - DNA, 15 bp, Homo sapiens
cacatcagtgctagt

SEQ ID NO: 23994 - DNA, 15 bp, Homo sapiens
tcacatcagtgctag

SEQ ID NO: 23995 - DNA, 15 bp, Homo sapiens
ttcacatcagtgcta

SEQ ID NO: 23996 - DNA, 15 bp, Homo sapiens
gttcacatcagtgct

SEQ ID NO: 23997 - DNA, 15 bp, Homo sapiens
ggttcacatcagtgc

SEQ ID NO: 23998 - DNA, 15 bp, Homo sapiens
tggttcacatcagtg

SEQ ID NO: 23999 - DNA, 15 bp, Homo sapiens
gtggttcacatcagt

SEQ ID NO: 24000 - DNA, 15 bp, Homo sapiens
tgtggttcacatcag

SEQ ID NO: 24001 - DNA, 15 bp, Homo sapiens
atgtggttcacatca

SEQ ID NO: 24002 - DNA, 15 bp, Homo sapiens
catgtggttcacatc

SEQ ID NO: 24003 - DNA, 15 bp, Homo sapiens
ccatgtggttcacat

SEQ ID NO: 24004 - DNA, 15 bp, Homo sapiens
cccatgtggttcaca

SEQ ID NO: 24005 - DNA, 15 bp, Homo sapiens
tcccatgtggttcac

SEQ ID NO: 24006 - DNA, 15 bp, Homo sapiens
gtcccatgtggttca

SEQ ID NO: 24007 - DNA, 15 bp, Homo sapiens
tgtcccatgtggttc

SEQ ID NO: 24008 - DNA, 15 bp, Homo sapiens
ctgtcccatgtggtt

SEQ ID NO: 24009 - DNA, 15 bp, Homo sapiens
cctgtcccatgtggt

SEQ ID NO: 24010 - DNA, 15 bp, Homo sapiens
ccctgtcccatgtgg

SEQ ID NO: 24011 - DNA, 15 bp, Homo sapiens
cccctgtcccatgtg

SEQ ID NO: 24012 - DNA, 15 bp, Homo sapiens
tcccctgtcccatgt

SEQ ID NO: 24013 - DNA, 15 bp, Homo sapiens
ctcccctgtcccatg

SEQ ID NO: 24014 - DNA, 15 bp, Homo sapiens
actcccctgtcccat

SEQ ID NO: 24015 - DNA, 15 bp, Homo sapiens
aactcccctgtccca

SEQ ID NO: 24016 - DNA, 15 bp, Homo sapiens
caactcccctgtccc

SEQ ID NO: 24017 - DNA, 15 bp, Homo sapiens
acaactcccctgtcc

SEQ ID NO: 24018 - DNA, 15 bp, Homo sapiens
cacaactcccctgtc

SEQ ID NO: 24019 - DNA, 15 bp, Homo sapiens
ccacaactcccctgt

SEQ ID NO: 24020 - DNA, 15 bp, Homo sapiens
cccacaactcccctg

SEQ ID NO: 24021 - DNA, 15 bp, Homo sapiens
ccccacaactcccct

SEQ ID NO: 24022 - DNA, 15 bp, Homo sapiens
gccccacaactcccc

SEQ ID NO: 24023 - DNA, 15 bp, Homo sapiens
agccccacaactccc

SEQ ID NO: 24024 - DNA, 15 bp, Homo sapiens
cagccccacaactcc

SEQ ID NO: 24025 - DNA, 15 bp, Homo sapiens
tcagccccacaactc

SEQ ID NO: 24026 - DNA, 15 bp, Homo sapiens
ctcagccccacaact

SEQ ID NO: 24027 - DNA, 15 bp, Homo sapiens
tctcagccccacaac

SEQ ID NO: 24028 - DNA, 15 bp, Homo sapiens
ttctcagccccacaa

SEQ ID NO: 24029 - DNA, 15 bp, Homo sapiens
gttctcagccccaca

SEQ ID NO: 24030 - DNA, 15 bp, Homo sapiens
tgttctcagccccac

SEQ ID NO: 24031 - DNA, 15 bp, Homo sapiens
gtgttctcagcccca

SEQ ID NO: 24032 - DNA, 15 bp, Homo sapiens
cgtgttctcagcccc

SEQ ID NO: 24033 - DNA, 15 bp, Homo sapiens
ccgtgttctcagccc

SEQ ID NO: 24034 - DNA, 15 bp, Homo sapiens
tccgtgttctcagcc

SEQ ID NO: 24035 - DNA, 15 bp, Homo sapiens
ctccgtgttctcagc

SEQ ID NO: 24036 - DNA, 15 bp, Homo sapiens
cctccgtgttctcag

SEQ ID NO: 24037 - DNA, 15 bp, Homo sapiens
ccctccgtgttctca

SEQ ID NO: 24038 - DNA, 15 bp, Homo sapiens
accctccgtgttctc

SEQ ID NO: 24039 - DNA, 15 bp, Homo sapiens
caccctccgtgttct

SEQ ID NO: 24040 - DNA, 15 bp, Homo sapiens
ccaccctccgtgttc

SEQ ID NO: 24041 - DNA, 15 bp, Homo sapiens
cccaccctccgtgtt

SEQ ID NO: 24042 - DNA, 15 bp, Homo sapiens
tcccaccctccgtgt

SEQ ID NO: 24043 - DNA, 15 bp, Homo sapiens
ctcccaccctccgtg

SEQ ID NO: 24044 - DNA, 15 bp, Homo sapiens
actcccaccctccgt

SEQ ID NO: 24045 - DNA, 15 bp, Homo sapiens
tactcccaccctccg

SEQ ID NO: 24046 - DNA, 15 bp, Homo sapiens
ctactcccaccctcc

SEQ ID NO: 24047 - DNA, 15 bp, Homo sapiens
actactcccaccctc

SEQ ID NO: 24048 - DNA, 15 bp, Homo sapiens
gactactcccaccct

SEQ ID NO: 24049 - DNA, 15 bp, Homo sapiens
tgactactcccaccc

SEQ ID NO: 24050 - DNA, 15 bp, Homo sapiens
atgactactcccacc

SEQ ID NO: 24051 - DNA, 15 bp, Homo sapiens
catgactactcccac

SEQ ID NO: 24052 - DNA, 15 bp, Homo sapiens
gcatgactactccca

SEQ ID NO: 24053 - DNA, 15 bp, Homo sapiens
agcatgactactccc

SEQ ID NO: 24054 - DNA, 15 bp, Homo sapiens
gagcatgactactcc

SEQ ID NO: 24055 - DNA, 15 bp, Homo sapiens
agagcatgactactc

SEQ ID NO: 24056 - DNA, 15 bp, Homo sapiens
aagagcatgactact

SEQ ID NO: 24057 - DNA, 15 bp, Homo sapiens
aaagagcatgactac

SEQ ID NO: 24058 - DNA, 15 bp, Homo sapiens
aaaagagcatgacta

SEQ ID NO: 24059 - DNA, 15 bp, Homo sapiens
gaaaagagcatgact

SEQ ID NO: 24060 - DNA, 15 bp, Homo sapiens
ggaaaagagcatgac

SEQ ID NO: 24061 - DNA, 15 bp, Homo sapiens
tggaaaagagcatga

SEQ ID NO: 24062 - DNA, 15 bp, Homo sapiens
ctggaaaagagcatg

SEQ ID NO: 24063 - DNA, 15 bp, Homo sapiens
tctggaaaagagcat

SEQ ID NO: 24064 - DNA, 15 bp, Homo sapiens
ttctggaaaagagca

SEQ ID NO: 24065 - DNA, 15 bp, Homo sapiens
attctggaaaagagc

SEQ ID NO: 24066 - DNA, 15 bp, Homo sapiens
cattctggaaaagag

SEQ ID NO: 24067 - DNA, 15 bp, Homo sapiens
tcattctggaaaaga

SEQ ID NO: 24068 - DNA, 15 bp, Homo sapiens
ttcattctggaaaag

SEQ ID NO: 24069 - DNA, 15 bp, Homo sapiens
gttcattctggaaaa

SEQ ID NO: 24070 - DNA, 15 bp, Homo sapiens
agttcattctggaaa

SEQ ID NO: 24071 - DNA, 15 bp, Homo sapiens
cagttcattctggaa

SEQ ID NO: 24072 - DNA, 15 bp, Homo sapiens
gcagttcattctgga

SEQ ID NO: 24073 - DNA, 15 bp, Homo sapiens
agcagttcattctgg

SEQ ID NO: 24074 - DNA, 15 bp, Homo sapiens
tagcagttcattctg

SEQ ID NO: 24075 - DNA, 15 bp, Homo sapiens
ttagcagttcattct

SEQ ID NO: 24076 - DNA, 15 bp, Homo sapiens
gttagcagttcattc

SEQ ID NO: 24077 - DNA, 15 bp, Homo sapiens
cgttagcagttcatt

SEQ ID NO: 24078 - DNA, 15 bp, Homo sapiens
tcgttagcagttcat

SEQ ID NO: 24079 - DNA, 15 bp, Homo sapiens
ttcgttagcagttca

SEQ ID NO: 24080 - DNA, 15 bp, Homo sapiens
cttcgttagcagttc

SEQ ID NO: 24081 - DNA, 15 bp, Homo sapiens
ccttcgttagcagtt

SEQ ID NO: 24082 - DNA, 15 bp, Homo sapiens
cccttcgttagcagt

SEQ ID NO: 24083 - DNA, 15 bp, Homo sapiens
tcccttcgttagcag

SEQ ID NO: 24084 - DNA, 15 bp, Homo sapiens
gtcccttcgttagca

SEQ ID NO: 24085 - DNA, 15 bp, Homo sapiens
agtcccttcgttagc

SEQ ID NO: 24086 - DNA, 15 bp, Homo sapiens
gagtcccttcgttag

SEQ ID NO: 24087 - DNA, 15 bp, Homo sapiens
cgagtcccttcgtta

SEQ ID NO: 24088 - DNA, 15 bp, Homo sapiens
gcgagtcccttcgtt

SEQ ID NO: 24089 - DNA, 15 bp, Homo sapiens
tgcgagtcccttcgt

SEQ ID NO: 24090 - DNA, 15 bp, Homo sapiens
ctgcgagtcccttcg

SEQ ID NO: 24091 - DNA, 15 bp, Homo sapiens
cctgcgagtcccttc

SEQ ID NO: 24092 - DNA, 15 bp, Homo sapiens
acctgcgagtccctt

SEQ ID NO: 24093 - DNA, 15 bp, Homo sapiens
cacctgcgagtccct

SEQ ID NO: 24094 - DNA, 15 bp, Homo sapiens
ccacctgcgagtccc

SEQ ID NO: 24095 - DNA, 15 bp, Homo sapiens
gccacctgcgagtcc

SEQ ID NO: 24096 - DNA, 15 bp, Homo sapiens
agccacctgcgagtc

SEQ ID NO: 24097 - DNA, 15 bp, Homo sapiens
cagccacctgcgagt

SEQ ID NO: 24098 - DNA, 15 bp, Homo sapiens
gcagccacctgcgag

SEQ ID NO: 24099 - DNA, 15 bp, Homo sapiens
agcagccacctgcga

SEQ ID NO: 24100 - DNA, 15 bp, Homo sapiens
cagcagccacctgcg

SEQ ID NO: 24101 - DNA, 15 bp, Homo sapiens
gcagcagccacctgc

SEQ ID NO: 24102 - DNA, 15 bp, Homo sapiens
agcagcagccacctg

SEQ ID NO: 24103 - DNA, 15 bp, Homo sapiens
aagcagcagccacct

SEQ ID NO: 24104 - DNA, 15 bp, Homo sapiens
gaagcagcagccacc

SEQ ID NO: 24105 - DNA, 15 bp, Homo sapiens
agaagcagcagccac

SEQ ID NO: 24106 - DNA, 15 bp, Homo sapiens
aagaagcagcagcca

SEQ ID NO: 24107 - DNA, 15 bp, Homo sapiens
aaagaagcagcagcc

SEQ ID NO: 24108 - DNA, 15 bp, Homo sapiens
gaaagaagcagcagc

SEQ ID NO: 24109 - DNA, 15 bp, Homo sapiens
ggaaagaagcagcag

SEQ ID NO: 24110 - DNA, 15 bp, Homo sapiens
tggaaagaagcagca

SEQ ID NO: 24111 - DNA, 15 bp, Homo sapiens
ttggaaagaagcagc

SEQ ID NO: 24112 - DNA, 15 bp, Homo sapiens
cttggaaagaagcag

SEQ ID NO: 24113 - DNA, 15 bp, Homo sapiens
gcttggaaagaagca

SEQ ID NO: 24114 - DNA, 15 bp, Homo sapiens
agcttggaaagaagc

SEQ ID NO: 24115 - DNA, 15 bp, Homo sapiens
cagcttggaaagaag

SEQ ID NO: 24116 - DNA, 15 bp, Homo sapiens
gcagcttggaaagaa

SEQ ID NO: 24117 - DNA, 15 bp, Homo sapiens
ggcagcttggaaaga

SEQ ID NO: 24118 - DNA, 15 bp, Homo sapiens
gggcagcttggaaag

SEQ ID NO: 24119 - DNA, 15 bp, Homo sapiens
ggggcagcttggaaa

SEQ ID NO: 24120 - DNA, 15 bp, Homo sapiens
aggggcagcttggaa

SEQ ID NO: 24121 - DNA, 15 bp, Homo sapiens
caggggcagcttgga

SEQ ID NO: 24122 - DNA, 15 bp, Homo sapiens
acaggggcagcttgg

SEQ ID NO: 24123 - DNA, 15 bp, Homo sapiens
aacaggggcagcttg

SEQ ID NO: 24124 - DNA, 15 bp, Homo sapiens
caacaggggcagctt

SEQ ID NO: 24125 - DNA, 15 bp, Homo sapiens
acaacaggggcagct

SEQ ID NO: 24126 - DNA, 15 bp, Homo sapiens
aacaacaggggcagc

SEQ ID NO: 24127 - DNA, 15 bp, Homo sapiens
caacaacaggggcag

SEQ ID NO: 24128 - DNA, 15 bp, Homo sapiens
gcaacaacaggggca

SEQ ID NO: 24129 - DNA, 15 bp, Homo sapiens
tgcaacaacaggggc

SEQ ID NO: 24130 - DNA, 15 bp, Homo sapiens
ctgcaacaacagggg

SEQ ID NO: 24131 - DNA, 15 bp, Homo sapiens
tctgcaacaacaggg

SEQ ID NO: 24132 - DNA, 15 bp, Homo sapiens
ctctgcaacaacagg

SEQ ID NO: 24133 - DNA, 15 bp, Homo sapiens
cctctgcaacaacag

SEQ ID NO: 24134 - DNA, 15 bp, Homo sapiens
gcctctgcaacaaca

SEQ ID NO: 24135 - DNA, 15 bp, Homo sapiens
agcctctgcaacaac

SEQ ID NO: 24136 - DNA, 15 bp, Homo sapiens
gagcctctgcaacaa

SEQ ID NO: 24137 - DNA, 15 bp, Homo sapiens
agagcctctgcaaca

SEQ ID NO: 24138 - DNA, 15 bp, Homo sapiens
cagagcctctgcaac

SEQ ID NO: 24139 - DNA, 15 bp, Homo sapiens
ccagagcctctgcaa

SEQ ID NO: 24140 - DNA, 15 bp, Homo sapiens
tccagagcctctgca

SEQ ID NO: 24141 - DNA, 15 bp, Homo sapiens
ctccagagcctctgc

SEQ ID NO: 24142 - DNA, 15 bp, Homo sapiens
actccagagcctctg

SEQ ID NO: 24143 - DNA, 15 bp, Homo sapiens
gactccagagcctct

SEQ ID NO: 24144 - DNA, 15 bp, Homo sapiens
ggactccagagcctc

SEQ ID NO: 24145 - DNA, 15 bp, Homo sapiens
aggactccagagcct

SEQ ID NO: 24146 - DNA, 15 bp, Homo sapiens
taggactccagagcc

SEQ ID NO: 24147 - DNA, 15 bp, Homo sapiens
ctaggactccagagc

SEQ ID NO: 24148 - DNA, 15 bp, Homo sapiens
cctaggactccagag

SEQ ID NO: 24149 - DNA, 15 bp, Homo sapiens
tcctaggactccaga

SEQ ID NO: 24150 - DNA, 15 bp, Homo sapiens
ctcctaggactccag

SEQ ID NO: 24151 - DNA, 15 bp, Homo sapiens
cctcctaggactcca

SEQ ID NO: 24152 - DNA, 15 bp, Homo sapiens
acctcctaggactcc

SEQ ID NO: 24153 - DNA, 15 bp, Homo sapiens
aacctcctaggactc

SEQ ID NO: 24154 - DNA, 15 bp, Homo sapiens
aaacctcctaggact

SEQ ID NO: 24155 - DNA, 15 bp, Homo sapiens
gaaacctcctaggac

SEQ ID NO: 24156 - DNA, 15 bp, Homo sapiens
tgaaacctcctagga

SEQ ID NO: 24157 - DNA, 15 bp, Homo sapiens
gtgaaacctcctagg

SEQ ID NO: 24158 - DNA, 15 bp, Homo sapiens
cgtgaaacctcctag

SEQ ID NO: 24159 - DNA, 15 bp, Homo sapiens
ccgtgaaacctccta

SEQ ID NO: 24160 - DNA, 15 bp, Homo sapiens
accgtgaaacctcct

SEQ ID NO: 24161 - DNA, 15 bp, Homo sapiens
caccgtgaaacctcc

SEQ ID NO: 24162 - DNA, 15 bp, Homo sapiens
ccaccgtgaaacctc

SEQ ID NO: 24163 - DNA, 15 bp, Homo sapiens
gccaccgtgaaacct

SEQ ID NO: 24164 - DNA, 15 bp, Homo sapiens
tgccaccgtgaaacc

SEQ ID NO: 24165 - DNA, 15 bp, Homo sapiens
atgccaccgtgaaac

SEQ ID NO: 24166 - DNA, 15 bp, Homo sapiens
tatgccaccgtgaaa

SEQ ID NO: 24167 - DNA, 15 bp, Homo sapiens
gtatgccaccgtgaa

SEQ ID NO: 24168 - DNA, 15 bp, Homo sapiens
agtatgccaccgtga

SEQ ID NO: 24169 - DNA, 15 bp, Homo sapiens
gagtatgccaccgtg

SEQ ID NO: 24170 - DNA, 15 bp, Homo sapiens
cgagtatgccaccgt

SEQ ID NO: 24171 - DNA, 15 bp, Homo sapiens
tcgagtatgccaccg

SEQ ID NO: 24172 - DNA, 15 bp, Homo sapiens
gtcgagtatgccacc

SEQ ID NO: 24173 - DNA, 15 bp, Homo sapiens
tgtcgagtatgccac

SEQ ID NO: 24174 - DNA, 15 bp, Homo sapiens
ctgtcgagtatgcca

SEQ ID NO: 24175 - DNA, 15 bp, Homo sapiens
tctgtcgagtatgcc

SEQ ID NO: 24176 - DNA, 15 bp, Homo sapiens
ctctgtcgagtatgc

SEQ ID NO: 24177 - DNA, 15 bp, Homo sapiens
actctgtcgagtatg

SEQ ID NO: 24178 - DNA, 15 bp, Homo sapiens
tactctgtcgagtat

SEQ ID NO: 24179 - DNA, 15 bp, Homo sapiens
gtactctgtcgagta

SEQ ID NO: 24180 - DNA, 15 bp, Homo sapiens
agtactctgtcgagt

SEQ ID NO: 24181 - DNA, 15 bp, Homo sapiens
tagtactctgtcgag

SEQ ID NO: 24182 - DNA, 15 bp, Homo sapiens
ctagtactctgtcga

SEQ ID NO: 24183 - DNA, 15 bp, Homo sapiens
tctagtactctgtcg

SEQ ID NO: 24184 - DNA, 15 bp, Homo sapiens
ctctagtactctgtc

SEQ ID NO: 24185 - DNA, 15 bp, Homo sapiens
gctctagtactctgt

SEQ ID NO: 24186 - DNA, 15 bp, Homo sapiens
tgctctagtactctg

SEQ ID NO: 24187 - DNA, 15 bp, Homo sapiens
atgctctagtactct

SEQ ID NO: 24188 - DNA, 15 bp, Homo sapiens
gatgctctagtactc

SEQ ID NO: 24189 - DNA, 15 bp, Homo sapiens
tgatgctctagtact

SEQ ID NO: 24190 - DNA, 15 bp, Homo sapiens
atgatgctctagtac

SEQ ID NO: 24191 - DNA, 15 bp, Homo sapiens
catgatgctctagta

SEQ ID NO: 24192 - DNA, 15 bp, Homo sapiens
ccatgatgctctagt

SEQ ID NO: 24193 - DNA, 15 bp, Homo sapiens
gccatgatgctctag

SEQ ID NO: 24194 - DNA, 15 bp, Homo sapiens
ggccatgatgctcta

SEQ ID NO: 24195 - DNA, 15 bp, Homo sapiens
tggccatgatgctct

SEQ ID NO: 24196 - DNA, 15 bp, Homo sapiens
ctggccatgatgctc

SEQ ID NO: 24197 - DNA, 15 bp, Homo sapiens
tctggccatgatgct

SEQ ID NO: 24198 - DNA, 15 bp, Homo sapiens
atctggccatgatgc

SEQ ID NO: 24199 - DNA, 15 bp, Homo sapiens
tatctggccatgatg

SEQ ID NO: 24200 - DNA, 15 bp, Homo sapiens
ctatctggccatgat

SEQ ID NO: 24201 - DNA, 15 bp, Homo sapiens
actatctggccatga

SEQ ID NO: 24202 - DNA, 15 bp, Homo sapiens
cactatctggccatg

SEQ ID NO: 24203 - DNA, 15 bp, Homo sapiens
tcactatctggccat

SEQ ID NO: 24204 - DNA, 15 bp, Homo sapiens
atcactatctggcca

SEQ ID NO: 24205 - DNA, 15 bp, Homo sapiens
catcactatctggcc

SEQ ID NO: 24206 - DNA, 15 bp, Homo sapiens
gcatcactatctggc

SEQ ID NO: 24207 - DNA, 15 bp, Homo sapiens
agcatcactatctgg

SEQ ID NO: 24208 - DNA, 15 bp, Homo sapiens
cagcatcactatctg

SEQ ID NO: 24209 - DNA, 15 bp, Homo sapiens
ccagcatcactatct

SEQ ID NO: 24210 - DNA, 15 bp, Homo sapiens
cccagcatcactatc

SEQ ID NO: 24211 - DNA, 15 bp, Homo sapiens
ccccagcatcactat

SEQ ID NO: 24212 - DNA, 15 bp, Homo sapiens
accccagcatcacta

SEQ ID NO: 24213 - DNA, 15 bp, Homo sapiens
caccccagcatcact

SEQ ID NO: 24214 - DNA, 15 bp, Homo sapiens
acaccccagcatcac

SEQ ID NO: 24215 - DNA, 15 bp, Homo sapiens
cacaccccagcatca

SEQ ID NO: 24216 - DNA, 15 bp, Homo sapiens
ccacaccccagcatc

SEQ ID NO: 24217 - DNA, 15 bp, Homo sapiens
cccacaccccagcat

SEQ ID NO: 24218 - DNA, 15 bp, Homo sapiens
ccccacaccccagca

SEQ ID NO: 24219 - DNA, 15 bp, Homo sapiens
gccccacaccccagc

SEQ ID NO: 24220 - DNA, 15 bp, Homo sapiens
ggccccacaccccag

SEQ ID NO: 24221 - DNA, 15 bp, Homo sapiens
aggccccacacccca

SEQ ID NO: 24222 - DNA, 15 bp, Homo sapiens
gaggccccacacccc

SEQ ID NO: 24223 - DNA, 15 bp, Homo sapiens
tgaggccccacaccc

SEQ ID NO: 24224 - DNA, 15 bp, Homo sapiens
gtgaggccccacacc

SEQ ID NO: 24225 - DNA, 15 bp, Homo sapiens
cgtgaggccccacac

SEQ ID NO: 24226 - DNA, 15 bp, Homo sapiens
ccgtgaggccccaca

SEQ ID NO: 24227 - DNA, 15 bp, Homo sapiens
accgtgaggccccac

SEQ ID NO: 24228 - DNA, 15 bp, Homo sapiens
caccgtgaggcccca

SEQ ID NO: 24229 - DNA, 15 bp, Homo sapiens
ccaccgtgaggcccc

SEQ ID NO: 24230 - DNA, 15 bp, Homo sapiens
gccaccgtgaggccc

SEQ ID NO: 24231 - DNA, 15 bp, Homo sapiens
ggccaccgtgaggcc

SEQ ID NO: 24232 - DNA, 15 bp, Homo sapiens
tggccaccgtgaggc

SEQ ID NO: 24233 - DNA, 15 bp, Homo sapiens
atggccaccgtgagg

SEQ ID NO: 24234 - DNA, 15 bp, Homo sapiens
aatggccaccgtgag

SEQ ID NO: 24235 - DNA, 15 bp, Homo sapiens
aaatggccaccgtga

SEQ ID NO: 24236 - DNA, 15 bp, Homo sapiens
gaaatggccaccgtg

SEQ ID NO: 24237 - DNA, 15 bp, Homo sapiens
agaaatggccaccgt

SEQ ID NO: 24238 - DNA, 15 bp, Homo sapiens
cagaaatggccaccg

SEQ ID NO: 24239 - DNA, 15 bp, Homo sapiens
tcagaaatggccacc

SEQ ID NO: 24240 - DNA, 15 bp, Homo sapiens
gtcagaaatggccac

SEQ ID NO: 24241 - DNA, 15 bp, Homo sapiens
cgtcagaaatggcca

SEQ ID NO: 24242 - DNA, 15 bp, Homo sapiens
tcgtcagaaatggcc

SEQ ID NO: 24243 - DNA, 15 bp, Homo sapiens
ctcgtcagaaatggc

SEQ ID NO: 24244 - DNA, 15 bp, Homo sapiens
tctcgtcagaaatgg

SEQ ID NO: 24245 - DNA, 15 bp, Homo sapiens
gtctcgtcagaaatg

SEQ ID NO: 24246 - DNA, 15 bp, Homo sapiens
ggtctcgtcagaaat

SEQ ID NO: 24247 - DNA, 15 bp, Homo sapiens
gggtctcgtcagaaa

SEQ ID NO: 24248 - DNA, 15 bp, Homo sapiens
ggggtctcgtcagaa

SEQ ID NO: 24249 - DNA, 15 bp, Homo sapiens
tggggtctcgtcaga

SEQ ID NO: 24250 - DNA, 15 bp, Homo sapiens
gtggggtctcgtcag

SEQ ID NO: 24251 - DNA, 15 bp, Homo sapiens
ggtggggtctcgtca

SEQ ID NO: 24252 - DNA, 15 bp, Homo sapiens
cggtggggtctcgtc

SEQ ID NO: 24253 - DNA, 15 bp, Homo sapiens
ccggtggggtctcgt

SEQ ID NO: 24254 - DNA, 15 bp, Homo sapiens
cccggtggggtctcg

SEQ ID NO: 24255 - DNA, 15 bp, Homo sapiens
gcccggtggggtctc

SEQ ID NO: 24256 - DNA, 15 bp, Homo sapiens
ggcccggtggggtct

SEQ ID NO: 24257 - DNA, 15 bp, Homo sapiens
tggcccggtggggtc

SEQ ID NO: 24258 - DNA, 15 bp, Homo sapiens
ttggcccggtggggt

SEQ ID NO: 24259 - DNA, 15 bp, Homo sapiens
tttggcccggtgggg

SEQ ID NO: 24260 - DNA, 15 bp, Homo sapiens
ctttggcccggtggg

SEQ ID NO: 24261 - DNA, 15 bp, Homo sapiens
actttggcccggtgg

SEQ ID NO: 24262 - DNA, 15 bp, Homo sapiens
cactttggcccggtg

SEQ ID NO: 24263 - DNA, 15 bp, Homo sapiens
tcactttggcccggt

SEQ ID NO: 24264 - DNA, 15 bp, Homo sapiens
atcactttggcccgg

SEQ ID NO: 24265 - DNA, 15 bp, Homo sapiens
catcactttggcccg

SEQ ID NO: 24266 - DNA, 15 bp, Homo sapiens
acatcactttggccc

SEQ ID NO: 24267 - DNA, 15 bp, Homo sapiens
cacatcactttggcc

SEQ ID NO: 24268 - DNA, 15 bp, Homo sapiens
acacatcactttggc

SEQ ID NO: 24269 - DNA, 15 bp, Homo sapiens
tacacatcactttgg

SEQ ID NO: 24270 - DNA, 15 bp, Homo sapiens
ctacacatcactttg

SEQ ID NO: 24271 - DNA, 15 bp, Homo sapiens
tctacacatcacttt

SEQ ID NO: 24272 - DNA, 15 bp, Homo sapiens
ctctacacatcactt

SEQ ID NO: 24273 - DNA, 15 bp, Homo sapiens
tctctacacatcact

SEQ ID NO: 24274 - DNA, 15 bp, Homo sapiens
ttctctacacatcac

SEQ ID NO: 24275 - DNA, 15 bp, Homo sapiens
cttctctacacatca

SEQ ID NO: 24276 - DNA, 15 bp, Homo sapiens
ccttctctacacatc

SEQ ID NO: 24277 - DNA, 15 bp, Homo sapiens
tccttctctacacat

SEQ ID NO: 24278 - DNA, 15 bp, Homo sapiens
ctccttctctacaca

SEQ ID NO: 24279 - DNA, 15 bp, Homo sapiens
gctccttctctacac

SEQ ID NO: 24280 - DNA, 15 bp, Homo sapiens
agctccttctctaca

SEQ ID NO: 24281 - DNA, 15 bp, Homo sapiens
cagctccttctctac

SEQ ID NO: 24282 - DNA, 15 bp, Homo sapiens
gcagctccttctcta

SEQ ID NO: 24283 - DNA, 15 bp, Homo sapiens
agcagctccttctct

SEQ ID NO: 24284 - DNA, 15 bp, Homo sapiens
aagcagctccttctc

SEQ ID NO: 24285 - DNA, 15 bp, Homo sapiens
gaagcagctccttct

SEQ ID NO: 24286 - DNA, 15 bp, Homo sapiens
cgaagcagctccttc

SEQ ID NO: 24287 - DNA, 15 bp, Homo sapiens
ccgaagcagctcctt

SEQ ID NO: 24288 - DNA, 15 bp, Homo sapiens
accgaagcagctcct

SEQ ID NO: 24289 - DNA, 15 bp, Homo sapiens
gaccgaagcagctcc

SEQ ID NO: 24290 - DNA, 15 bp, Homo sapiens
tgaccgaagcagctc

SEQ ID NO: 24291 - DNA, 15 bp, Homo sapiens
gtgaccgaagcagct

SEQ ID NO: 24292 - DNA, 15 bp, Homo sapiens
ggtgaccgaagcagc

SEQ ID NO: 24293 - DNA, 15 bp, Homo sapiens
tggtgaccgaagcag

SEQ ID NO: 24294 - DNA, 15 bp, Homo sapiens
ctggtgaccgaagca

SEQ ID NO: 24295 - DNA, 15 bp, Homo sapiens
tctggtgaccgaagc

SEQ ID NO: 24296 - DNA, 15 bp, Homo sapiens
ttctggtgaccgaag

SEQ ID NO: 24297 - DNA, 15 bp, Homo sapiens
tttctggtgaccgaa

SEQ ID NO: 24298 - DNA, 15 bp, Homo sapiens
ttttctggtgaccga

SEQ ID NO: 24299 - DNA, 15 bp, Homo sapiens
cttttctggtgaccg

SEQ ID NO: 24300 - DNA, 15 bp, Homo sapiens
tcttttctggtgacc

SEQ ID NO: 24301 - DNA, 15 bp, Homo sapiens
ttcttttctggtgac

SEQ ID NO: 24302 - DNA, 15 bp, Homo sapiens
gttcttttctggtga

SEQ ID NO: 24303 - DNA, 15 bp, Homo sapiens
cgttcttttctggtg

SEQ ID NO: 24304 - DNA, 15 bp, Homo sapiens
ccgttcttttctggt

SEQ ID NO: 24305 - DNA, 15 bp, Homo sapiens
cccgttcttttctgg

SEQ ID NO: 24306 - DNA, 15 bp, Homo sapiens
ccccgttcttttctg

SEQ ID NO: 24307 - DNA, 15 bp, Homo sapiens
tccccgttcttttct

SEQ ID NO: 24308 - DNA, 15 bp, Homo sapiens
ttccccgttcttttc

SEQ ID NO: 24309 - DNA, 15 bp, Homo sapiens
cttccccgttctttt

SEQ ID NO: 24310 - DNA, 15 bp, Homo sapiens
gcttccccgttcttt

SEQ ID NO: 24311 - DNA, 15 bp, Homo sapiens
ggcttccccgttctt

SEQ ID NO: 24312 - DNA, 15 bp, Homo sapiens
aggcttccccgttct

SEQ ID NO: 24313 - DNA, 15 bp, Homo sapiens
gaggcttccccgttc

SEQ ID NO: 24314 - DNA, 15 bp, Homo sapiens
ggaggcttccccgtt

SEQ ID NO: 24315 - DNA, 15 bp, Homo sapiens
gggaggcttccccgt

SEQ ID NO: 24316 - DNA, 15 bp, Homo sapiens
tgggaggcttccccg

SEQ ID NO: 24317 - DNA, 15 bp, Homo sapiens
gtgggaggcttcccc

SEQ ID NO: 24318 - DNA, 15 bp, Homo sapiens
tgtgggaggcttccc

SEQ ID NO: 24319 - DNA, 15 bp, Homo sapiens
gtgtgggaggcttcc

SEQ ID NO: 24320 - DNA, 15 bp, Homo sapiens
agtgtgggaggcttc

SEQ ID NO: 24321 - DNA, 15 bp, Homo sapiens
tagtgtgggaggctt

SEQ ID NO: 24322 - DNA, 15 bp, Homo sapiens
ctagtgtgggaggct

SEQ ID NO: 24323 - DNA, 15 bp, Homo sapiens
tctagtgtgggaggc

SEQ ID NO: 24324 - DNA, 15 bp, Homo sapiens
ttctagtgtgggagg

SEQ ID NO: 24325 - DNA, 15 bp, Homo sapiens
attctagtgtgggag

SEQ ID NO: 24326 - DNA, 15 bp, Homo sapiens
tattctagtgtggga

SEQ ID NO: 24327 - DNA, 15 bp, Homo sapiens
ctattctagtgtggg

SEQ ID NO: 24328 - DNA, 15 bp, Homo sapiens
cctattctagtgtgg

SEQ ID NO: 24329 - DNA, 15 bp, Homo sapiens
acctattctagtgtg

SEQ ID NO: 24330 - DNA, 15 bp, Homo sapiens
tacctattctagtgt

SEQ ID NO: 24331 - DNA, 15 bp, Homo sapiens
ctacctattctagtg

SEQ ID NO: 24332 - DNA, 15 bp, Homo sapiens
cctacctattctagt

SEQ ID NO: 24333 - DNA, 15 bp, Homo sapiens
ccctacctattctag

SEQ ID NO: 24334 - DNA, 15 bp, Homo sapiens
accctacctattcta

SEQ ID NO: 24335 - DNA, 15 bp, Homo sapiens
caccctacctattct

SEQ ID NO: 24336 - DNA, 15 bp, Homo sapiens
gcaccctacctattc

SEQ ID NO: 24337 - DNA, 15 bp, Homo sapiens
agcaccctacctatt

SEQ ID NO: 24338 - DNA, 15 bp, Homo sapiens
gagcaccctacctat

SEQ ID NO: 24339 - DNA, 15 bp, Homo sapiens
agagcaccctaccta

SEQ ID NO: 24340 - DNA, 15 bp, Homo sapiens
aagagcaccctacct

SEQ ID NO: 24341 - DNA, 15 bp, Homo sapiens
gaagagcaccctacc

SEQ ID NO: 24342 - DNA, 15 bp, Homo sapiens
agaagagcaccctac

SEQ ID NO: 24343 - DNA, 15 bp, Homo sapiens
gagaagagcacccta

SEQ ID NO: 24344 - DNA, 15 bp, Homo sapiens
ggagaagagcaccct

SEQ ID NO: 24345 - DNA, 15 bp, Homo sapiens
tggagaagagcaccc

SEQ ID NO: 24346 - DNA, 15 bp, Homo sapiens
gtggagaagagcacc

SEQ ID NO: 24347 - DNA, 15 bp, Homo sapiens
ggtggagaagagcac

SEQ ID NO: 24348 - DNA, 15 bp, Homo sapiens
cggtggagaagagca

SEQ ID NO: 24349 - DNA, 15 bp, Homo sapiens
ccggtggagaagagc

SEQ ID NO: 24350 - DNA, 15 bp, Homo sapiens
gccggtggagaagag

SEQ ID NO: 24351 - DNA, 15 bp, Homo sapiens
tgccggtggagaaga

SEQ ID NO: 24352 - DNA, 15 bp, Homo sapiens
ctgccggtggagaag

SEQ ID NO: 24353 - DNA, 15 bp, Homo sapiens
cctgccggtggagaa

SEQ ID NO: 24354 - DNA, 15 bp, Homo sapiens
tcctgccggtggaga

SEQ ID NO: 24355 - DNA, 15 bp, Homo sapiens
ttcctgccggtggag

SEQ ID NO: 24356 - DNA, 15 bp, Homo sapiens
cttcctgccggtgga

SEQ ID NO: 24357 - DNA, 15 bp, Homo sapiens
ccttcctgccggtgg

SEQ ID NO: 24358 - DNA, 15 bp, Homo sapiens
cccttcctgccggtg

SEQ ID NO: 24359 - DNA, 15 bp, Homo sapiens
ccccttcctgccggt

SEQ ID NO: 24360 - DNA, 15 bp, Homo sapiens
tccccttcctgccgg

SEQ ID NO: 24361 - DNA, 15 bp, Homo sapiens
atccccttcctgccg

SEQ ID NO: 24362 - DNA, 15 bp, Homo sapiens
catccccttcctgcc

SEQ ID NO: 24363 - DNA, 15 bp, Homo sapiens
acatccccttcctgc

SEQ ID NO: 24364 - DNA, 15 bp, Homo sapiens
tacatccccttcctg

SEQ ID NO: 24365 - DNA, 15 bp, Homo sapiens
atacatccccttcct

SEQ ID NO: 24366 - DNA, 15 bp, Homo sapiens
catacatccccttcc

SEQ ID NO: 24367 - DNA, 15 bp, Homo sapiens
ccatacatccccttc

SEQ ID NO: 24368 - DNA, 15 bp, Homo sapiens
gccatacatcccctt

SEQ ID NO: 24369 - DNA, 15 bp, Homo sapiens
agccatacatcccct

SEQ ID NO: 24370 - DNA, 15 bp, Homo sapiens
gagccatacatcccc

SEQ ID NO: 24371 - DNA, 15 bp, Homo sapiens
agagccatacatccc

SEQ ID NO: 24372 - DNA, 15 bp, Homo sapiens
cagagccatacatcc

SEQ ID NO: 24373 - DNA, 15 bp, Homo sapiens
gcagagccatacatc

SEQ ID NO: 24374 - DNA, 15 bp, Homo sapiens
ggcagagccatacat

SEQ ID NO: 24375 - DNA, 15 bp, Homo sapiens
aggcagagccataca

SEQ ID NO: 24376 - DNA, 15 bp, Homo sapiens
caggcagagccatac

SEQ ID NO: 24377 - DNA, 15 bp, Homo sapiens
ccaggcagagccata

SEQ ID NO: 24378 - DNA, 15 bp, Homo sapiens
tccaggcagagccat

SEQ ID NO: 24379 - DNA, 15 bp, Homo sapiens
gtccaggcagagcca

SEQ ID NO: 24380 - DNA, 15 bp, Homo sapiens
ggtccaggcagagcc

SEQ ID NO: 24381 - DNA, 15 bp, Homo sapiens
tggtccaggcagagc

SEQ ID NO: 24382 - DNA, 15 bp, Homo sapiens
gtggtccaggcagag

SEQ ID NO: 24383 - DNA, 15 bp, Homo sapiens
tgtggtccaggcaga

SEQ ID NO: 24384 - DNA, 15 bp, Homo sapiens
gtgtggtccaggcag

SEQ ID NO: 24385 - DNA, 15 bp, Homo sapiens
ggtgtggtccaggca

SEQ ID NO: 24386 - DNA, 15 bp, Homo sapiens
aggtgtggtccaggc

SEQ ID NO: 24387 - DNA, 15 bp, Homo sapiens
aaggtgtggtccagg

SEQ ID NO: 24388 - DNA, 15 bp, Homo sapiens
aaaggtgtggtccag

SEQ ID NO: 24389 - DNA, 15 bp, Homo sapiens
aaaaggtgtggtcca

SEQ ID NO: 24390 - DNA, 15 bp, Homo sapiens
aaaaaggtgtggtcc

SEQ ID NO: 24391 - DNA, 15 bp, Homo sapiens
gaaaaaggtgtggtc

SEQ ID NO: 24392 - DNA, 15 bp, Homo sapiens
ggaaaaaggtgtggt

SEQ ID NO: 24393 - DNA, 15 bp, Homo sapiens
aggaaaaaggtgtgg

SEQ ID NO: 24394 - DNA, 15 bp, Homo sapiens
aaggaaaaaggtgtg

SEQ ID NO: 24395 - DNA, 15 bp, Homo sapiens
caaggaaaaaggtgt

SEQ ID NO: 24396 - DNA, 15 bp, Homo sapiens
gcaaggaaaaaggtg

SEQ ID NO: 24397 - DNA, 15 bp, Homo sapiens
agcaaggaaaaaggt

SEQ ID NO: 24398 - DNA, 15 bp, Homo sapiens
gagcaaggaaaaagg

SEQ ID NO: 24399 - DNA, 15 bp, Homo sapiens
agagcaaggaaaaag

SEQ ID NO: 24400 - DNA, 15 bp, Homo sapiens
aagagcaaggaaaaa

SEQ ID NO: 24401 - DNA, 15 bp, Homo sapiens
gaagagcaaggaaaa

SEQ ID NO: 24402 - DNA, 15 bp, Homo sapiens
ggaagagcaaggaaa

SEQ ID NO: 24403 - DNA, 15 bp, Homo sapiens
gggaagagcaaggaa

SEQ ID NO: 24404 - DNA, 15 bp, Homo sapiens
agggaagagcaagga

SEQ ID NO: 24405 - DNA, 15 bp, Homo sapiens
gagggaagagcaagg

SEQ ID NO: 24406 - DNA, 15 bp, Homo sapiens
ggagggaagagcaag

SEQ ID NO: 24407 - DNA, 15 bp, Homo sapiens
cggagggaagagcaa

SEQ ID NO: 24408 - DNA, 15 bp, Homo sapiens
gcggagggaagagca

SEQ ID NO: 24409 - DNA, 15 bp, Homo sapiens
tgcggagggaagagc

SEQ ID NO: 24410 - DNA, 15 bp, Homo sapiens
atgcggagggaagag

SEQ ID NO: 24411 - DNA, 15 bp, Homo sapiens
gatgcggagggaaga

SEQ ID NO: 24412 - DNA, 15 bp, Homo sapiens
agatgcggagggaag

SEQ ID NO: 24413 - DNA, 15 bp, Homo sapiens
cagatgcggagggaa

SEQ ID NO: 24414 - DNA, 15 bp, Homo sapiens
gcagatgcggaggga

SEQ ID NO: 24415 - DNA, 15 bp, Homo sapiens
agcagatgcggaggg

SEQ ID NO: 24416 - DNA, 15 bp, Homo sapiens
cagcagatgcggagg

SEQ ID NO: 24417 - DNA, 15 bp, Homo sapiens
acagcagatgcggag

SEQ ID NO: 24418 - DNA, 15 bp, Homo sapiens
cacagcagatgcgga

SEQ ID NO: 24419 - DNA, 15 bp, Homo sapiens
ccacagcagatgcgg

SEQ ID NO: 24420 - DNA, 15 bp, Homo sapiens
gccacagcagatgcg

SEQ ID NO: 24421 - DNA, 15 bp, Homo sapiens
ggccacagcagatgc

SEQ ID NO: 24422 - DNA, 15 bp, Homo sapiens
cggccacagcagatg

SEQ ID NO: 24423 - DNA, 15 bp, Homo sapiens
tcggccacagcagat

SEQ ID NO: 24424 - DNA, 15 bp, Homo sapiens
ctcggccacagcaga

SEQ ID NO: 24425 - DNA, 15 bp, Homo sapiens
cctcggccacagcag

SEQ ID NO: 24426 - DNA, 15 bp, Homo sapiens
gcctcggccacagca

SEQ ID NO: 24427 - DNA, 15 bp, Homo sapiens
ggcctcggccacagc

SEQ ID NO: 24428 - DNA, 15 bp, Homo sapiens
tggcctcggccacag

SEQ ID NO: 24429 - DNA, 15 bp, Homo sapiens
atggcctcggccaca

SEQ ID NO: 24430 - DNA, 15 bp, Homo sapiens
aatggcctcggccac

SEQ ID NO: 24431 - DNA, 15 bp, Homo sapiens
gaatggcctcggcca

SEQ ID NO: 24432 - DNA, 15 bp, Homo sapiens
ggaatggcctcggcc

SEQ ID NO: 24433 - DNA, 15 bp, Homo sapiens
aggaatggcctcggc

SEQ ID NO: 24434 - DNA, 15 bp, Homo sapiens
gaggaatggcctcgg

SEQ ID NO: 24435 - DNA, 15 bp, Homo sapiens
tgaggaatggcctcg

SEQ ID NO: 24436 - DNA, 15 bp, Homo sapiens
atgaggaatggcctc

SEQ ID NO: 24437 - DNA, 15 bp, Homo sapiens
gatgaggaatggcct

SEQ ID NO: 24438 - DNA, 15 bp, Homo sapiens
tgatgaggaatggcc

SEQ ID NO: 24439 - DNA, 15 bp, Homo sapiens
ctgatgaggaatggc

SEQ ID NO: 24440 - DNA, 15 bp, Homo sapiens
cctgatgaggaatgg

SEQ ID NO: 24441 - DNA, 15 bp, Homo sapiens
ccctgatgaggaatg

SEQ ID NO: 24442 - DNA, 15 bp, Homo sapiens
tccctgatgaggaat

SEQ ID NO: 24443 - DNA, 15 bp, Homo sapiens
ttccctgatgaggaa

SEQ ID NO: 24444 - DNA, 15 bp, Homo sapiens
gttccctgatgagga

SEQ ID NO: 24445 - DNA, 15 bp, Homo sapiens
tgttccctgatgagg

SEQ ID NO: 24446 - DNA, 15 bp, Homo sapiens
atgttccctgatgag

SEQ ID NO: 24447 - DNA, 15 bp, Homo sapiens
catgttccctgatga

SEQ ID NO: 24448 - DNA, 15 bp, Homo sapiens
acatgttccctgatg

SEQ ID NO: 24449 - DNA, 15 bp, Homo sapiens
cacatgttccctgat

SEQ ID NO: 24450 - DNA, 15 bp, Homo sapiens
acacatgttccctga

SEQ ID NO: 24451 - DNA, 15 bp, Homo sapiens
aacacatgttccctg

SEQ ID NO: 24452 - DNA, 15 bp, Homo sapiens
taacacatgttccct

SEQ ID NO: 24453 - DNA, 15 bp, Homo sapiens
ctaacacatgttccc

SEQ ID NO: 24454 - DNA, 15 bp, Homo sapiens
tctaacacatgttcc

SEQ ID NO: 24455 - DNA, 15 bp, Homo sapiens
ctctaacacatgttc

SEQ ID NO: 24456 - DNA, 15 bp, Homo sapiens
cctctaacacatgtt

SEQ ID NO: 24457 - DNA, 15 bp, Homo sapiens
gcctctaacacatgt

SEQ ID NO: 24458 - DNA, 15 bp, Homo sapiens
agcctctaacacatg

SEQ ID NO: 24459 - DNA, 15 bp, Homo sapiens
gagcctctaacacat

SEQ ID NO: 24460 - DNA, 15 bp, Homo sapiens
tgagcctctaacaca

SEQ ID NO: 24461 - DNA, 15 bp, Homo sapiens
gtgagcctctaacac

SEQ ID NO: 24462 - DNA, 15 bp, Homo sapiens
cgtgagcctctaaca

SEQ ID NO: 24463 - DNA, 15 bp, Homo sapiens
gcgtgagcctctaac

SEQ ID NO: 24464 - DNA, 15 bp, Homo sapiens
ggcgtgagcctctaa

SEQ ID NO: 24465 - DNA, 15 bp, Homo sapiens
tggcgtgagcctcta

SEQ ID NO: 24466 - DNA, 15 bp, Homo sapiens
gtggcgtgagcctct

SEQ ID NO: 24467 - DNA, 15 bp, Homo sapiens
ggtggcgtgagcctc

SEQ ID NO: 24468 - DNA, 15 bp, Homo sapiens
aggtggcgtgagcct

SEQ ID NO: 24469 - DNA, 15 bp, Homo sapiens
caggtggcgtgagcc

SEQ ID NO: 24470 - DNA, 15 bp, Homo sapiens
ccaggtggcgtgagc

SEQ ID NO: 24471 - DNA, 15 bp, Homo sapiens
cccaggtggcgtgag

SEQ ID NO: 24472 - DNA, 15 bp, Homo sapiens
tcccaggtggcgtga

SEQ ID NO: 24473 - DNA, 15 bp, Homo sapiens
gtcccaggtggcgtg

SEQ ID NO: 24474 - DNA, 15 bp, Homo sapiens
ggtcccaggtggcgt

SEQ ID NO: 24475 - DNA, 15 bp, Homo sapiens
tggtcccaggtggcg

SEQ ID NO: 24476 - DNA, 15 bp, Homo sapiens
gtggtcccaggtggc

SEQ ID NO: 24477 - DNA, 15 bp, Homo sapiens
agtggtcccaggtgg

SEQ ID NO: 24478 - DNA, 15 bp, Homo sapiens
aagtggtcccaggtg

SEQ ID NO: 24479 - DNA, 15 bp, Homo sapiens
caagtggtcccaggt

SEQ ID NO: 24480 - DNA, 15 bp, Homo sapiens
acaagtggtcccagg

SEQ ID NO: 24481 - DNA, 15 bp, Homo sapiens
gacaagtggtcccag

SEQ ID NO: 24482 - DNA, 15 bp, Homo sapiens
agacaagtggtccca

SEQ ID NO: 24483 - DNA, 15 bp, Homo sapiens
aagacaagtggtccc

SEQ ID NO: 24484 - DNA, 15 bp, Homo sapiens
taagacaagtggtcc

SEQ ID NO: 24485 - DNA, 15 bp, Homo sapiens
ataagacaagtggtc

SEQ ID NO: 24486 - DNA, 15 bp, Homo sapiens
gataagacaagtggt

SEQ ID NO: 24487 - DNA, 15 bp, Homo sapiens
tgataagacaagtgg

SEQ ID NO: 24488 - DNA, 15 bp, Homo sapiens
gtgataagacaagtg

SEQ ID NO: 24489 - DNA, 15 bp, Homo sapiens
ggtgataagacaagt

SEQ ID NO: 24490 - DNA, 15 bp, Homo sapiens
gggtgataagacaag

SEQ ID NO: 24491 - DNA, 15 bp, Homo sapiens
ggggtgataagacaa

SEQ ID NO: 24492 - DNA, 15 bp, Homo sapiens
gggggtgataagaca

SEQ ID NO: 24493 - DNA, 15 bp, Homo sapiens
tgggggtgataagac

SEQ ID NO: 24494 - DNA, 15 bp, Homo sapiens
ctgggggtgataaga

SEQ ID NO: 24495 - DNA, 15 bp, Homo sapiens
cctgggggtgataag

SEQ ID NO: 24496 - DNA, 15 bp, Homo sapiens
tcctgggggtgataa

SEQ ID NO: 24497 - DNA, 15 bp, Homo sapiens
gtcctgggggtgata

SEQ ID NO: 24498 - DNA, 15 bp, Homo sapiens
ggtcctgggggtgat

SEQ ID NO: 24499 - DNA, 15 bp, Homo sapiens
gggtcctgggggtga

SEQ ID NO: 24500 - DNA, 15 bp, Homo sapiens
agggtcctgggggtg

SEQ ID NO: 24501 - DNA, 15 bp, Homo sapiens
tagggtcctgggggt

SEQ ID NO: 24502 - DNA, 15 bp, Homo sapiens
ctagggtcctggggg

SEQ ID NO: 24503 - DNA, 15 bp, Homo sapiens
cctagggtcctgggg

SEQ ID NO: 24504 - DNA, 15 bp, Homo sapiens
gcctagggtcctggg

SEQ ID NO: 24505 - DNA, 15 bp, Homo sapiens
cgcctagggtcctgg

SEQ ID NO: 24506 - DNA, 15 bp, Homo sapiens
ccgcctagggtcctg

SEQ ID NO: 24507 - DNA, 15 bp, Homo sapiens
accgcctagggtcct

SEQ ID NO: 24508 - DNA, 15 bp, Homo sapiens
taccgcctagggtcc

SEQ ID NO: 24509 - DNA, 15 bp, Homo sapiens
ctaccgcctagggtc

SEQ ID NO: 24510 - DNA, 15 bp, Homo sapiens
actaccgcctagggt

SEQ ID NO: 24511 - DNA, 15 bp, Homo sapiens
aactaccgcctaggg

SEQ ID NO: 24512 - DNA, 15 bp, Homo sapiens
aaactaccgcctagg

SEQ ID NO: 24513 - DNA, 15 bp, Homo sapiens
gaaactaccgcctag

SEQ ID NO: 24514 - DNA, 15 bp, Homo sapiens
ggaaactaccgccta

SEQ ID NO: 24515 - DNA, 15 bp, Homo sapiens
aggaaactaccgcct

SEQ ID NO: 24516 - DNA, 15 bp, Homo sapiens
caggaaactaccgcc

SEQ ID NO: 24517 - DNA, 15 bp, Homo sapiens
acaggaaactaccgc

SEQ ID NO: 24518 - DNA, 15 bp, Homo sapiens
cacaggaaactaccg

SEQ ID NO: 24519 - DNA, 15 bp, Homo sapiens
ccacaggaaactacc

SEQ ID NO: 24520 - DNA, 15 bp, Homo sapiens
gccacaggaaactac

SEQ ID NO: 24521 - DNA, 15 bp, Homo sapiens
ggccacaggaaacta

SEQ ID NO: 24522 - DNA, 15 bp, Homo sapiens
aggccacaggaaact

SEQ ID NO: 24523 - DNA, 15 bp, Homo sapiens
caggccacaggaaac

SEQ ID NO: 24524 - DNA, 15 bp, Homo sapiens
tcaggccacaggaaa

SEQ ID NO: 24525 - DNA, 15 bp, Homo sapiens
ctcaggccacaggaa

SEQ ID NO: 24526 - DNA, 15 bp, Homo sapiens
actcaggccacagga

SEQ ID NO: 24527 - DNA, 15 bp, Homo sapiens
aactcaggccacagg

SEQ ID NO: 24528 - DNA, 15 bp, Homo sapiens
taactcaggccacag

SEQ ID NO: 24529 - DNA, 15 bp, Homo sapiens
ctaactcaggccaca

SEQ ID NO: 24530 - DNA, 15 bp, Homo sapiens
gctaactcaggccac

SEQ ID NO: 24531 - DNA, 15 bp, Homo sapiens
agctaactcaggcca

SEQ ID NO: 24532 - DNA, 15 bp, Homo sapiens
cagctaactcaggcc

SEQ ID NO: 24533 - DNA, 15 bp, Homo sapiens
tcagctaactcaggc

SEQ ID NO: 24534 - DNA, 15 bp, Homo sapiens
atcagctaactcagg

SEQ ID NO: 24535 - DNA, 15 bp, Homo sapiens
tatcagctaactcag

SEQ ID NO: 24536 - DNA, 15 bp, Homo sapiens
atatcagctaactca

SEQ ID NO: 24537 - DNA, 15 bp, Homo sapiens
aatatcagctaactc

SEQ ID NO: 24538 - DNA, 15 bp, Homo sapiens
aaatatcagctaact

SEQ ID NO: 24539 - DNA, 15 bp, Homo sapiens
taaatatcagctaac

SEQ ID NO: 24540 - DNA, 15 bp, Homo sapiens
ataaatatcagctaa

SEQ ID NO: 24541 - DNA, 15 bp, Homo sapiens
tataaatatcagcta

SEQ ID NO: 24542 - DNA, 15 bp, Homo sapiens
atataaatatcagct

SEQ ID NO: 24543 - DNA, 15 bp, Homo sapiens
tatataaatatcagc

SEQ ID NO: 24544 - DNA, 15 bp, Homo sapiens
ctatataaatatcag

SEQ ID NO: 24545 - DNA, 15 bp, Homo sapiens
actatataaatatca

SEQ ID NO: 24546 - DNA, 15 bp, Homo sapiens
cactatataaatatc

SEQ ID NO: 24547 - DNA, 15 bp, Homo sapiens
gcactatataaatat

SEQ ID NO: 24548 - DNA, 15 bp, Homo sapiens
ggcactatataaata

SEQ ID NO: 24549 - DNA, 15 bp, Homo sapiens
tggcactatataaat

SEQ ID NO: 24550 - DNA, 15 bp, Homo sapiens
atggcactatataaa

SEQ ID NO: 24551 - DNA, 15 bp, Homo sapiens
aatggcactatataa

SEQ ID NO: 24552 - DNA, 15 bp, Homo sapiens
caatggcactatata

SEQ ID NO: 24553 - DNA, 15 bp, Homo sapiens
acaatggcactatat

SEQ ID NO: 24554 - DNA, 15 bp, Homo sapiens
cacaatggcactata

SEQ ID NO: 24555 - DNA, 15 bp, Homo sapiens
gcacaatggcactat

SEQ ID NO: 24556 - DNA, 15 bp, Homo sapiens
ggcacaatggcacta

SEQ ID NO: 24557 - DNA, 15 bp, Homo sapiens
aggcacaatggcact

SEQ ID NO: 24558 - DNA, 15 bp, Homo sapiens
aaggcacaatggcac

SEQ ID NO: 24559 - DNA, 15 bp, Homo sapiens
aaaggcacaatggca

SEQ ID NO: 24560 - DNA, 15 bp, Homo sapiens
aaaaggcacaatggc

SEQ ID NO: 24561 - DNA, 15 bp, Homo sapiens
gaaaaggcacaatgg

SEQ ID NO: 24562 - DNA, 15 bp, Homo sapiens
agaaaaggcacaatg

SEQ ID NO: 24563 - DNA, 15 bp, Homo sapiens
gagaaaaggcacaat

SEQ ID NO: 24564 - DNA, 15 bp, Homo sapiens
ggagaaaaggcacaa

SEQ ID NO: 24565 - DNA, 15 bp, Homo sapiens
aggagaaaaggcaca

SEQ ID NO: 24566 - DNA, 15 bp, Homo sapiens
caggagaaaaggcac

SEQ ID NO: 24567 - DNA, 15 bp, Homo sapiens
acaggagaaaaggca

SEQ ID NO: 24568 - DNA, 15 bp, Homo sapiens
cacaggagaaaaggc

SEQ ID NO: 24569 - DNA, 15 bp, Homo sapiens
tcacaggagaaaagg

SEQ ID NO: 24570 - DNA, 15 bp, Homo sapiens
atcacaggagaaaag

SEQ ID NO: 24571 - DNA, 15 bp, Homo sapiens
catcacaggagaaaa

SEQ ID NO: 24572 - DNA, 15 bp, Homo sapiens
gcatcacaggagaaa

SEQ ID NO: 24573 - DNA, 15 bp, Homo sapiens
agcatcacaggagaa

SEQ ID NO: 24574 - DNA, 15 bp, Homo sapiens
gagcatcacaggaga

SEQ ID NO: 24575 - DNA, 15 bp, Homo sapiens
tgagcatcacaggag

SEQ ID NO: 24576 - DNA, 15 bp, Homo sapiens
gtgagcatcacagga

SEQ ID NO: 24577 - DNA, 15 bp, Homo sapiens
tgtgagcatcacagg

SEQ ID NO: 24578 - DNA, 15 bp, Homo sapiens
ctgtgagcatcacag

SEQ ID NO: 24579 - DNA, 15 bp, Homo sapiens
actgtgagcatcaca

SEQ ID NO: 24580 - DNA, 15 bp, Homo sapiens
tactgtgagcatcac

SEQ ID NO: 24581 - DNA, 15 bp, Homo sapiens
ttactgtgagcatca

SEQ ID NO: 24582 - DNA, 15 bp, Homo sapiens
cttactgtgagcatc

SEQ ID NO: 24583 - DNA, 15 bp, Homo sapiens
ccttactgtgagcat

SEQ ID NO: 24584 - DNA, 15 bp, Homo sapiens
tccttactgtgagca

SEQ ID NO: 24585 - DNA, 15 bp, Homo sapiens
atccttactgtgagc

SEQ ID NO: 24586 - DNA, 15 bp, Homo sapiens
catccttactgtgag

SEQ ID NO: 24587 - DNA, 15 bp, Homo sapiens
gcatccttactgtga

SEQ ID NO: 24588 - DNA, 15 bp, Homo sapiens
ggcatccttactgtg

SEQ ID NO: 24589 - DNA, 15 bp, Homo sapiens
aggcatccttactgt

SEQ ID NO: 24590 - DNA, 15 bp, Homo sapiens
taggcatccttactg

SEQ ID NO: 24591 - DNA, 15 bp, Homo sapiens
ctaggcatccttact

SEQ ID NO: 24592 - DNA, 15 bp, Homo sapiens
tctaggcatccttac

SEQ ID NO: 24593 - DNA, 15 bp, Homo sapiens
atctaggcatcctta

SEQ ID NO: 24594 - DNA, 15 bp, Homo sapiens
catctaggcatcctt

SEQ ID NO: 24595 - DNA, 15 bp, Homo sapiens
ccatctaggcatcct

SEQ ID NO: 24596 - DNA, 15 bp, Homo sapiens
cccatctaggcatcc

SEQ ID NO: 24597 - DNA, 15 bp, Homo sapiens
ccccatctaggcatc

SEQ ID NO: 24598 - DNA, 15 bp, Homo sapiens
accccatctaggcat

SEQ ID NO: 24599 - DNA, 15 bp, Homo sapiens
aaccccatctaggca

SEQ ID NO: 24600 - DNA, 15 bp, Homo sapiens
taaccccatctaggc

SEQ ID NO: 24601 - DNA, 15 bp, Homo sapiens
gtaaccccatctagg

SEQ ID NO: 24602 - DNA, 15 bp, Homo sapiens
ggtaaccccatctag

SEQ ID NO: 24603 - DNA, 15 bp, Homo sapiens
aggtaaccccatcta

SEQ ID NO: 24604 - DNA, 15 bp, Homo sapiens
caggtaaccccatct

SEQ ID NO: 24605 - DNA, 15 bp, Homo sapiens
acaggtaaccccatc

SEQ ID NO: 24606 - DNA, 15 bp, Homo sapiens
aacaggtaaccccat

SEQ ID NO: 24607 - DNA, 15 bp, Homo sapiens
caacaggtaacccca

SEQ ID NO: 24608 - DNA, 15 bp, Homo sapiens
acaacaggtaacccc

SEQ ID NO: 24609 - DNA, 15 bp, Homo sapiens
gacaacaggtaaccc

SEQ ID NO: 24610 - DNA, 15 bp, Homo sapiens
tgacaacaggtaacc

SEQ ID NO: 24611 - DNA, 15 bp, Homo sapiens
ttgacaacaggtaac

SEQ ID NO: 24612 - DNA, 15 bp, Homo sapiens
cttgacaacaggtaa

SEQ ID NO: 24613 - DNA, 15 bp, Homo sapiens
tcttgacaacaggta

SEQ ID NO: 24614 - DNA, 15 bp, Homo sapiens
atcttgacaacaggt

SEQ ID NO: 24615 - DNA, 15 bp, Homo sapiens
tatcttgacaacagg

SEQ ID NO: 24616 - DNA, 15 bp, Homo sapiens
ttatcttgacaacag

SEQ ID NO: 24617 - DNA, 15 bp, Homo sapiens
cttatcttgacaaca

SEQ ID NO: 24618 - DNA, 15 bp, Homo sapiens
ccttatcttgacaac

SEQ ID NO: 24619 - DNA, 15 bp, Homo sapiens
tccttatcttgacaa

SEQ ID NO: 24620 - DNA, 15 bp, Homo sapiens
ttccttatcttgaca

SEQ ID NO: 24621 - DNA, 15 bp, Homo sapiens
tttccttatcttgac

SEQ ID NO: 24622 - DNA, 15 bp, Homo sapiens
gtttccttatcttga

SEQ ID NO: 24623 - DNA, 15 bp, Homo sapiens
agtttccttatcttg

SEQ ID NO: 24624 - DNA, 15 bp, Homo sapiens
cagtttccttatctt

SEQ ID NO: 24625 - DNA, 15 bp, Homo sapiens
tcagtttccttatct

SEQ ID NO: 24626 - DNA, 15 bp, Homo sapiens
ttcagtttccttatc

SEQ ID NO: 24627 - DNA, 15 bp, Homo sapiens
cttcagtttccttat

SEQ ID NO: 24628 - DNA, 15 bp, Homo sapiens
gcttcagtttcctta

SEQ ID NO: 24629 - DNA, 15 bp, Homo sapiens
tgcttcagtttcctt

SEQ ID NO: 24630 - DNA, 15 bp, Homo sapiens
gtgcttcagtttcct

SEQ ID NO: 24631 - DNA, 15 bp, Homo sapiens
tgtgcttcagtttcc

SEQ ID NO: 24632 - DNA, 15 bp, Homo sapiens
ctgtgcttcagtttc

SEQ ID NO: 24633 - DNA, 15 bp, Homo sapiens
tctgtgcttcagttt

SEQ ID NO: 24634 - DNA, 15 bp, Homo sapiens
ttctgtgcttcagtt

SEQ ID NO: 24635 - DNA, 15 bp, Homo sapiens
attctgtgcttcagt

SEQ ID NO: 24636 - DNA, 15 bp, Homo sapiens
cattctgtgcttcag

SEQ ID NO: 24637 - DNA, 15 bp, Homo sapiens
gcattctgtgcttca

SEQ ID NO: 24638 - DNA, 15 bp, Homo sapiens
agcattctgtgcttc

SEQ ID NO: 24639 - DNA, 15 bp, Homo sapiens
cagcattctgtgctt

SEQ ID NO: 24640 - DNA, 15 bp, Homo sapiens
tcagcattctgtgct

SEQ ID NO: 24641 - DNA, 15 bp, Homo sapiens
ctcagcattctgtgc

SEQ ID NO: 24642 - DNA, 15 bp, Homo sapiens
cctcagcattctgtg

SEQ ID NO: 24643 - DNA, 15 bp, Homo sapiens
acctcagcattctgt

SEQ ID NO: 24644 - DNA, 15 bp, Homo sapiens
gacctcagcattctg

SEQ ID NO: 24645 - DNA, 15 bp, Homo sapiens
tgacctcagcattct

SEQ ID NO: 24646 - DNA, 15 bp, Homo sapiens
atgacctcagcattc

SEQ ID NO: 24647 - DNA, 15 bp, Homo sapiens
aatgacctcagcatt

SEQ ID NO: 24648 - DNA, 15 bp, Homo sapiens
aaatgacctcagcat

SEQ ID NO: 24649 - DNA, 15 bp, Homo sapiens
caaatgacctcagca

SEQ ID NO: 24650 - DNA, 15 bp, Homo sapiens
gcaaatgacctcagc

SEQ ID NO: 24651 - DNA, 15 bp, Homo sapiens
agcaaatgacctcag

SEQ ID NO: 24652 - DNA, 15 bp, Homo sapiens
cagcaaatgacctca

SEQ ID NO: 24653 - DNA, 15 bp, Homo sapiens
ccagcaaatgacctc

SEQ ID NO: 24654 - DNA, 15 bp, Homo sapiens
cccagcaaatgacct

SEQ ID NO: 24655 - DNA, 15 bp, Homo sapiens
acccagcaaatgacc

SEQ ID NO: 24656 - DNA, 15 bp, Homo sapiens
aacccagcaaatgac

SEQ ID NO: 24657 - DNA, 15 bp, Homo sapiens
gaacccagcaaatga

SEQ ID NO: 24658 - DNA, 15 bp, Homo sapiens
tgaacccagcaaatg

SEQ ID NO: 24659 - DNA, 15 bp, Homo sapiens
atgaacccagcaaat

SEQ ID NO: 24660 - DNA, 15 bp, Homo sapiens
catgaacccagcaaa

SEQ ID NO: 24661 - DNA, 15 bp, Homo sapiens
acatgaacccagcaa

SEQ ID NO: 24662 - DNA, 15 bp, Homo sapiens
aacatgaacccagca

SEQ ID NO: 24663 - DNA, 15 bp, Homo sapiens
aaacatgaacccagc

SEQ ID NO: 24664 - DNA, 15 bp, Homo sapiens
caaacatgaacccag

SEQ ID NO: 24665 - DNA, 15 bp, Homo sapiens
ccaaacatgaaccca

SEQ ID NO: 24666 - DNA, 15 bp, Homo sapiens
tccaaacatgaaccc

SEQ ID NO: 24667 - DNA, 15 bp, Homo sapiens
ttccaaacatgaacc

SEQ ID NO: 24668 - DNA, 15 bp, Homo sapiens
tttccaaacatgaac

SEQ ID NO: 24669 - DNA, 15 bp, Homo sapiens
ctttccaaacatgaa

SEQ ID NO: 24670 - DNA, 15 bp, Homo sapiens
gctttccaaacatga

SEQ ID NO: 24671 - DNA, 15 bp, Homo sapiens
cgctttccaaacatg

SEQ ID NO: 24672 - DNA, 15 bp, Homo sapiens
ccgctttccaaacat

SEQ ID NO: 24673 - DNA, 15 bp, Homo sapiens
gccgctttccaaaca

SEQ ID NO: 24674 - DNA, 15 bp, Homo sapiens
tgccgctttccaaac

SEQ ID NO: 24675 - DNA, 15 bp, Homo sapiens
ttgccgctttccaaa

SEQ ID NO: 24676 - DNA, 15 bp, Homo sapiens
tttgccgctttccaa

SEQ ID NO: 24677 - DNA, 15 bp, Homo sapiens
ctttgccgctttcca

SEQ ID NO: 24678 - DNA, 15 bp, Homo sapiens
cctttgccgctttcc

SEQ ID NO: 24679 - DNA, 15 bp, Homo sapiens
tcctttgccgctttc

SEQ ID NO: 24680 - DNA, 15 bp, Homo sapiens
atcctttgccgcttt

SEQ ID NO: 24681 - DNA, 15 bp, Homo sapiens
aatcctttgccgctt

SEQ ID NO: 24682 - DNA, 15 bp, Homo sapiens
aaatcctttgccgct

SEQ ID NO: 24683 - DNA, 15 bp, Homo sapiens
gaaatcctttgccgc

SEQ ID NO: 24684 - DNA, 15 bp, Homo sapiens
tgaaatcctttgccg

SEQ ID NO: 24685 - DNA, 15 bp, Homo sapiens
ctgaaatcctttgcc

SEQ ID NO: 24686 - DNA, 15 bp, Homo sapiens
actgaaatcctttgc

SEQ ID NO: 24687 - DNA, 15 bp, Homo sapiens
cactgaaatcctttg

SEQ ID NO: 24688 - DNA, 15 bp, Homo sapiens
gcactgaaatccttt

SEQ ID NO: 24689 - DNA, 15 bp, Homo sapiens
tgcactgaaatcctt

SEQ ID NO: 24690 - DNA, 15 bp, Homo sapiens
ctgcactgaaatcct

SEQ ID NO: 24691 - DNA, 15 bp, Homo sapiens
cctgcactgaaatcc

SEQ ID NO: 24692 - DNA, 15 bp, Homo sapiens
acctgcactgaaatc

SEQ ID NO: 24693 - DNA, 15 bp, Homo sapiens
aacctgcactgaaat

SEQ ID NO: 24694 - DNA, 15 bp, Homo sapiens
caacctgcactgaaa

SEQ ID NO: 24695 - DNA, 15 bp, Homo sapiens
ccaacctgcactgaa

SEQ ID NO: 24696 - DNA, 15 bp, Homo sapiens
gccaacctgcactga

SEQ ID NO: 24697 - DNA, 15 bp, Homo sapiens
agccaacctgcactg

SEQ ID NO: 24698 - DNA, 15 bp, Homo sapiens
cagccaacctgcact

SEQ ID NO: 24699 - DNA, 15 bp, Homo sapiens
ccagccaacctgcac

SEQ ID NO: 24700 - DNA, 15 bp, Homo sapiens
gccagccaacctgca

SEQ ID NO: 24701 - DNA, 15 bp, Homo sapiens
agccagccaacctgc

SEQ ID NO: 24702 - DNA, 15 bp, Homo sapiens
gagccagccaacctg

SEQ ID NO: 24703 - DNA, 15 bp, Homo sapiens
ggagccagccaacct

SEQ ID NO: 24704 - DNA, 15 bp, Homo sapiens
tggagccagccaacc

SEQ ID NO: 24705 - DNA, 15 bp, Homo sapiens
ttggagccagccaac

SEQ ID NO: 24706 - DNA, 15 bp, Homo sapiens
tttggagccagccaa

SEQ ID NO: 24707 - DNA, 15 bp, Homo sapiens
gtttggagccagcca

SEQ ID NO: 24708 - DNA, 15 bp, Homo sapiens
ggtttggagccagcc

SEQ ID NO: 24709 - DNA, 15 bp, Homo sapiens
aggtttggagccagc

SEQ ID NO: 24710 - DNA, 15 bp, Homo sapiens
caggtttggagccag

SEQ ID NO: 24711 - DNA, 15 bp, Homo sapiens
acaggtttggagcca

SEQ ID NO: 24712 - DNA, 15 bp, Homo sapiens
cacaggtttggagcc

SEQ ID NO: 24713 - DNA, 15 bp, Homo sapiens
acacaggtttggagc

SEQ ID NO: 24714 - DNA, 15 bp, Homo sapiens
cacacaggtttggag

SEQ ID NO: 24715 - DNA, 15 bp, Homo sapiens
acacacaggtttgga

SEQ ID NO: 24716 - DNA, 15 bp, Homo sapiens
cacacacaggtttgg

SEQ ID NO: 24717 - DNA, 15 bp, Homo sapiens
gcacacacaggtttg

SEQ ID NO: 24718 - DNA, 15 bp, Homo sapiens
agcacacacaggttt

SEQ ID NO: 24719 - DNA, 15 bp, Homo sapiens
aagcacacacaggtt

SEQ ID NO: 24720 - DNA, 15 bp, Homo sapiens
aaagcacacacaggt

SEQ ID NO: 24721 - DNA, 15 bp, Homo sapiens
gaaagcacacacagg

SEQ ID NO: 24722 - DNA, 15 bp, Homo sapiens
ggaaagcacacacag

SEQ ID NO: 24723 - DNA, 15 bp, Homo sapiens
tggaaagcacacaca

SEQ ID NO: 24724 - DNA, 15 bp, Homo sapiens
atggaaagcacacac

SEQ ID NO: 24725 - DNA, 15 bp, Homo sapiens
catggaaagcacaca

SEQ ID NO: 24726 - DNA, 15 bp, Homo sapiens
tcatggaaagcacac

SEQ ID NO: 24727 - DNA, 15 bp, Homo sapiens
gtcatggaaagcaca

SEQ ID NO: 24728 - DNA, 15 bp, Homo sapiens
tgtcatggaaagcac

SEQ ID NO: 24729 - DNA, 15 bp, Homo sapiens
gtgtcatggaaagca

SEQ ID NO: 24730 - DNA, 15 bp, Homo sapiens
agtgtcatggaaagc

SEQ ID NO: 24731 - DNA, 15 bp, Homo sapiens
cagtgtcatggaaag

SEQ ID NO: 24732 - DNA, 15 bp, Homo sapiens
acagtgtcatggaaa

SEQ ID NO: 24733 - DNA, 15 bp, Homo sapiens
tacagtgtcatggaa

SEQ ID NO: 24734 - DNA, 15 bp, Homo sapiens
gtacagtgtcatgga

SEQ ID NO: 24735 - DNA, 15 bp, Homo sapiens
agtacagtgtcatgg

SEQ ID NO: 24736 - DNA, 15 bp, Homo sapiens
cagtacagtgtcatg

SEQ ID NO: 24737 - DNA, 15 bp, Homo sapiens
acagtacagtgtcat

SEQ ID NO: 24738 - DNA, 15 bp, Homo sapiens
cacagtacagtgtca

SEQ ID NO: 24739 - DNA, 15 bp, Homo sapiens
acacagtacagtgtc

SEQ ID NO: 24740 - DNA, 15 bp, Homo sapiens
cacacagtacagtgt

SEQ ID NO: 24741 - DNA, 15 bp, Homo sapiens
gcacacagtacagtg

SEQ ID NO: 24742 - DNA, 15 bp, Homo sapiens
ggcacacagtacagt

SEQ ID NO: 24743 - DNA, 15 bp, Homo sapiens
aggcacacagtacag

SEQ ID NO: 24744 - DNA, 15 bp, Homo sapiens
gaggcacacagtaca

SEQ ID NO: 24745 - DNA, 15 bp, Homo sapiens
tgaggcacacagtac

SEQ ID NO: 24746 - DNA, 15 bp, Homo sapiens
atgaggcacacagta

SEQ ID NO: 24747 - DNA, 15 bp, Homo sapiens
aatgaggcacacagt

SEQ ID NO: 24748 - DNA, 15 bp, Homo sapiens
caatgaggcacacag

SEQ ID NO: 24749 - DNA, 15 bp, Homo sapiens
tcaatgaggcacaca

SEQ ID NO: 24750 - DNA, 15 bp, Homo sapiens
ctcaatgaggcacac

SEQ ID NO: 24751 - DNA, 15 bp, Homo sapiens
gctcaatgaggcaca

SEQ ID NO: 24752 - DNA, 15 bp, Homo sapiens
ggctcaatgaggcac

SEQ ID NO: 24753 - DNA, 15 bp, Homo sapiens
aggctcaatgaggca

SEQ ID NO: 24754 - DNA, 15 bp, Homo sapiens
gaggctcaatgaggc

SEQ ID NO: 24755 - DNA, 15 bp, Homo sapiens
tgaggctcaatgagg

SEQ ID NO: 24756 - DNA, 15 bp, Homo sapiens
atgaggctcaatgag

SEQ ID NO: 24757 - DNA, 15 bp, Homo sapiens
aatgaggctcaatga

SEQ ID NO: 24758 - DNA, 15 bp, Homo sapiens
gaatgaggctcaatg

SEQ ID NO: 24759 - DNA, 15 bp, Homo sapiens
agaatgaggctcaat

SEQ ID NO: 24760 - DNA, 15 bp, Homo sapiens
tagaatgaggctcaa

SEQ ID NO: 24761 - DNA, 15 bp, Homo sapiens
ctagaatgaggctca

SEQ ID NO: 24762 - DNA, 15 bp, Homo sapiens
tctagaatgaggctc

SEQ ID NO: 24763 - DNA, 15 bp, Homo sapiens
ttctagaatgaggct

SEQ ID NO: 24764 - DNA, 15 bp, Homo sapiens
tttctagaatgaggc

SEQ ID NO: 24765 - DNA, 15 bp, Homo sapiens
ttttctagaatgagg

SEQ ID NO: 24766 - DNA, 15 bp, Homo sapiens
gttttctagaatgag

SEQ ID NO: 24767 - DNA, 15 bp, Homo sapiens
ggttttctagaatga

SEQ ID NO: 24768 - DNA, 15 bp, Homo sapiens
tggttttctagaatg

SEQ ID NO: 24769 - DNA, 15 bp, Homo sapiens
ttggttttctagaat

SEQ ID NO: 24770 - DNA, 15 bp, Homo sapiens
tttggttttctagaa

SEQ ID NO: 24771 - DNA, 15 bp, Homo sapiens
ttttggttttctaga

SEQ ID NO: 24772 - DNA, 15 bp, Homo sapiens
tttttggttttctag

SEQ ID NO: 24773 - DNA, 15 bp, Homo sapiens
gtttttggttttcta

SEQ ID NO: 24774 - DNA, 15 bp, Homo sapiens
tgtttttggttttct

SEQ ID NO: 24775 - DNA, 15 bp, Homo sapiens
gtgtttttggttttc

SEQ ID NO: 24776 - DNA, 15 bp, Homo sapiens
tgtgtttttggtttt

SEQ ID NO: 24777 - DNA, 15 bp, Homo sapiens
gtgtgtttttggttt

SEQ ID NO: 24778 - DNA, 15 bp, Homo sapiens
ggtgtgtttttggtt

SEQ ID NO: 24779 - DNA, 15 bp, Homo sapiens
gggtgtgtttttggt

SEQ ID NO: 24780 - DNA, 15 bp, Homo sapiens
tgggtgtgtttttgg

SEQ ID NO: 24781 - DNA, 15 bp, Homo sapiens
ttgggtgtgtttttg

SEQ ID NO: 24782 - DNA, 15 bp, Homo sapiens
cttgggtgtgttttt

SEQ ID NO: 24783 - DNA, 15 bp, Homo sapiens
ccttgggtgtgtttt

SEQ ID NO: 24784 - DNA, 15 bp, Homo sapiens
gccttgggtgtgttt

SEQ ID NO: 24785 - DNA, 15 bp, Homo sapiens
ggccttgggtgtgtt

SEQ ID NO: 24786 - DNA, 15 bp, Homo sapiens
gggccttgggtgtgt

SEQ ID NO: 24787 - DNA, 15 bp, Homo sapiens
cgggccttgggtgtg

SEQ ID NO: 24788 - DNA, 15 bp, Homo sapiens
ccgggccttgggtgt

SEQ ID NO: 24789 - DNA, 15 bp, Homo sapiens
gccgggccttgggtg

SEQ ID NO: 24790 - DNA, 15 bp, Homo sapiens
ggccgggccttgggt

SEQ ID NO: 24791 - DNA, 15 bp, Homo sapiens
aggccgggccttggg

SEQ ID NO: 24792 - DNA, 15 bp, Homo sapiens
aaggccgggccttgg

SEQ ID NO: 24793 - DNA, 15 bp, Homo sapiens
gaaggccgggccttg

SEQ ID NO: 24794 - DNA, 15 bp, Homo sapiens
tgaaggccgggcctt

SEQ ID NO: 24795 - DNA, 15 bp, Homo sapiens
gtgaaggccgggcct

SEQ ID NO: 24796 - DNA, 15 bp, Homo sapiens
tgtgaaggccgggcc

SEQ ID NO: 24797 - DNA, 15 bp, Homo sapiens
ttgtgaaggccgggc

SEQ ID NO: 24798 - DNA, 15 bp, Homo sapiens
tttgtgaaggccggg

SEQ ID NO: 24799 - DNA, 15 bp, Homo sapiens
ctttgtgaaggccgg

SEQ ID NO: 24800 - DNA, 15 bp, Homo sapiens
cctttgtgaaggccg

SEQ ID NO: 24801 - DNA, 15 bp, Homo sapiens
tcctttgtgaaggcc

SEQ ID NO: 24802 - DNA, 15 bp, Homo sapiens
ctcctttgtgaaggc

SEQ ID NO: 24803 - DNA, 15 bp, Homo sapiens
tctcctttgtgaagg

SEQ ID NO: 24804 - DNA, 15 bp, Homo sapiens
gtctcctttgtgaag

SEQ ID NO: 24805 - DNA, 15 bp, Homo sapiens
ggtctcctttgtgaa

SEQ ID NO: 24806 - DNA, 15 bp, Homo sapiens
gggtctcctttgtga

SEQ ID NO: 24807 - DNA, 15 bp, Homo sapiens
ggggtctcctttgtg

SEQ ID NO: 24808 - DNA, 15 bp, Homo sapiens
aggggtctcctttgt

SEQ ID NO: 24809 - DNA, 15 bp, Homo sapiens
gaggggtctcctttg

SEQ ID NO: 24810 - DNA, 15 bp, Homo sapiens
ggaggggtctccttt

SEQ ID NO: 24811 - DNA, 15 bp, Homo sapiens
gggaggggtctcctt

SEQ ID NO: 24812 - DNA, 15 bp, Homo sapiens
ggggaggggtctcct

SEQ ID NO: 24813 - DNA, 15 bp, Homo sapiens
gggggaggggtctcc

SEQ ID NO: 24814 - DNA, 15 bp, Homo sapiens
tgggggaggggtctc

SEQ ID NO: 24815 - DNA, 15 bp, Homo sapiens
atgggggaggggtct

SEQ ID NO: 24816 - DNA, 15 bp, Homo sapiens
aatgggggaggggtc

SEQ ID NO: 24817 - DNA, 15 bp, Homo sapiens
aaatgggggaggggt

SEQ ID NO: 24818 - DNA, 15 bp, Homo sapiens
caaatgggggagggg

SEQ ID NO: 24819 - DNA, 15 bp, Homo sapiens
ccaaatgggggaggg

SEQ ID NO: 24820 - DNA, 15 bp, Homo sapiens
gccaaatgggggagg

SEQ ID NO: 24821 - DNA, 15 bp, Homo sapiens
agccaaatgggggag

SEQ ID NO: 24822 - DNA, 15 bp, Homo sapiens
gagccaaatggggga

SEQ ID NO: 24823 - DNA, 15 bp, Homo sapiens
ggagccaaatggggg

SEQ ID NO: 24824 - DNA, 15 bp, Homo sapiens
gggagccaaatgggg

SEQ ID NO: 24825 - DNA, 15 bp, Homo sapiens
agggagccaaatggg

SEQ ID NO: 24826 - DNA, 15 bp, Homo sapiens
aagggagccaaatgg

SEQ ID NO: 24827 - DNA, 15 bp, Homo sapiens
aaagggagccaaatg

SEQ ID NO: 24828 - DNA, 15 bp, Homo sapiens
gaaagggagccaaat

SEQ ID NO: 24829 - DNA, 15 bp, Homo sapiens
ggaaagggagccaaa

SEQ ID NO: 24830 - DNA, 15 bp, Homo sapiens
tggaaagggagccaa

SEQ ID NO: 24831 - DNA, 15 bp, Homo sapiens
ctggaaagggagcca

SEQ ID NO: 24832 - DNA, 15 bp, Homo sapiens
gctggaaagggagcc

SEQ ID NO: 24833 - DNA, 15 bp, Homo sapiens
tgctggaaagggagc

SEQ ID NO: 24834 - DNA, 15 bp, Homo sapiens
ctgctggaaagggag

SEQ ID NO: 24835 - DNA, 15 bp, Homo sapiens
actgctggaaaggga

SEQ ID NO: 24836 - DNA, 15 bp, Homo sapiens
gactgctggaaaggg

SEQ ID NO: 24837 - DNA, 15 bp, Homo sapiens
cgactgctggaaagg

SEQ ID NO: 24838 - DNA, 15 bp, Homo sapiens
tcgactgctggaaag

SEQ ID NO: 24839 - DNA, 15 bp, Homo sapiens
gtcgactgctggaaa

SEQ ID NO: 24840 - DNA, 15 bp, Homo sapiens
cgtcgactgctggaa

SEQ ID NO: 24841 - DNA, 15 bp, Homo sapiens
ccgtcgactgctgga

SEQ ID NO: 24842 - DNA, 15 bp, Homo sapiens
gccgtcgactgctgg

SEQ ID NO: 24843 - DNA, 15 bp, Homo sapiens
ggccgtcgactgctg

SEQ ID NO: 24844 - DNA, 15 bp, Homo sapiens
aggccgtcgactgct

SEQ ID NO: 24845 - DNA, 15 bp, Homo sapiens
gaggccgtcgactgc

SEQ ID NO: 24846 - DNA, 15 bp, Homo sapiens
agaggccgtcgactg

SEQ ID NO: 24847 - DNA, 15 bp, Homo sapiens
aagaggccgtcgact

SEQ ID NO: 24848 - DNA, 15 bp, Homo sapiens
caagaggccgtcgac

SEQ ID NO: 24849 - DNA, 15 bp, Homo sapiens
acaagaggccgtcga

SEQ ID NO: 24850 - DNA, 15 bp, Homo sapiens
gacaagaggccgtcg

SEQ ID NO: 24851 - DNA, 15 bp, Homo sapiens
tgacaagaggccgtc

SEQ ID NO: 24852 - DNA, 15 bp, Homo sapiens
ctgacaagaggccgt

SEQ ID NO: 24853 - DNA, 15 bp, Homo sapiens
gctgacaagaggccg

SEQ ID NO: 24854 - DNA, 15 bp, Homo sapiens
ggctgacaagaggcc

SEQ ID NO: 24855 - DNA, 15 bp, Homo sapiens
tggctgacaagaggc

SEQ ID NO: 24856 - DNA, 15 bp, Homo sapiens
atggctgacaagagg

SEQ ID NO: 24857 - DNA, 15 bp, Homo sapiens
gatggctgacaagag

SEQ ID NO: 24858 - DNA, 15 bp, Homo sapiens
cgatggctgacaaga

SEQ ID NO: 24859 - DNA, 15 bp, Homo sapiens
tcgatggctgacaag

SEQ ID NO: 24860 - DNA, 15 bp, Homo sapiens
ctcgatggctgacaa

SEQ ID NO: 24861 - DNA, 15 bp, Homo sapiens
gctcgatggctgaca

SEQ ID NO: 24862 - DNA, 15 bp, Homo sapiens
ggctcgatggctgac

SEQ ID NO: 24863 - DNA, 15 bp, Homo sapiens
gggctcgatggctga

SEQ ID NO: 24864 - DNA, 15 bp, Homo sapiens
tgggctcgatggctg

SEQ ID NO: 24865 - DNA, 15 bp, Homo sapiens
ctgggctcgatggct

SEQ ID NO: 24866 - DNA, 15 bp, Homo sapiens
tctgggctcgatggc

SEQ ID NO: 24867 - DNA, 15 bp, Homo sapiens
ctctgggctcgatgg

SEQ ID NO: 24868 - DNA, 15 bp, Homo sapiens
actctgggctcgatg

SEQ ID NO: 24869 - DNA, 15 bp, Homo sapiens
gactctgggctcgat

SEQ ID NO: 24870 - DNA, 15 bp, Homo sapiens
ggactctgggctcga

SEQ ID NO: 24871 - DNA, 15 bp, Homo sapiens
gggactctgggctcg

SEQ ID NO: 24872 - DNA, 15 bp, Homo sapiens
agggactctgggctc

SEQ ID NO: 24873 - DNA, 15 bp, Homo sapiens
aagggactctgggct

SEQ ID NO: 24874 - DNA, 15 bp, Homo sapiens
caagggactctgggc

SEQ ID NO: 24875 - DNA, 15 bp, Homo sapiens
tcaagggactctggg

SEQ ID NO: 24876 - DNA, 15 bp, Homo sapiens
ttcaagggactctgg

SEQ ID NO: 24877 - DNA, 15 bp, Homo sapiens
cttcaagggactctg

SEQ ID NO: 24878 - DNA, 15 bp, Homo sapiens
acttcaagggactct

SEQ ID NO: 24879 - DNA, 15 bp, Homo sapiens
cacttcaagggactc

SEQ ID NO: 24880 - DNA, 15 bp, Homo sapiens
gcacttcaagggact

SEQ ID NO: 24881 - DNA, 15 bp, Homo sapiens
cgcacttcaagggac

SEQ ID NO: 24882 - DNA, 15 bp, Homo sapiens
tcgcacttcaaggga

SEQ ID NO: 24883 - DNA, 15 bp, Homo sapiens
gtcgcacttcaaggg

SEQ ID NO: 24884 - DNA, 15 bp, Homo sapiens
agtcgcacttcaagg

SEQ ID NO: 24885 - DNA, 15 bp, Homo sapiens
gagtcgcacttcaag

SEQ ID NO: 24886 - DNA, 15 bp, Homo sapiens
tgagtcgcacttcaa

SEQ ID NO: 24887 - DNA, 15 bp, Homo sapiens
atgagtcgcacttca

SEQ ID NO: 24888 - DNA, 15 bp, Homo sapiens
catgagtcgcacttc

SEQ ID NO: 24889 - DNA, 15 bp, Homo sapiens
gcatgagtcgcactt

SEQ ID NO: 24890 - DNA, 15 bp, Homo sapiens
agcatgagtcgcact

SEQ ID NO: 24891 - DNA, 15 bp, Homo sapiens
cagcatgagtcgcac

SEQ ID NO: 24892 - DNA, 15 bp, Homo sapiens
ccagcatgagtcgca

SEQ ID NO: 24893 - DNA, 15 bp, Homo sapiens
cccagcatgagtcgc

SEQ ID NO: 24894 - DNA, 15 bp, Homo sapiens
ccccagcatgagtcg

SEQ ID NO: 24895 - DNA, 15 bp, Homo sapiens
accccagcatgagtc

SEQ ID NO: 24896 - DNA, 15 bp, Homo sapiens
caccccagcatgagt

SEQ ID NO: 24897 - DNA, 15 bp, Homo sapiens
ccaccccagcatgag

SEQ ID NO: 24898 - DNA, 15 bp, Homo sapiens
accaccccagcatga

SEQ ID NO: 24899 - DNA, 15 bp, Homo sapiens
taccaccccagcatg

SEQ ID NO: 24900 - DNA, 15 bp, Homo sapiens
ataccaccccagcat

SEQ ID NO: 24901 - DNA, 15 bp, Homo sapiens
cataccaccccagca

SEQ ID NO: 24902 - DNA, 15 bp, Homo sapiens
gcataccaccccagc

SEQ ID NO: 24903 - DNA, 15 bp, Homo sapiens
agcataccaccccag

SEQ ID NO: 24904 - DNA, 15 bp, Homo sapiens
gagcataccacccca

SEQ ID NO: 24905 - DNA, 15 bp, Homo sapiens
tgagcataccacccc

SEQ ID NO: 24906 - DNA, 15 bp, Homo sapiens
ctgagcataccaccc

SEQ ID NO: 24907 - DNA, 15 bp, Homo sapiens
cctgagcataccacc

SEQ ID NO: 24908 - DNA, 15 bp, Homo sapiens
tcctgagcataccac

SEQ ID NO: 24909 - DNA, 15 bp, Homo sapiens
ctcctgagcatacca

SEQ ID NO: 24910 - DNA, 15 bp, Homo sapiens
gctcctgagcatacc

SEQ ID NO: 24911 - DNA, 15 bp, Homo sapiens
ggctcctgagcatac

SEQ ID NO: 24912 - DNA, 15 bp, Homo sapiens
cggctcctgagcata

SEQ ID NO: 24913 - DNA, 15 bp, Homo sapiens
gcggctcctgagcat

SEQ ID NO: 24914 - DNA, 15 bp, Homo sapiens
tgcggctcctgagca

SEQ ID NO: 24915 - DNA, 15 bp, Homo sapiens
ctgcggctcctgagc

SEQ ID NO: 24916 - DNA, 15 bp, Homo sapiens
actgcggctcctgag

SEQ ID NO: 24917 - DNA, 15 bp, Homo sapiens
cactgcggctcctga

SEQ ID NO: 24918 - DNA, 15 bp, Homo sapiens
acactgcggctcctg

SEQ ID NO: 24919 - DNA, 15 bp, Homo sapiens
aacactgcggctcct

SEQ ID NO: 24920 - DNA, 15 bp, Homo sapiens
aaacactgcggctcc

SEQ ID NO: 24921 - DNA, 15 bp, Homo sapiens
gaaacactgcggctc

SEQ ID NO: 24922 - DNA, 15 bp, Homo sapiens
ggaaacactgcggct

SEQ ID NO: 24923 - DNA, 15 bp, Homo sapiens
cggaaacactgcggc

SEQ ID NO: 24924 - DNA, 15 bp, Homo sapiens
gcggaaacactgcgg

SEQ ID NO: 24925 - DNA, 15 bp, Homo sapiens
agcggaaacactgcg

SEQ ID NO: 24926 - DNA, 15 bp, Homo sapiens
gagcggaaacactgc

SEQ ID NO: 24927 - DNA, 15 bp, Homo sapiens
tgagcggaaacactg

SEQ ID NO: 24928 - DNA, 15 bp, Homo sapiens
ctgagcggaaacact

SEQ ID NO: 24929 - DNA, 15 bp, Homo sapiens
tctgagcggaaacac

SEQ ID NO: 24930 - DNA, 15 bp, Homo sapiens
ctctgagcggaaaca

SEQ ID NO: 24931 - DNA, 15 bp, Homo sapiens
cctctgagcggaaac

SEQ ID NO: 24932 - DNA, 15 bp, Homo sapiens
tcctctgagcggaaa

SEQ ID NO: 24933 - DNA, 15 bp, Homo sapiens
ttcctctgagcggaa

SEQ ID NO: 24934 - DNA, 15 bp, Homo sapiens
tttcctctgagcgga

SEQ ID NO: 24935 - DNA, 15 bp, Homo sapiens
ctttcctctgagcgg

SEQ ID NO: 24936 - DNA, 15 bp, Homo sapiens
cctttcctctgagcg

SEQ ID NO: 24937 - DNA, 15 bp, Homo sapiens
ccctttcctctgagc

SEQ ID NO: 24938 - DNA, 15 bp, Homo sapiens
gccctttcctctgag

SEQ ID NO: 24939 - DNA, 15 bp, Homo sapiens
agccctttcctctga

SEQ ID NO: 24940 - DNA, 15 bp, Homo sapiens
gagccctttcctctg

SEQ ID NO: 24941 - DNA, 15 bp, Homo sapiens
agagccctttcctct

SEQ ID NO: 24942 - DNA, 15 bp, Homo sapiens
cagagccctttcctc

SEQ ID NO: 24943 - DNA, 15 bp, Homo sapiens
tcagagccctttcct

SEQ ID NO: 24944 - DNA, 15 bp, Homo sapiens
atcagagccctttcc

SEQ ID NO: 24945 - DNA, 15 bp, Homo sapiens
aatcagagccctttc

SEQ ID NO: 24946 - DNA, 15 bp, Homo sapiens
gaatcagagcccttt

SEQ ID NO: 24947 - DNA, 15 bp, Homo sapiens
agaatcagagccctt

SEQ ID NO: 24948 - DNA, 15 bp, Homo sapiens
gagaatcagagccct

SEQ ID NO: 24949 - DNA, 15 bp, Homo sapiens
ggagaatcagagccc

SEQ ID NO: 24950 - DNA, 15 bp, Homo sapiens
aggagaatcagagcc

SEQ ID NO: 24951 - DNA, 15 bp, Homo sapiens
caggagaatcagagc

SEQ ID NO: 24952 - DNA, 15 bp, Homo sapiens
gcaggagaatcagag

SEQ ID NO: 24953 - DNA, 15 bp, Homo sapiens
tgcaggagaatcaga

SEQ ID NO: 24954 - DNA, 15 bp, Homo sapiens
ctgcaggagaatcag

SEQ ID NO: 24955 - DNA, 15 bp, Homo sapiens
actgcaggagaatca

SEQ ID NO: 24956 - DNA, 15 bp, Homo sapiens
cactgcaggagaatc

SEQ ID NO: 24957 - DNA, 15 bp, Homo sapiens
gcactgcaggagaat

SEQ ID NO: 24958 - DNA, 15 bp, Homo sapiens
agcactgcaggagaa

SEQ ID NO: 24959 - DNA, 15 bp, Homo sapiens
tagcactgcaggaga

SEQ ID NO: 24960 - DNA, 15 bp, Homo sapiens
ctagcactgcaggag

SEQ ID NO: 24961 - DNA, 15 bp, Homo sapiens
cctagcactgcagga

SEQ ID NO: 24962 - DNA, 15 bp, Homo sapiens
tcctagcactgcagg

SEQ ID NO: 24963 - DNA, 15 bp, Homo sapiens
ctcctagcactgcag

SEQ ID NO: 24964 - DNA, 15 bp, Homo sapiens
tctcctagcactgca

SEQ ID NO: 24965 - DNA, 15 bp, Homo sapiens
gtctcctagcactgc

SEQ ID NO: 24966 - DNA, 15 bp, Homo sapiens
agtctcctagcactg

SEQ ID NO: 24967 - DNA, 15 bp, Homo sapiens
aagtctcctagcact

SEQ ID NO: 24968 - DNA, 15 bp, Homo sapiens
caagtctcctagcac

SEQ ID NO: 24969 - DNA, 15 bp, Homo sapiens
acaagtctcctagca

SEQ ID NO: 24970 - DNA, 15 bp, Homo sapiens
cacaagtctcctagc

SEQ ID NO: 24971 - DNA, 15 bp, Homo sapiens
ccacaagtctcctag

SEQ ID NO: 24972 - DNA, 15 bp, Homo sapiens
cccacaagtctccta

SEQ ID NO: 24973 - DNA, 15 bp, Homo sapiens
acccacaagtctcct

SEQ ID NO: 24974 - DNA, 15 bp, Homo sapiens
cacccacaagtctcc

SEQ ID NO: 24975 - DNA, 15 bp, Homo sapiens
ccacccacaagtctc

SEQ ID NO: 24976 - DNA, 15 bp, Homo sapiens
gccacccacaagtct

SEQ ID NO: 24977 - DNA, 15 bp, Homo sapiens
ggccacccacaagtc

SEQ ID NO: 24978 - DNA, 15 bp, Homo sapiens
tggccacccacaagt

SEQ ID NO: 24979 - DNA, 15 bp, Homo sapiens
gtggccacccacaag

SEQ ID NO: 24980 - DNA, 15 bp, Homo sapiens
tgtggccacccacaa

SEQ ID NO: 24981 - DNA, 15 bp, Homo sapiens
ctgtggccacccaca

SEQ ID NO: 24982 - DNA, 15 bp, Homo sapiens
actgtggccacccac

SEQ ID NO: 24983 - DNA, 15 bp, Homo sapiens
cactgtggccaccca

SEQ ID NO: 24984 - DNA, 15 bp, Homo sapiens
gcactgtggccaccc

SEQ ID NO: 24985 - DNA, 15 bp, Homo sapiens
tgcactgtggccacc

SEQ ID NO: 24986 - DNA, 15 bp, Homo sapiens
ctgcactgtggccac

SEQ ID NO: 24987 - DNA, 15 bp, Homo sapiens
cctgcactgtggcca

SEQ ID NO: 24988 - DNA, 15 bp, Homo sapiens
acctgcactgtggcc

SEQ ID NO: 24989 - DNA, 15 bp, Homo sapiens
gacctgcactgtggc

SEQ ID NO: 24990 - DNA, 15 bp, Homo sapiens
tgacctgcactgtgg

SEQ ID NO: 24991 - DNA, 15 bp, Homo sapiens
ctgacctgcactgtg

SEQ ID NO: 24992 - DNA, 15 bp, Homo sapiens
cctgacctgcactgt

SEQ ID NO: 24993 - DNA, 15 bp, Homo sapiens
gcctgacctgcactg

SEQ ID NO: 24994 - DNA, 15 bp, Homo sapiens
tgcctgacctgcact

SEQ ID NO: 24995 - DNA, 15 bp, Homo sapiens
gtgcctgacctgcac

SEQ ID NO: 24996 - DNA, 15 bp, Homo sapiens
tgtgcctgacctgca

SEQ ID NO: 24997 - DNA, 15 bp, Homo sapiens
gtgtgcctgacctgc

SEQ ID NO: 24998 - DNA, 15 bp, Homo sapiens
ggtgtgcctgacctg

SEQ ID NO: 24999 - DNA, 15 bp, Homo sapiens
cggtgtgcctgacct

SEQ ID NO: 25000 - DNA, 15 bp, Homo sapiens
ccggtgtgcctgacc

SEQ ID NO: 25001 - DNA, 15 bp, Homo sapiens
gccggtgtgcctgac

SEQ ID NO: 25002 - DNA, 15 bp, Homo sapiens
ggccggtgtgcctga

SEQ ID NO: 25003 - DNA, 15 bp, Homo sapiens
tggccggtgtgcctg

SEQ ID NO: 25004 - DNA, 15 bp, Homo sapiens
ctggccggtgtgcct

SEQ ID NO: 25005 - DNA, 15 bp, Homo sapiens
gctggccggtgtgcc

SEQ ID NO: 25006 - DNA, 15 bp, Homo sapiens
tgctggccggtgtgc

SEQ ID NO: 25007 - DNA, 15 bp, Homo sapiens
gtgctggccggtgtg

SEQ ID NO: 25008 - DNA, 15 bp, Homo sapiens
ggtgctggccggtgt

SEQ ID NO: 25009 - DNA, 15 bp, Homo sapiens
tggtgctggccggtg

SEQ ID NO: 25010 - DNA, 15 bp, Homo sapiens
gtggtgctggccggt

SEQ ID NO: 25011 - DNA, 15 bp, Homo sapiens
ggtggtgctggccgg

SEQ ID NO: 25012 - DNA, 15 bp, Homo sapiens
gggtggtgctggccg

SEQ ID NO: 25013 - DNA, 15 bp, Homo sapiens
tgggtggtgctggcc

SEQ ID NO: 25014 - DNA, 15 bp, Homo sapiens
gtgggtggtgctggc

SEQ ID NO: 25015 - DNA, 15 bp, Homo sapiens
tgtgggtggtgctgg

SEQ ID NO: 25016 - DNA, 15 bp, Homo sapiens
ctgtgggtggtgctg

SEQ ID NO: 25017 - DNA, 15 bp, Homo sapiens
gctgtgggtggtgct

SEQ ID NO: 25018 - DNA, 15 bp, Homo sapiens
ggctgtgggtggtgc

SEQ ID NO: 25019 - DNA, 15 bp, Homo sapiens
gggctgtgggtggtg

SEQ ID NO: 25020 - DNA, 15 bp, Homo sapiens
tgggctgtgggtggt

SEQ ID NO: 25021 - DNA, 15 bp, Homo sapiens
ttgggctgtgggtgg

SEQ ID NO: 25022 - DNA, 15 bp, Homo sapiens
tttgggctgtgggtg

SEQ ID NO: 25023 - DNA, 15 bp, Homo sapiens
atttgggctgtgggt

SEQ ID NO: 25024 - DNA, 15 bp, Homo sapiens
aatttgggctgtggg

SEQ ID NO: 25025 - DNA, 15 bp, Homo sapiens
gaatttgggctgtgg

SEQ ID NO: 25026 - DNA, 15 bp, Homo sapiens
ggaatttgggctgtg

SEQ ID NO: 25027 - DNA, 15 bp, Homo sapiens
aggaatttgggctgt

SEQ ID NO: 25028 - DNA, 15 bp, Homo sapiens
taggaatttgggctg

SEQ ID NO: 25029 - DNA, 15 bp, Homo sapiens
ttaggaatttgggct

SEQ ID NO: 25030 - DNA, 15 bp, Homo sapiens
tttaggaatttgggc

SEQ ID NO: 25031 - DNA, 15 bp, Homo sapiens
ctttaggaatttggg

SEQ ID NO: 25032 - DNA, 15 bp, Homo sapiens
tctttaggaatttgg

SEQ ID NO: 25033 - DNA, 15 bp, Homo sapiens
ttctttaggaatttg

SEQ ID NO: 25034 - DNA, 15 bp, Homo sapiens
tttctttaggaattt

SEQ ID NO: 25035 - DNA, 15 bp, Homo sapiens
atttctttaggaatt

SEQ ID NO: 25036 - DNA, 15 bp, Homo sapiens
tatttctttaggaat

SEQ ID NO: 25037 - DNA, 15 bp, Homo sapiens
atatttctttaggaa

SEQ ID NO: 25038 - DNA, 15 bp, Homo sapiens
aatatttctttagga

SEQ ID NO: 25039 - DNA, 15 bp, Homo sapiens
aaatatttctttagg

SEQ ID NO: 25040 - DNA, 15 bp, Homo sapiens
caaatatttctttag

SEQ ID NO: 25041 - DNA, 15 bp, Homo sapiens
ccaaatatttcttta

SEQ ID NO: 25042 - DNA, 15 bp, Homo sapiens
cccaaatatttcttt

SEQ ID NO: 25043 - DNA, 15 bp, Homo sapiens
acccaaatatttctt

SEQ ID NO: 25044 - DNA, 15 bp, Homo sapiens
gacccaaatatttct

SEQ ID NO: 25045 - DNA, 15 bp, Homo sapiens
ggacccaaatatttc

SEQ ID NO: 25046 - DNA, 15 bp, Homo sapiens
gggacccaaatattt

SEQ ID NO: 25047 - DNA, 15 bp, Homo sapiens
tgggacccaaatatt

SEQ ID NO: 25048 - DNA, 15 bp, Homo sapiens
ctgggacccaaatat

SEQ ID NO: 25049 - DNA, 15 bp, Homo sapiens
gctgggacccaaata

SEQ ID NO: 25050 - DNA, 15 bp, Homo sapiens
agctgggacccaaat

SEQ ID NO: 25051 - DNA, 15 bp, Homo sapiens
aagctgggacccaaa

SEQ ID NO: 25052 - DNA, 15 bp, Homo sapiens
caagctgggacccaa

SEQ ID NO: 25053 - DNA, 15 bp, Homo sapiens
ccaagctgggaccca

SEQ ID NO: 25054 - DNA, 15 bp, Homo sapiens
gccaagctgggaccc

SEQ ID NO: 25055 - DNA, 15 bp, Homo sapiens
ggccaagctgggacc

SEQ ID NO: 25056 - DNA, 15 bp, Homo sapiens
gggccaagctgggac

SEQ ID NO: 25057 - DNA, 15 bp, Homo sapiens
cgggccaagctggga

SEQ ID NO: 25058 - DNA, 15 bp, Homo sapiens
tcgggccaagctggg

SEQ ID NO: 25059 - DNA, 15 bp, Homo sapiens
ctcgggccaagctgg

SEQ ID NO: 25060 - DNA, 15 bp, Homo sapiens
actcgggccaagctg

SEQ ID NO: 25061 - DNA, 15 bp, Homo sapiens
gactcgggccaagct

SEQ ID NO: 25062 - DNA, 15 bp, Homo sapiens
agactcgggccaagc

SEQ ID NO: 25063 - DNA, 15 bp, Homo sapiens
gagactcgggccaag

SEQ ID NO: 25064 - DNA, 15 bp, Homo sapiens
agagactcgggccaa

SEQ ID NO: 25065 - DNA, 15 bp, Homo sapiens
cagagactcgggcca

SEQ ID NO: 25066 - DNA, 15 bp, Homo sapiens
acagagactcgggcc

SEQ ID NO: 25067 - DNA, 15 bp, Homo sapiens
aacagagactcgggc

SEQ ID NO: 25068 - DNA, 15 bp, Homo sapiens
caacagagactcggg

SEQ ID NO: 25069 - DNA, 15 bp, Homo sapiens
acaacagagactcgg

SEQ ID NO: 25070 - DNA, 15 bp, Homo sapiens
gacaacagagactcg

SEQ ID NO: 25071 - DNA, 15 bp, Homo sapiens
ggacaacagagactc

SEQ ID NO: 25072 - DNA, 15 bp, Homo sapiens
aggacaacagagact

SEQ ID NO: 25073 - DNA, 15 bp, Homo sapiens
caggacaacagagac

SEQ ID NO: 25074 - DNA, 15 bp, Homo sapiens
ccaggacaacagaga

SEQ ID NO: 25075 - DNA, 15 bp, Homo sapiens
cccaggacaacagag

SEQ ID NO: 25076 - DNA, 15 bp, Homo sapiens
ccccaggacaacaga

SEQ ID NO: 25077 - DNA, 15 bp, Homo sapiens
tccccaggacaacag

SEQ ID NO: 25078 - DNA, 15 bp, Homo sapiens
ttccccaggacaaca

SEQ ID NO: 25079 - DNA, 15 bp, Homo sapiens
cttccccaggacaac

SEQ ID NO: 25080 - DNA, 15 bp, Homo sapiens
ccttccccaggacaa

SEQ ID NO: 25081 - DNA, 15 bp, Homo sapiens
tccttccccaggaca

SEQ ID NO: 25082 - DNA, 15 bp, Homo sapiens
gtccttccccaggac

SEQ ID NO: 25083 - DNA, 15 bp, Homo sapiens
tgtccttccccagga

SEQ ID NO: 25084 - DNA, 15 bp, Homo sapiens
atgtccttccccagg

SEQ ID NO: 25085 - DNA, 15 bp, Homo sapiens
gatgtccttccccag

SEQ ID NO: 25086 - DNA, 15 bp, Homo sapiens
tgatgtccttcccca

SEQ ID NO: 25087 - DNA, 15 bp, Homo sapiens
ttgatgtccttcccc

SEQ ID NO: 25088 - DNA, 15 bp, Homo sapiens
cttgatgtccttccc

SEQ ID NO: 25089 - DNA, 15 bp, Homo sapiens
tcttgatgtccttcc

SEQ ID NO: 25090 - DNA, 15 bp, Homo sapiens
atcttgatgtccttc

SEQ ID NO: 25091 - DNA, 15 bp, Homo sapiens
gatcttgatgtcctt

SEQ ID NO: 25092 - DNA, 15 bp, Homo sapiens
agatcttgatgtcct

SEQ ID NO: 25093 - DNA, 15 bp, Homo sapiens
cagatcttgatgtcc

SEQ ID NO: 25094 - DNA, 15 bp, Homo sapiens
tcagatcttgatgtc

SEQ ID NO: 25095 - DNA, 15 bp, Homo sapiens
ctcagatcttgatgt

SEQ ID NO: 25096 - DNA, 15 bp, Homo sapiens
actcagatcttgatg

SEQ ID NO: 25097 - DNA, 15 bp, Homo sapiens
cactcagatcttgat

SEQ ID NO: 25098 - DNA, 15 bp, Homo sapiens
acactcagatcttga

SEQ ID NO: 25099 - DNA, 15 bp, Homo sapiens
tacactcagatcttg

SEQ ID NO: 25100 - DNA, 15 bp, Homo sapiens
atacactcagatctt

SEQ ID NO: 25101 - DNA, 15 bp, Homo sapiens
catacactcagatct

SEQ ID NO: 25102 - DNA, 15 bp, Homo sapiens
tcatacactcagatc

SEQ ID NO: 25103 - DNA, 15 bp, Homo sapiens
atcatacactcagat

SEQ ID NO: 25104 - DNA, 15 bp, Homo sapiens
catcatacactcaga

SEQ ID NO: 25105 - DNA, 15 bp, Homo sapiens
ccatcatacactcag

SEQ ID NO: 25106 - DNA, 15 bp, Homo sapiens
gccatcatacactca

SEQ ID NO: 25107 - DNA, 15 bp, Homo sapiens
ggccatcatacactc

SEQ ID NO: 25108 - DNA, 15 bp, Homo sapiens
aggccatcatacact

SEQ ID NO: 25109 - DNA, 15 bp, Homo sapiens
caggccatcatacac

SEQ ID NO: 25110 - DNA, 15 bp, Homo sapiens
ccaggccatcataca

SEQ ID NO: 25111 - DNA, 15 bp, Homo sapiens
cccaggccatcatac

SEQ ID NO: 25112 - DNA, 15 bp, Homo sapiens
ccccaggccatcata

SEQ ID NO: 25113 - DNA, 15 bp, Homo sapiens
gccccaggccatcat

SEQ ID NO: 25114 - DNA, 15 bp, Homo sapiens
ggccccaggccatca

SEQ ID NO: 25115 - DNA, 15 bp, Homo sapiens
aggccccaggccatc

SEQ ID NO: 25116 - DNA, 15 bp, Homo sapiens
aaggccccaggccat

SEQ ID NO: 25117 - DNA, 15 bp, Homo sapiens
caaggccccaggcca

SEQ ID NO: 25118 - DNA, 15 bp, Homo sapiens
gcaaggccccaggcc

SEQ ID NO: 25119 - DNA, 15 bp, Homo sapiens
tgcaaggccccaggc

SEQ ID NO: 25120 - DNA, 15 bp, Homo sapiens
atgcaaggccccagg

SEQ ID NO: 25121 - DNA, 15 bp, Homo sapiens
catgcaaggccccag

SEQ ID NO: 25122 - DNA, 15 bp, Homo sapiens
acatgcaaggcccca

SEQ ID NO: 25123 - DNA, 15 bp, Homo sapiens
cacatgcaaggcccc

SEQ ID NO: 25124 - DNA, 15 bp, Homo sapiens
ccacatgcaaggccc

SEQ ID NO: 25125 - DNA, 15 bp, Homo sapiens
accacatgcaaggcc

SEQ ID NO: 25126 - DNA, 15 bp, Homo sapiens
caccacatgcaaggc

SEQ ID NO: 25127 - DNA, 15 bp, Homo sapiens
ccaccacatgcaagg

SEQ ID NO: 25128 - DNA, 15 bp, Homo sapiens
cccaccacatgcaag

SEQ ID NO: 25129 - DNA, 15 bp, Homo sapiens
ccccaccacatgcaa

SEQ ID NO: 25130 - DNA, 15 bp, Homo sapiens
cccccaccacatgca

SEQ ID NO: 25131 - DNA, 15 bp, Homo sapiens
acccccaccacatgc

SEQ ID NO: 25132 - DNA, 15 bp, Homo sapiens
gacccccaccacatg

SEQ ID NO: 25133 - DNA, 15 bp, Homo sapiens
ggacccccaccacat

SEQ ID NO: 25134 - DNA, 15 bp, Homo sapiens
tggacccccaccaca

SEQ ID NO: 25135 - DNA, 15 bp, Homo sapiens
ttggacccccaccac

SEQ ID NO: 25136 - DNA, 15 bp, Homo sapiens
cttggacccccacca

SEQ ID NO: 25137 - DNA, 15 bp, Homo sapiens
gcttggacccccacc

SEQ ID NO: 25138 - DNA, 15 bp, Homo sapiens
ggcttggacccccac

SEQ ID NO: 25139 - DNA, 15 bp, Homo sapiens
aggcttggaccccca

SEQ ID NO: 25140 - DNA, 15 bp, Homo sapiens
caggcttggaccccc

SEQ ID NO: 25141 - DNA, 15 bp, Homo sapiens
gcaggcttggacccc

SEQ ID NO: 25142 - DNA, 15 bp, Homo sapiens
ggcaggcttggaccc

SEQ ID NO: 25143 - DNA, 15 bp, Homo sapiens
aggcaggcttggacc

SEQ ID NO: 25144 - DNA, 15 bp, Homo sapiens
gaggcaggcttggac

SEQ ID NO: 25145 - DNA, 15 bp, Homo sapiens
agaggcaggcttgga

SEQ ID NO: 25146 - DNA, 15 bp, Homo sapiens
cagaggcaggcttgg

SEQ ID NO: 25147 - DNA, 15 bp, Homo sapiens
gcagaggcaggcttg

SEQ ID NO: 25148 - DNA, 15 bp, Homo sapiens
agcagaggcaggctt

SEQ ID NO: 25149 - DNA, 15 bp, Homo sapiens
gagcagaggcaggct

SEQ ID NO: 25150 - DNA, 15 bp, Homo sapiens
tgagcagaggcaggc

SEQ ID NO: 25151 - DNA, 15 bp, Homo sapiens
gtgagcagaggcagg

SEQ ID NO: 25152 - DNA, 15 bp, Homo sapiens
agtgagcagaggcag

SEQ ID NO: 25153 - DNA, 15 bp, Homo sapiens
aagtgagcagaggca

SEQ ID NO: 25154 - DNA, 15 bp, Homo sapiens
caagtgagcagaggc

SEQ ID NO: 25155 - DNA, 15 bp, Homo sapiens
acaagtgagcagagg

SEQ ID NO: 25156 - DNA, 15 bp, Homo sapiens
aacaagtgagcagag

SEQ ID NO: 25157 - DNA, 15 bp, Homo sapiens
gaacaagtgagcaga

SEQ ID NO: 25158 - DNA, 15 bp, Homo sapiens
agaacaagtgagcag

SEQ ID NO: 25159 - DNA, 15 bp, Homo sapiens
cagaacaagtgagca

SEQ ID NO: 25160 - DNA, 15 bp, Homo sapiens
gcagaacaagtgagc

SEQ ID NO: 25161 - DNA, 15 bp, Homo sapiens
tgcagaacaagtgag

SEQ ID NO: 25162 - DNA, 15 bp, Homo sapiens
ctgcagaacaagtga

SEQ ID NO: 25163 - DNA, 15 bp, Homo sapiens
tctgcagaacaagtg

SEQ ID NO: 25164 - DNA, 15 bp, Homo sapiens
gtctgcagaacaagt

SEQ ID NO: 25165 - DNA, 15 bp, Homo sapiens
agtctgcagaacaag

SEQ ID NO: 25166 - DNA, 15 bp, Homo sapiens
cagtctgcagaacaa

SEQ ID NO: 25167 - DNA, 15 bp, Homo sapiens
ccagtctgcagaaca

SEQ ID NO: 25168 - DNA, 15 bp, Homo sapiens
gccagtctgcagaac

SEQ ID NO: 25169 - DNA, 15 bp, Homo sapiens
tgccagtctgcagaa

SEQ ID NO: 25170 - DNA, 15 bp, Homo sapiens
atgccagtctgcaga

SEQ ID NO: 25171 - DNA, 15 bp, Homo sapiens
catgccagtctgcag

SEQ ID NO: 25172 - DNA, 15 bp, Homo sapiens
acatgccagtctgca

SEQ ID NO: 25173 - DNA, 15 bp, Homo sapiens
aacatgccagtctgc

SEQ ID NO: 25174 - DNA, 15 bp, Homo sapiens
gaacatgccagtctg

SEQ ID NO: 25175 - DNA, 15 bp, Homo sapiens
agaacatgccagtct

SEQ ID NO: 25176 - DNA, 15 bp, Homo sapiens
gagaacatgccagtc

SEQ ID NO: 25177 - DNA, 15 bp, Homo sapiens
agagaacatgccagt

SEQ ID NO: 25178 - DNA, 15 bp, Homo sapiens
cagagaacatgccag

SEQ ID NO: 25179 - DNA, 15 bp, Homo sapiens
acagagaacatgcca

SEQ ID NO: 25180 - DNA, 15 bp, Homo sapiens
cacagagaacatgcc

SEQ ID NO: 25181 - DNA, 15 bp, Homo sapiens
tcacagagaacatgc

SEQ ID NO: 25182 - DNA, 15 bp, Homo sapiens
atcacagagaacatg

SEQ ID NO: 25183 - DNA, 15 bp, Homo sapiens
tatcacagagaacat

SEQ ID NO: 25184 - DNA, 15 bp, Homo sapiens
gtatcacagagaaca

SEQ ID NO: 25185 - DNA, 15 bp, Homo sapiens
agtatcacagagaac

SEQ ID NO: 25186 - DNA, 15 bp, Homo sapiens
aagtatcacagagaa

SEQ ID NO: 25187 - DNA, 15 bp, Homo sapiens
taagtatcacagaga

SEQ ID NO: 25188 - DNA, 15 bp, Homo sapiens
gtaagtatcacagag

SEQ ID NO: 25189 - DNA, 15 bp, Homo sapiens
tgtaagtatcacaga

SEQ ID NO: 25190 - DNA, 15 bp, Homo sapiens
atgtaagtatcacag

SEQ ID NO: 25191 - DNA, 15 bp, Homo sapiens
tatgtaagtatcaca

SEQ ID NO: 25192 - DNA, 15 bp, Homo sapiens
gtatgtaagtatcac

SEQ ID NO: 25193 - DNA, 15 bp, Homo sapiens
agtatgtaagtatca

SEQ ID NO: 25194 - DNA, 15 bp, Homo sapiens
aagtatgtaagtatc

SEQ ID NO: 25195 - DNA, 15 bp, Homo sapiens
caagtatgtaagtat

SEQ ID NO: 25196 - DNA, 15 bp, Homo sapiens
acaagtatgtaagta

SEQ ID NO: 25197 - DNA, 15 bp, Homo sapiens
aacaagtatgtaagt

SEQ ID NO: 25198 - DNA, 15 bp, Homo sapiens
aaacaagtatgtaag

SEQ ID NO: 25199 - DNA, 15 bp, Homo sapiens
taaacaagtatgtaa

SEQ ID NO: 25200 - DNA, 15 bp, Homo sapiens
ttaaacaagtatgta

SEQ ID NO: 25201 - DNA, 15 bp, Homo sapiens
gttaaacaagtatgt

SEQ ID NO: 25202 - DNA, 15 bp, Homo sapiens
tgttaaacaagtatg

SEQ ID NO: 25203 - DNA, 15 bp, Homo sapiens
gtgttaaacaagtat

SEQ ID NO: 25204 - DNA, 15 bp, Homo sapiens
agtgttaaacaagta

SEQ ID NO: 25205 - DNA, 15 bp, Homo sapiens
aagtgttaaacaagt

SEQ ID NO: 25206 - DNA, 15 bp, Homo sapiens
gaagtgttaaacaag

SEQ ID NO: 25207 - DNA, 15 bp, Homo sapiens
tgaagtgttaaacaa

SEQ ID NO: 25208 - DNA, 15 bp, Homo sapiens
ctgaagtgttaaaca

SEQ ID NO: 25209 - DNA, 15 bp, Homo sapiens
cctgaagtgttaaac

SEQ ID NO: 25210 - DNA, 15 bp, Homo sapiens
ccctgaagtgttaaa

SEQ ID NO: 25211 - DNA, 15 bp, Homo sapiens
tccctgaagtgttaa

SEQ ID NO: 25212 - DNA, 15 bp, Homo sapiens
ttccctgaagtgtta

SEQ ID NO: 25213 - DNA, 15 bp, Homo sapiens
cttccctgaagtgtt

SEQ ID NO: 25214 - DNA, 15 bp, Homo sapiens
tcttccctgaagtgt

SEQ ID NO: 25215 - DNA, 15 bp, Homo sapiens
ttcttccctgaagtg

SEQ ID NO: 25216 - DNA, 15 bp, Homo sapiens
tttcttccctgaagt

SEQ ID NO: 25217 - DNA, 15 bp, Homo sapiens
ttttcttccctgaag

SEQ ID NO: 25218 - DNA, 15 bp, Homo sapiens
cttttcttccctgaa

SEQ ID NO: 25219 - DNA, 15 bp, Homo sapiens
acttttcttccctga

SEQ ID NO: 25220 - DNA, 15 bp, Homo sapiens
gacttttcttccctg

SEQ ID NO: 25221 - DNA, 15 bp, Homo sapiens
tgacttttcttccct

SEQ ID NO: 25222 - DNA, 15 bp, Homo sapiens
ctgacttttcttccc

SEQ ID NO: 25223 - DNA, 15 bp, Homo sapiens
tctgacttttcttcc

SEQ ID NO: 25224 - DNA, 15 bp, Homo sapiens
ttctgacttttcttc

SEQ ID NO: 25225 - DNA, 15 bp, Homo sapiens
cttctgacttttctt

SEQ ID NO: 25226 - DNA, 15 bp, Homo sapiens
tcttctgacttttct

SEQ ID NO: 25227 - DNA, 15 bp, Homo sapiens
gtcttctgacttttc

SEQ ID NO: 25228 - DNA, 15 bp, Homo sapiens
ggtcttctgactttt

SEQ ID NO: 25229 - DNA, 15 bp, Homo sapiens
tggtcttctgacttt

SEQ ID NO: 25230 - DNA, 15 bp, Homo sapiens
ctggtcttctgactt

SEQ ID NO: 25231 - DNA, 15 bp, Homo sapiens
cctggtcttctgact

SEQ ID NO: 25232 - DNA, 15 bp, Homo sapiens
tcctggtcttctgac

SEQ ID NO: 25233 - DNA, 15 bp, Homo sapiens
gtcctggtcttctga

SEQ ID NO: 25234 - DNA, 15 bp, Homo sapiens
ggtcctggtcttctg

SEQ ID NO: 25235 - DNA, 15 bp, Homo sapiens
aggtcctggtcttct

SEQ ID NO: 25236 - DNA, 15 bp, Homo sapiens
gaggtcctggtcttc

SEQ ID NO: 25237 - DNA, 15 bp, Homo sapiens
ggaggtcctggtctt

SEQ ID NO: 25238 - DNA, 15 bp, Homo sapiens
tggaggtcctggtct

SEQ ID NO: 25239 - DNA, 15 bp, Homo sapiens
ctggaggtcctggtc

SEQ ID NO: 25240 - DNA, 15 bp, Homo sapiens
cctggaggtcctggt

SEQ ID NO: 25241 - DNA, 15 bp, Homo sapiens
ccctggaggtcctgg

SEQ ID NO: 25242 - DNA, 15 bp, Homo sapiens
gccctggaggtcctg

SEQ ID NO: 25243 - DNA, 15 bp, Homo sapiens
ggccctggaggtcct

SEQ ID NO: 25244 - DNA, 15 bp, Homo sapiens
aggccctggaggtcc

SEQ ID NO: 25245 - DNA, 15 bp, Homo sapiens
gaggccctggaggtc

SEQ ID NO: 25246 - DNA, 15 bp, Homo sapiens
tgaggccctggaggt

SEQ ID NO: 25247 - DNA, 15 bp, Homo sapiens
ttgaggccctggagg

SEQ ID NO: 25248 - DNA, 15 bp, Homo sapiens
cttgaggccctggag

SEQ ID NO: 25249 - DNA, 15 bp, Homo sapiens
ccttgaggccctgga

SEQ ID NO: 25250 - DNA, 15 bp, Homo sapiens
tccttgaggccctgg

SEQ ID NO: 25251 - DNA, 15 bp, Homo sapiens
gtccttgaggccctg

SEQ ID NO: 25252 - DNA, 15 bp, Homo sapiens
tgtccttgaggccct

SEQ ID NO: 25253 - DNA, 15 bp, Homo sapiens
ttgtccttgaggccc

SEQ ID NO: 25254 - DNA, 15 bp, Homo sapiens
tttgtccttgaggcc

SEQ ID NO: 25255 - DNA, 15 bp, Homo sapiens
gtttgtccttgaggc

SEQ ID NO: 25256 - DNA, 15 bp, Homo sapiens
ggtttgtccttgagg

SEQ ID NO: 25257 - DNA, 15 bp, Homo sapiens
gggtttgtccttgag

SEQ ID NO: 25258 - DNA, 15 bp, Homo sapiens
ggggtttgtccttga

SEQ ID NO: 25259 - DNA, 15 bp, Homo sapiens
aggggtttgtccttg

SEQ ID NO: 25260 - DNA, 15 bp, Homo sapiens
gaggggtttgtcctt

SEQ ID NO: 25261 - DNA, 15 bp, Homo sapiens
tgaggggtttgtcct

SEQ ID NO: 25262 - DNA, 15 bp, Homo sapiens
ttgaggggtttgtcc

SEQ ID NO: 25263 - DNA, 15 bp, Homo sapiens
cttgaggggtttgtc

SEQ ID NO: 25264 - DNA, 15 bp, Homo sapiens
acttgaggggtttgt

SEQ ID NO: 25265 - DNA, 15 bp, Homo sapiens
aacttgaggggtttg

SEQ ID NO: 25266 - DNA, 15 bp, Homo sapiens
aaacttgaggggttt

SEQ ID NO: 25267 - DNA, 15 bp, Homo sapiens
taaacttgaggggtt

SEQ ID NO: 25268 - DNA, 15 bp, Homo sapiens
ttaaacttgaggggt

SEQ ID NO: 25269 - DNA, 15 bp, Homo sapiens
tttaaacttgagggg

SEQ ID NO: 25270 - DNA, 15 bp, Homo sapiens
ttttaaacttgaggg

SEQ ID NO: 25271 - DNA, 15 bp, Homo sapiens
tttttaaacttgagg

SEQ ID NO: 25272 - DNA, 15 bp, Homo sapiens
ctttttaaacttgag

SEQ ID NO: 25273 - DNA, 15 bp, Homo sapiens
cctttttaaacttga

SEQ ID NO: 25274 - DNA, 15 bp, Homo sapiens
acctttttaaacttg

SEQ ID NO: 25275 - DNA, 15 bp, Homo sapiens
cacctttttaaactt

SEQ ID NO: 25276 - DNA, 15 bp, Homo sapiens
tcacctttttaaact

SEQ ID NO: 25277 - DNA, 15 bp, Homo sapiens
ttcacctttttaaac

SEQ ID NO: 25278 - DNA, 15 bp, Homo sapiens
cttcacctttttaaa

SEQ ID NO: 25279 - DNA, 15 bp, Homo sapiens
tcttcacctttttaa

SEQ ID NO: 25280 - DNA, 15 bp, Homo sapiens
ttcttcaccttttta

SEQ ID NO: 25281 - DNA, 15 bp, Homo sapiens
tttcttcaccttttt

SEQ ID NO: 25282 - DNA, 15 bp, Homo sapiens
ctttcttcacctttt

SEQ ID NO: 25283 - DNA, 15 bp, Homo sapiens
tctttcttcaccttt

SEQ ID NO: 25284 - DNA, 15 bp, Homo sapiens
atctttcttcacctt

SEQ ID NO: 25285 - DNA, 15 bp, Homo sapiens
tatctttcttcacct

SEQ ID NO: 25286 - DNA, 15 bp, Homo sapiens
ttatctttcttcacc

SEQ ID NO: 25287 - DNA, 15 bp, Homo sapiens
cttatctttcttcac

SEQ ID NO: 25288 - DNA, 15 bp, Homo sapiens
tcttatctttcttca

SEQ ID NO: 25289 - DNA, 15 bp, Homo sapiens
ttcttatctttcttc

SEQ ID NO: 25290 - DNA, 15 bp, Homo sapiens
tttcttatctttctt

SEQ ID NO: 25291 - DNA, 15 bp, Homo sapiens
ctttcttatctttct

SEQ ID NO: 25292 - DNA, 15 bp, Homo sapiens
tctttcttatctttc

SEQ ID NO: 25293 - DNA, 15 bp, Homo sapiens
ttctttcttatcttt

SEQ ID NO: 25294 - DNA, 15 bp, Homo sapiens
cttctttcttatctt

SEQ ID NO: 25295 - DNA, 15 bp, Homo sapiens
tcttctttcttatct

SEQ ID NO: 25296 - DNA, 15 bp, Homo sapiens
ctcttctttcttatc

SEQ ID NO: 25297 - DNA, 15 bp, Homo sapiens
tctcttctttcttat

SEQ ID NO: 25298 - DNA, 15 bp, Homo sapiens
ttctcttctttctta

SEQ ID NO: 25299 - DNA, 15 bp, Homo sapiens
tttctcttctttctt

SEQ ID NO: 25300 - DNA, 15 bp, Homo sapiens
ctttctcttctttct

SEQ ID NO: 25301 - DNA, 15 bp, Homo sapiens
tctttctcttctttc

SEQ ID NO: 25302 - DNA, 15 bp, Homo sapiens
ctctttctcttcttt

SEQ ID NO: 25303 - DNA, 15 bp, Homo sapiens
cctctttctcttctt

SEQ ID NO: 25304 - DNA, 15 bp, Homo sapiens
ccctctttctcttct

SEQ ID NO: 25305 - DNA, 15 bp, Homo sapiens
gccctctttctcttc

SEQ ID NO: 25306 - DNA, 15 bp, Homo sapiens
tgccctctttctctt

SEQ ID NO: 25307 - DNA, 15 bp, Homo sapiens
ttgccctctttctct

SEQ ID NO: 25308 - DNA, 15 bp, Homo sapiens
cttgccctctttctc

SEQ ID NO: 25309 - DNA, 15 bp, Homo sapiens
gcttgccctctttct

SEQ ID NO: 25310 - DNA, 15 bp, Homo sapiens
tgcttgccctctttc

SEQ ID NO: 25311 - DNA, 15 bp, Homo sapiens
atgcttgccctcttt

SEQ ID NO: 25312 - DNA, 15 bp, Homo sapiens
catgcttgccctctt

SEQ ID NO: 25313 - DNA, 15 bp, Homo sapiens
tcatgcttgccctct

SEQ ID NO: 25314 - DNA, 15 bp, Homo sapiens
ctcatgcttgccctc

SEQ ID NO: 25315 - DNA, 15 bp, Homo sapiens
gctcatgcttgccct

SEQ ID NO: 25316 - DNA, 15 bp, Homo sapiens
ggctcatgcttgccc

SEQ ID NO: 25317 - DNA, 15 bp, Homo sapiens
gggctcatgcttgcc

SEQ ID NO: 25318 - DNA, 15 bp, Homo sapiens
cgggctcatgcttgc

SEQ ID NO: 25319 - DNA, 15 bp, Homo sapiens
acgggctcatgcttg

SEQ ID NO: 25320 - DNA, 15 bp, Homo sapiens
cacgggctcatgctt

SEQ ID NO: 25321 - DNA, 15 bp, Homo sapiens
gcacgggctcatgct

SEQ ID NO: 25322 - DNA, 15 bp, Homo sapiens
tgcacgggctcatgc

SEQ ID NO: 25323 - DNA, 15 bp, Homo sapiens
ctgcacgggctcatg

SEQ ID NO: 25324 - DNA, 15 bp, Homo sapiens
gctgcacgggctcat

SEQ ID NO: 25325 - DNA, 15 bp, Homo sapiens
ggctgcacgggctca

SEQ ID NO: 25326 - DNA, 15 bp, Homo sapiens
tggctgcacgggctc

SEQ ID NO: 25327 - DNA, 15 bp, Homo sapiens
atggctgcacgggct

SEQ ID NO: 25328 - DNA, 15 bp, Homo sapiens
gatggctgcacgggc

SEQ ID NO: 25329 - DNA, 15 bp, Homo sapiens
tgatggctgcacggg

SEQ ID NO: 25330 - DNA, 15 bp, Homo sapiens
ctgatggctgcacgg

SEQ ID NO: 25331 - DNA, 15 bp, Homo sapiens
gctgatggctgcacg

SEQ ID NO: 25332 - DNA, 15 bp, Homo sapiens
ggctgatggctgcac

SEQ ID NO: 25333 - DNA, 15 bp, Homo sapiens
gggctgatggctgca

SEQ ID NO: 25334 - DNA, 15 bp, Homo sapiens
tgggctgatggctgc

SEQ ID NO: 25335 - DNA, 15 bp, Homo sapiens
gtgggctgatggctg

SEQ ID NO: 25336 - DNA, 15 bp, Homo sapiens
ggtgggctgatggct

SEQ ID NO: 25337 - DNA, 15 bp, Homo sapiens
tggtgggctgatggc

SEQ ID NO: 25338 - DNA, 15 bp, Homo sapiens
gtggtgggctgatgg

SEQ ID NO: 25339 - DNA, 15 bp, Homo sapiens
agtggtgggctgatg

SEQ ID NO: 25340 - DNA, 15 bp, Homo sapiens
gagtggtgggctgat

SEQ ID NO: 25341 - DNA, 15 bp, Homo sapiens
agagtggtgggctga

SEQ ID NO: 25342 - DNA, 15 bp, Homo sapiens
cagagtggtgggctg

SEQ ID NO: 25343 - DNA, 15 bp, Homo sapiens
gcagagtggtgggct

SEQ ID NO: 25344 - DNA, 15 bp, Homo sapiens
agcagagtggtgggc

SEQ ID NO: 25345 - DNA, 15 bp, Homo sapiens
cagcagagtggtggg

SEQ ID NO: 25346 - DNA, 15 bp, Homo sapiens
tcagcagagtggtgg

SEQ ID NO: 25347 - DNA, 15 bp, Homo sapiens
ctcagcagagtggtg

SEQ ID NO: 25348 - DNA, 15 bp, Homo sapiens
gctcagcagagtggt

SEQ ID NO: 25349 - DNA, 15 bp, Homo sapiens
ggctcagcagagtgg

SEQ ID NO: 25350 - DNA, 15 bp, Homo sapiens
gggctcagcagagtg

SEQ ID NO: 25351 - DNA, 15 bp, Homo sapiens
cgggctcagcagagt

SEQ ID NO: 25352 - DNA, 15 bp, Homo sapiens
gcgggctcagcagag

SEQ ID NO: 25353 - DNA, 15 bp, Homo sapiens
tgcgggctcagcaga

SEQ ID NO: 25354 - DNA, 15 bp, Homo sapiens
ctgcgggctcagcag

SEQ ID NO: 25355 - DNA, 15 bp, Homo sapiens
tctgcgggctcagca

SEQ ID NO: 25356 - DNA, 15 bp, Homo sapiens
ctctgcgggctcagc

SEQ ID NO: 25357 - DNA, 15 bp, Homo sapiens
cctctgcgggctcag

SEQ ID NO: 25358 - DNA, 15 bp, Homo sapiens
gcctctgcgggctca

SEQ ID NO: 25359 - DNA, 15 bp, Homo sapiens
tgcctctgcgggctc

SEQ ID NO: 25360 - DNA, 15 bp, Homo sapiens
ctgcctctgcgggct

SEQ ID NO: 25361 - DNA, 15 bp, Homo sapiens
cctgcctctgcgggc

SEQ ID NO: 25362 - DNA, 15 bp, Homo sapiens
gcctgcctctgcggg

SEQ ID NO: 25363 - DNA, 15 bp, Homo sapiens
tgcctgcctctgcgg

SEQ ID NO: 25364 - DNA, 15 bp, Homo sapiens
ttgcctgcctctgcg

SEQ ID NO: 25365 - DNA, 15 bp, Homo sapiens
tttgcctgcctctgc

SEQ ID NO: 25366 - DNA, 15 bp, Homo sapiens
ctttgcctgcctctg

SEQ ID NO: 25367 - DNA, 15 bp, Homo sapiens
gctttgcctgcctct

SEQ ID NO: 25368 - DNA, 15 bp, Homo sapiens
tgctttgcctgcctc

SEQ ID NO: 25369 - DNA, 15 bp, Homo sapiens
ctgctttgcctgcct

SEQ ID NO: 25370 - DNA, 15 bp, Homo sapiens
tctgctttgcctgcc

SEQ ID NO: 25371 - DNA, 15 bp, Homo sapiens
ctctgctttgcctgc

SEQ ID NO: 25372 - DNA, 15 bp, Homo sapiens
tctctgctttgcctg

SEQ ID NO: 25373 - DNA, 15 bp, Homo sapiens
gtctctgctttgcct

SEQ ID NO: 25374 - DNA, 15 bp, Homo sapiens
tgtctctgctttgcc

SEQ ID NO: 25375 - DNA, 15 bp, Homo sapiens
atgtctctgctttgc

SEQ ID NO: 25376 - DNA, 15 bp, Homo sapiens
gatgtctctgctttg

SEQ ID NO: 25377 - DNA, 15 bp, Homo sapiens
tgatgtctctgcttt

SEQ ID NO: 25378 - DNA, 15 bp, Homo sapiens
ctgatgtctctgctt

SEQ ID NO: 25379 - DNA, 15 bp, Homo sapiens
tctgatgtctctgct

SEQ ID NO: 25380 - DNA, 15 bp, Homo sapiens
ttctgatgtctctgc

SEQ ID NO: 25381 - DNA, 15 bp, Homo sapiens
cttctgatgtctctg

SEQ ID NO: 25382 - DNA, 15 bp, Homo sapiens
ccttctgatgtctct

SEQ ID NO: 25383 - DNA, 15 bp, Homo sapiens
cccttctgatgtctc

SEQ ID NO: 25384 - DNA, 15 bp, Homo sapiens
acccttctgatgtct

SEQ ID NO: 25385 - DNA, 15 bp, Homo sapiens
gacccttctgatgtc

SEQ ID NO: 25386 - DNA, 15 bp, Homo sapiens
tgacccttctgatgt

SEQ ID NO: 25387 - DNA, 15 bp, Homo sapiens
ctgacccttctgatg

SEQ ID NO: 25388 - DNA, 15 bp, Homo sapiens
cctgacccttctgat

SEQ ID NO: 25389 - DNA, 15 bp, Homo sapiens
gcctgacccttctga

SEQ ID NO: 25390 - DNA, 15 bp, Homo sapiens
agcctgacccttctg

SEQ ID NO: 25391 - DNA, 15 bp, Homo sapiens
gagcctgacccttct

SEQ ID NO: 25392 - DNA, 15 bp, Homo sapiens
ggagcctgacccttc

SEQ ID NO: 25393 - DNA, 15 bp, Homo sapiens
cggagcctgaccctt

SEQ ID NO: 25394 - DNA, 15 bp, Homo sapiens
gcggagcctgaccct

SEQ ID NO: 25395 - DNA, 15 bp, Homo sapiens
ggcggagcctgaccc

SEQ ID NO: 25396 - DNA, 15 bp, Homo sapiens
gggcggagcctgacc

SEQ ID NO: 25397 - DNA, 15 bp, Homo sapiens
ggggcggagcctgac

SEQ ID NO: 25398 - DNA, 15 bp, Homo sapiens
cggggcggagcctga

SEQ ID NO: 25399 - DNA, 15 bp, Homo sapiens
ccggggcggagcctg

SEQ ID NO: 25400 - DNA, 15 bp, Homo sapiens
gccggggcggagcct

SEQ ID NO: 25401 - DNA, 15 bp, Homo sapiens
agccggggcggagcc

SEQ ID NO: 25402 - DNA, 15 bp, Homo sapiens
cagccggggcggagc

SEQ ID NO: 25403 - DNA, 15 bp, Homo sapiens
acagccggggcggag

SEQ ID NO: 25404 - DNA, 15 bp, Homo sapiens
cacagccggggcgga

SEQ ID NO: 25405 - DNA, 15 bp, Homo sapiens
gcacagccggggcgg

SEQ ID NO: 25406 - DNA, 15 bp, Homo sapiens
ggcacagccggggcg

SEQ ID NO: 25407 - DNA, 15 bp, Homo sapiens
cggcacagccggggc

SEQ ID NO: 25408 - DNA, 15 bp, Homo sapiens
ccggcacagccgggg

SEQ ID NO: 25409 - DNA, 15 bp, Homo sapiens
tccggcacagccggg

SEQ ID NO: 25410 - DNA, 15 bp, Homo sapiens
ttccggcacagccgg

SEQ ID NO: 25411 - DNA, 15 bp, Homo sapiens
cttccggcacagccg

SEQ ID NO: 25412 - DNA, 15 bp, Homo sapiens
gcttccggcacagcc

SEQ ID NO: 25413 - DNA, 15 bp, Homo sapiens
agcttccggcacagc

SEQ ID NO: 25414 - DNA, 15 bp, Homo sapiens
aagcttccggcacag

SEQ ID NO: 25415 - DNA, 15 bp, Homo sapiens
gaagcttccggcaca

SEQ ID NO: 25416 - DNA, 15 bp, Homo sapiens
agaagcttccggcac

SEQ ID NO: 25417 - DNA, 15 bp, Homo sapiens
cagaagcttccggca

SEQ ID NO: 25418 - DNA, 15 bp, Homo sapiens
gcagaagcttccggc

SEQ ID NO: 25419 - DNA, 15 bp, Homo sapiens
ggcagaagcttccgg

SEQ ID NO: 25420 - DNA, 15 bp, Homo sapiens
aggcagaagcttccg

SEQ ID NO: 25421 - DNA, 15 bp, Homo sapiens
gaggcagaagcttcc

SEQ ID NO: 25422 - DNA, 15 bp, Homo sapiens
ggaggcagaagcttc

SEQ ID NO: 25423 - DNA, 15 bp, Homo sapiens
gggaggcagaagctt

SEQ ID NO: 25424 - DNA, 15 bp, Homo sapiens
ggggaggcagaagct

SEQ ID NO: 25425 - DNA, 15 bp, Homo sapiens
gggggaggcagaagc

SEQ ID NO: 25426 - DNA, 15 bp, Homo sapiens
tgggggaggcagaag

SEQ ID NO: 25427 - DNA, 15 bp, Homo sapiens
ttgggggaggcagaa

SEQ ID NO: 25428 - DNA, 15 bp, Homo sapiens
tttgggggaggcaga

SEQ ID NO: 25429 - DNA, 15 bp, Homo sapiens
gtttgggggaggcag

SEQ ID NO: 25430 - DNA, 15 bp, Homo sapiens
tgtttgggggaggca

SEQ ID NO: 25431 - DNA, 15 bp, Homo sapiens
ctgtttgggggaggc

SEQ ID NO: 25432 - DNA, 15 bp, Homo sapiens
gctgtttgggggagg

SEQ ID NO: 25433 - DNA, 15 bp, Homo sapiens
cgctgtttgggggag

SEQ ID NO: 25434 - DNA, 15 bp, Homo sapiens
ccgctgtttggggga

SEQ ID NO: 25435 - DNA, 15 bp, Homo sapiens
gccgctgtttggggg

SEQ ID NO: 25436 - DNA, 15 bp, Homo sapiens
cgccgctgtttgggg

SEQ ID NO: 25437 - DNA, 15 bp, Homo sapiens
gcgccgctgtttggg

SEQ ID NO: 25438 - DNA, 15 bp, Homo sapiens
agcgccgctgtttgg

SEQ ID NO: 25439 - DNA, 15 bp, Homo sapiens
gagcgccgctgtttg

SEQ ID NO: 25440 - DNA, 15 bp, Homo sapiens
ggagcgccgctgttt

SEQ ID NO: 25441 - DNA, 15 bp, Homo sapiens
tggagcgccgctgtt

SEQ ID NO: 25442 - DNA, 15 bp, Homo sapiens
atggagcgccgctgt

SEQ ID NO: 25443 - DNA, 15 bp, Homo sapiens
gatggagcgccgctg

SEQ ID NO: 25444 - DNA, 15 bp, Homo sapiens
tgatggagcgccgct

SEQ ID NO: 25445 - DNA, 15 bp, Homo sapiens
atgatggagcgccgc

SEQ ID NO: 25446 - DNA, 15 bp, Homo sapiens
gatgatggagcgccg

SEQ ID NO: 25447 - DNA, 15 bp, Homo sapiens
ggatgatggagcgcc

SEQ ID NO: 25448 - DNA, 15 bp, Homo sapiens
cggatgatggagcgc

SEQ ID NO: 25449 - DNA, 15 bp, Homo sapiens
acggatgatggagcg

SEQ ID NO: 25450 - DNA, 15 bp, Homo sapiens
cacggatgatggagc

SEQ ID NO: 25451 - DNA, 15 bp, Homo sapiens
tcacggatgatggag

SEQ ID NO: 25452 - DNA, 15 bp, Homo sapiens
gtcacggatgatgga

SEQ ID NO: 25453 - DNA, 15 bp, Homo sapiens
ggtcacggatgatgg

SEQ ID NO: 25454 - DNA, 15 bp, Homo sapiens
cggtcacggatgatg

SEQ ID NO: 25455 - DNA, 15 bp, Homo sapiens
ccggtcacggatgat

SEQ ID NO: 25456 - DNA, 15 bp, Homo sapiens
cccggtcacggatga

SEQ ID NO: 25457 - DNA, 15 bp, Homo sapiens
ccccggtcacggatg

SEQ ID NO: 25458 - DNA, 15 bp, Homo sapiens
tccccggtcacggat

SEQ ID NO: 25459 - DNA, 15 bp, Homo sapiens
gtccccggtcacgga

SEQ ID NO: 25460 - DNA, 15 bp, Homo sapiens
ggtccccggtcacgg

SEQ ID NO: 25461 - DNA, 15 bp, Homo sapiens
gggtccccggtcacg

SEQ ID NO: 25462 - DNA, 15 bp, Homo sapiens
tgggtccccggtcac

SEQ ID NO: 25463 - DNA, 15 bp, Homo sapiens
atgggtccccggtca

SEQ ID NO: 25464 - DNA, 15 bp, Homo sapiens
catgggtccccggtc

SEQ ID NO: 25465 - DNA, 15 bp, Homo sapiens
acatgggtccccggt

SEQ ID NO: 25466 - DNA, 15 bp, Homo sapiens
tacatgggtccccgg

SEQ ID NO: 25467 - DNA, 15 bp, Homo sapiens
atacatgggtccccg

SEQ ID NO: 25468 - DNA, 15 bp, Homo sapiens
catacatgggtcccc

SEQ ID NO: 25469 - DNA, 15 bp, Homo sapiens
tcatacatgggtccc

SEQ ID NO: 25470 - DNA, 15 bp, Homo sapiens
atcatacatgggtcc

SEQ ID NO: 25471 - DNA, 15 bp, Homo sapiens
catcatacatgggtc

SEQ ID NO: 25472 - DNA, 15 bp, Homo sapiens
tcatcatacatgggt

SEQ ID NO: 25473 - DNA, 15 bp, Homo sapiens
gtcatcatacatggg

SEQ ID NO: 25474 - DNA, 15 bp, Homo sapiens
ggtcatcatacatgg

SEQ ID NO: 25475 - DNA, 15 bp, Homo sapiens
gggtcatcatacatg

SEQ ID NO: 25476 - DNA, 15 bp, Homo sapiens
ggggtcatcatacat

SEQ ID NO: 25477 - DNA, 15 bp, Homo sapiens
tggggtcatcataca

SEQ ID NO: 25478 - DNA, 15 bp, Homo sapiens
gtggggtcatcatac

SEQ ID NO: 25479 - DNA, 15 bp, Homo sapiens
ggtggggtcatcata

SEQ ID NO: 25480 - DNA, 15 bp, Homo sapiens
gggtggggtcatcat

SEQ ID NO: 25481 - DNA, 15 bp, Homo sapiens
agggtggggtcatca

SEQ ID NO: 25482 - DNA, 15 bp, Homo sapiens
cagggtggggtcatc

SEQ ID NO: 25483 - DNA, 15 bp, Homo sapiens
gcagggtggggtcat

SEQ ID NO: 25484 - DNA, 15 bp, Homo sapiens
ggcagggtggggtca

SEQ ID NO: 25485 - DNA, 15 bp, Homo sapiens
aggcagggtggggtc

SEQ ID NO: 25486 - DNA, 15 bp, Homo sapiens
caggcagggtggggt

SEQ ID NO: 25487 - DNA, 15 bp, Homo sapiens
tcaggcagggtgggg

SEQ ID NO: 25488 - DNA, 15 bp, Homo sapiens
ttcaggcagggtggg

SEQ ID NO: 25489 - DNA, 15 bp, Homo sapiens
cttcaggcagggtgg

SEQ ID NO: 25490 - DNA, 15 bp, Homo sapiens
ccttcaggcagggtg

SEQ ID NO: 25491 - DNA, 15 bp, Homo sapiens
gccttcaggcagggt

SEQ ID NO: 25492 - DNA, 15 bp, Homo sapiens
agccttcaggcaggg

SEQ ID NO: 25493 - DNA, 15 bp, Homo sapiens
cagccttcaggcagg

SEQ ID NO: 25494 - DNA, 15 bp, Homo sapiens
ccagccttcaggcag

SEQ ID NO: 25495 - DNA, 15 bp, Homo sapiens
tccagccttcaggca

SEQ ID NO: 25496 - DNA, 15 bp, Homo sapiens
gtccagccttcaggc

SEQ ID NO: 25497 - DNA, 15 bp, Homo sapiens
tgtccagccttcagg

SEQ ID NO: 25498 - DNA, 15 bp, Homo sapiens
gtgtccagccttcag

SEQ ID NO: 25499 - DNA, 15 bp, Homo sapiens
cgtgtccagccttca

SEQ ID NO: 25500 - DNA, 15 bp, Homo sapiens
ccgtgtccagccttc

SEQ ID NO: 25501 - DNA, 15 bp, Homo sapiens
tccgtgtccagcctt

SEQ ID NO: 25502 - DNA, 15 bp, Homo sapiens
ttccgtgtccagcct

SEQ ID NO: 25503 - DNA, 15 bp, Homo sapiens
cttccgtgtccagcc

SEQ ID NO: 25504 - DNA, 15 bp, Homo sapiens
gcttccgtgtccagc

SEQ ID NO: 25505 - DNA, 15 bp, Homo sapiens
agcttccgtgtccag

SEQ ID NO: 25506 - DNA, 15 bp, Homo sapiens
aagcttccgtgtcca

SEQ ID NO: 25507 - DNA, 15 bp, Homo sapiens
taagcttccgtgtcc

SEQ ID NO: 25508 - DNA, 15 bp, Homo sapiens
ttaagcttccgtgtc

SEQ ID NO: 25509 - DNA, 15 bp, Homo sapiens
cttaagcttccgtgt

SEQ ID NO: 25510 - DNA, 15 bp, Homo sapiens
gcttaagcttccgtg

SEQ ID NO: 25511 - DNA, 15 bp, Homo sapiens
tgcttaagcttccgt

SEQ ID NO: 25512 - DNA, 15 bp, Homo sapiens
ttgcttaagcttccg

SEQ ID NO: 25513 - DNA, 15 bp, Homo sapiens
tttgcttaagcttcc

SEQ ID NO: 25514 - DNA, 15 bp, Homo sapiens
ctttgcttaagcttc

SEQ ID NO: 25515 - DNA, 15 bp, Homo sapiens
cctttgcttaagctt

SEQ ID NO: 25516 - DNA, 15 bp, Homo sapiens
tcctttgcttaagct

SEQ ID NO: 25517 - DNA, 15 bp, Homo sapiens
ttcctttgcttaagc

SEQ ID NO: 25518 - DNA, 15 bp, Homo sapiens
tttcctttgcttaag

SEQ ID NO: 25519 - DNA, 15 bp, Homo sapiens
atttcctttgcttaa

SEQ ID NO: 25520 - DNA, 15 bp, Homo sapiens
gatttcctttgctta

SEQ ID NO: 25521 - DNA, 15 bp, Homo sapiens
agatttcctttgctt

SEQ ID NO: 25522 - DNA, 15 bp, Homo sapiens
cagatttcctttgct

SEQ ID NO: 25523 - DNA, 15 bp, Homo sapiens
ccagatttcctttgc

SEQ ID NO: 25524 - DNA, 15 bp, Homo sapiens
gccagatttcctttg

SEQ ID NO: 25525 - DNA, 15 bp, Homo sapiens
ggccagatttccttt

SEQ ID NO: 25526 - DNA, 15 bp, Homo sapiens
cggccagatttcctt

SEQ ID NO: 25527 - DNA, 15 bp, Homo sapiens
gcggccagatttcct

SEQ ID NO: 25528 - DNA, 15 bp, Homo sapiens
agcggccagatttcc

SEQ ID NO: 25529 - DNA, 15 bp, Homo sapiens
gagcggccagatttc

SEQ ID NO: 25530 - DNA, 15 bp, Homo sapiens
agagcggccagattt

SEQ ID NO: 25531 - DNA, 15 bp, Homo sapiens
cagagcggccagatt

SEQ ID NO: 25532 - DNA, 15 bp, Homo sapiens
gcagagcggccagat

SEQ ID NO: 25533 - DNA, 15 bp, Homo sapiens
agcagagcggccaga

SEQ ID NO: 25534 - DNA, 15 bp, Homo sapiens
cagcagagcggccag

SEQ ID NO: 25535 - DNA, 15 bp, Homo sapiens
ccagcagagcggcca

SEQ ID NO: 25536 - DNA, 15 bp, Homo sapiens
cccagcagagcggcc

SEQ ID NO: 25537 - DNA, 15 bp, Homo sapiens
tcccagcagagcggc

SEQ ID NO: 25538 - DNA, 15 bp, Homo sapiens
ttcccagcagagcgg

SEQ ID NO: 25539 - DNA, 15 bp, Homo sapiens
cttcccagcagagcg

SEQ ID NO: 25540 - DNA, 15 bp, Homo sapiens
acttcccagcagagc

SEQ ID NO: 25541 - DNA, 15 bp, Homo sapiens
tacttcccagcagag

SEQ ID NO: 25542 - DNA, 15 bp, Homo sapiens
atacttcccagcaga

SEQ ID NO: 25543 - DNA, 15 bp, Homo sapiens
catacttcccagcag

SEQ ID NO: 25544 - DNA, 15 bp, Homo sapiens
tcatacttcccagca

SEQ ID NO: 25545 - DNA, 15 bp, Homo sapiens
atcatacttcccagc

SEQ ID NO: 25546 - DNA, 15 bp, Homo sapiens
catcatacttcccag

SEQ ID NO: 25547 - DNA, 15 bp, Homo sapiens
acatcatacttccca

SEQ ID NO: 25548 - DNA, 15 bp, Homo sapiens
cacatcatacttccc

SEQ ID NO: 25549 - DNA, 15 bp, Homo sapiens
acacatcatacttcc

SEQ ID NO: 25550 - DNA, 15 bp, Homo sapiens
tacacatcatacttc

SEQ ID NO: 25551 - DNA, 15 bp, Homo sapiens
atacacatcatactt

SEQ ID NO: 25552 - DNA, 15 bp, Homo sapiens
aatacacatcatact

SEQ ID NO: 25553 - DNA, 15 bp, Homo sapiens
aaatacacatcatac

SEQ ID NO: 25554 - DNA, 15 bp, Homo sapiens
caaatacacatcata

SEQ ID NO: 25555 - DNA, 15 bp, Homo sapiens
tcaaatacacatcat

SEQ ID NO: 25556 - DNA, 15 bp, Homo sapiens
atcaaatacacatca

SEQ ID NO: 25557 - DNA, 15 bp, Homo sapiens
gatcaaatacacatc

SEQ ID NO: 25558 - DNA, 15 bp, Homo sapiens
tgatcaaatacacat

SEQ ID NO: 25559 - DNA, 15 bp, Homo sapiens
ttgatcaaatacaca

SEQ ID NO: 25560 - DNA, 15 bp, Homo sapiens
cttgatcaaatacac

SEQ ID NO: 25561 - DNA, 15 bp, Homo sapiens
acttgatcaaataca

SEQ ID NO: 25562 - DNA, 15 bp, Homo sapiens
tacttgatcaaatac

SEQ ID NO: 25563 - DNA, 15 bp, Homo sapiens
ttacttgatcaaata

SEQ ID NO: 25564 - DNA, 15 bp, Homo sapiens
cttacttgatcaaat

SEQ ID NO: 25565 - DNA, 15 bp, Homo sapiens
acttacttgatcaaa

SEQ ID NO: 25566 - DNA, 15 bp, Homo sapiens
tacttacttgatcaa

SEQ ID NO: 25567 - DNA, 15 bp, Homo sapiens
ttacttacttgatca

SEQ ID NO: 25568 - DNA, 15 bp, Homo sapiens
cttacttacttgatc

SEQ ID NO: 25569 - DNA, 15 bp, Homo sapiens
tcttacttacttgat

SEQ ID NO: 25570 - DNA, 15 bp, Homo sapiens
ctcttacttacttga

SEQ ID NO: 25571 - DNA, 15 bp, Homo sapiens
gctcttacttacttg

SEQ ID NO: 25572 - DNA, 15 bp, Homo sapiens
tgctcttacttactt

SEQ ID NO: 25573 - DNA, 15 bp, Homo sapiens
ttgctcttacttact

SEQ ID NO: 25574 - DNA, 15 bp, Homo sapiens
gttgctcttacttac

SEQ ID NO: 25575 - DNA, 15 bp, Homo sapiens
agttgctcttactta

SEQ ID NO: 25576 - DNA, 15 bp, Homo sapiens
gagttgctcttactt

SEQ ID NO: 25577 - DNA, 15 bp, Homo sapiens
ggagttgctcttact

SEQ ID NO: 25578 - DNA, 15 bp, Homo sapiens
aggagttgctcttac

SEQ ID NO: 25579 - DNA, 15 bp, Homo sapiens
taggagttgctctta

SEQ ID NO: 25580 - DNA, 15 bp, Homo sapiens
ataggagttgctctt

SEQ ID NO: 25581 - DNA, 15 bp, Homo sapiens
gataggagttgctct

SEQ ID NO: 25582 - DNA, 15 bp, Homo sapiens
agataggagttgctc

SEQ ID NO: 25583 - DNA, 15 bp, Homo sapiens
gagataggagttgct

SEQ ID NO: 25584 - DNA, 15 bp, Homo sapiens
agagataggagttgc

SEQ ID NO: 25585 - DNA, 15 bp, Homo sapiens
tagagataggagttg

SEQ ID NO: 25586 - DNA, 15 bp, Homo sapiens
gtagagataggagtt

SEQ ID NO: 25587 - DNA, 15 bp, Homo sapiens
tgtagagataggagt

SEQ ID NO: 25588 - DNA, 15 bp, Homo sapiens
ctgtagagataggag

SEQ ID NO: 25589 - DNA, 15 bp, Homo sapiens
cctgtagagatagga

SEQ ID NO: 25590 - DNA, 15 bp, Homo sapiens
ccctgtagagatagg

SEQ ID NO: 25591 - DNA, 15 bp, Homo sapiens
gccctgtagagatag

SEQ ID NO: 25592 - DNA, 15 bp, Homo sapiens
tgccctgtagagata

SEQ ID NO: 25593 - DNA, 15 bp, Homo sapiens
ctgccctgtagagat

SEQ ID NO: 25594 - DNA, 15 bp, Homo sapiens
cctgccctgtagaga

SEQ ID NO: 25595 - DNA, 15 bp, Homo sapiens
ccctgccctgtagag

SEQ ID NO: 25596 - DNA, 15 bp, Homo sapiens
tccctgccctgtaga

SEQ ID NO: 25597 - DNA, 15 bp, Homo sapiens
ctccctgccctgtag

SEQ ID NO: 25598 - DNA, 15 bp, Homo sapiens
cctccctgccctgta

SEQ ID NO: 25599 - DNA, 15 bp, Homo sapiens
ccctccctgccctgt

SEQ ID NO: 25600 - DNA, 15 bp, Homo sapiens
gccctccctgccctg

SEQ ID NO: 25601 - DNA, 15 bp, Homo sapiens
tgccctccctgccct

SEQ ID NO: 25602 - DNA, 15 bp, Homo sapiens
ctgccctccctgccc

SEQ ID NO: 25603 - DNA, 15 bp, Homo sapiens
cctgccctccctgcc

SEQ ID NO: 25604 - DNA, 15 bp, Homo sapiens
ccctgccctccctgc

SEQ ID NO: 25605 - DNA, 15 bp, Homo sapiens
tccctgccctccctg

SEQ ID NO: 25606 - DNA, 15 bp, Homo sapiens
gtccctgccctccct

SEQ ID NO: 25607 - DNA, 15 bp, Homo sapiens
tgtccctgccctccc

SEQ ID NO: 25608 - DNA, 15 bp, Homo sapiens
ttgtccctgccctcc

SEQ ID NO: 25609 - DNA, 15 bp, Homo sapiens
cttgtccctgccctc

SEQ ID NO: 25610 - DNA, 15 bp, Homo sapiens
ccttgtccctgccct

SEQ ID NO: 25611 - DNA, 15 bp, Homo sapiens
tccttgtccctgccc

SEQ ID NO: 25612 - DNA, 15 bp, Homo sapiens
atccttgtccctgcc

SEQ ID NO: 25613 - DNA, 15 bp, Homo sapiens
gatccttgtccctgc

SEQ ID NO: 25614 - DNA, 15 bp, Homo sapiens
ggatccttgtccctg

SEQ ID NO: 25615 - DNA, 15 bp, Homo sapiens
gggatccttgtccct

SEQ ID NO: 25616 - DNA, 15 bp, Homo sapiens
agggatccttgtccc

SEQ ID NO: 25617 - DNA, 15 bp, Homo sapiens
gagggatccttgtcc

SEQ ID NO: 25618 - DNA, 15 bp, Homo sapiens
tgagggatccttgtc

SEQ ID NO: 25619 - DNA, 15 bp, Homo sapiens
atgagggatccttgt

SEQ ID NO: 25620 - DNA, 15 bp, Homo sapiens
catgagggatccttg

SEQ ID NO: 25621 - DNA, 15 bp, Homo sapiens
ccatgagggatcctt

SEQ ID NO: 25622 - DNA, 15 bp, Homo sapiens
tccatgagggatcct

SEQ ID NO: 25623 - DNA, 15 bp, Homo sapiens
ctccatgagggatcc

SEQ ID NO: 25624 - DNA, 15 bp, Homo sapiens
gctccatgagggatc

SEQ ID NO: 25625 - DNA, 15 bp, Homo sapiens
tgctccatgagggat

SEQ ID NO: 25626 - DNA, 15 bp, Homo sapiens
ctgctccatgaggga

SEQ ID NO: 25627 - DNA, 15 bp, Homo sapiens
cctgctccatgaggg

SEQ ID NO: 25628 - DNA, 15 bp, Homo sapiens
tcctgctccatgagg

SEQ ID NO: 25629 - DNA, 15 bp, Homo sapiens
ttcctgctccatgag

SEQ ID NO: 25630 - DNA, 15 bp, Homo sapiens
tttcctgctccatga

SEQ ID NO: 25631 - DNA, 15 bp, Homo sapiens
ttttcctgctccatg

SEQ ID NO: 25632 - DNA, 15 bp, Homo sapiens
attttcctgctccat

SEQ ID NO: 25633 - DNA, 15 bp, Homo sapiens
cattttcctgctcca

SEQ ID NO: 25634 - DNA, 15 bp, Homo sapiens
acattttcctgctcc

SEQ ID NO: 25635 - DNA, 15 bp, Homo sapiens
tacattttcctgctc

SEQ ID NO: 25636 - DNA, 15 bp, Homo sapiens
atacattttcctgct

SEQ ID NO: 25637 - DNA, 15 bp, Homo sapiens
catacattttcctgc

SEQ ID NO: 25638 - DNA, 15 bp, Homo sapiens
acatacattttcctg

SEQ ID NO: 25639 - DNA, 15 bp, Homo sapiens
cacatacattttcct

SEQ ID NO: 25640 - DNA, 15 bp, Homo sapiens
gcacatacattttcc

SEQ ID NO: 25641 - DNA, 15 bp, Homo sapiens
ggcacatacattttc

SEQ ID NO: 25642 - DNA, 15 bp, Homo sapiens
gggcacatacatttt

SEQ ID NO: 25643 - DNA, 15 bp, Homo sapiens
tgggcacatacattt

SEQ ID NO: 25644 - DNA, 15 bp, Homo sapiens
ctgggcacatacatt

SEQ ID NO: 25645 - DNA, 15 bp, Homo sapiens
cctgggcacatacat

SEQ ID NO: 25646 - DNA, 15 bp, Homo sapiens
ccctgggcacataca

SEQ ID NO: 25647 - DNA, 15 bp, Homo sapiens
accctgggcacatac

SEQ ID NO: 25648 - DNA, 15 bp, Homo sapiens
caccctgggcacata

SEQ ID NO: 25649 - DNA, 15 bp, Homo sapiens
ccaccctgggcacat

SEQ ID NO: 25650 - DNA, 15 bp, Homo sapiens
cccaccctgggcaca

SEQ ID NO: 25651 - DNA, 15 bp, Homo sapiens
ccccaccctgggcac

SEQ ID NO: 25652 - DNA, 15 bp, Homo sapiens
accccaccctgggca

SEQ ID NO: 25653 - DNA, 15 bp, Homo sapiens
gaccccaccctgggc

SEQ ID NO: 25654 - DNA, 15 bp, Homo sapiens
cgaccccaccctggg

SEQ ID NO: 25655 - DNA, 15 bp, Homo sapiens
ccgaccccaccctgg

SEQ ID NO: 25656 - DNA, 15 bp, Homo sapiens
cccgaccccaccctg

SEQ ID NO: 25657 - DNA, 15 bp, Homo sapiens
ccccgaccccaccct

SEQ ID NO: 25658 - DNA, 15 bp, Homo sapiens
cccccgaccccaccc

SEQ ID NO: 25659 - DNA, 15 bp, Homo sapiens
ccccccgaccccacc

SEQ ID NO: 25660 - DNA, 15 bp, Homo sapiens
tccccccgaccccac

SEQ ID NO: 25661 - DNA, 15 bp, Homo sapiens
ttccccccgacccca

SEQ ID NO: 25662 - DNA, 15 bp, Homo sapiens
gttccccccgacccc

SEQ ID NO: 25663 - DNA, 15 bp, Homo sapiens
tgttccccccgaccc

SEQ ID NO: 25664 - DNA, 15 bp, Homo sapiens
atgttccccccgacc

SEQ ID NO: 25665 - DNA, 15 bp, Homo sapiens
tatgttccccccgac

SEQ ID NO: 25666 - DNA, 15 bp, Homo sapiens
ttatgttccccccga

SEQ ID NO: 25667 - DNA, 15 bp, Homo sapiens
tttatgttccccccg

SEQ ID NO: 25668 - DNA, 15 bp, Homo sapiens
gtttatgttcccccc

SEQ ID NO: 25669 - DNA, 15 bp, Homo sapiens
tgtttatgttccccc

SEQ ID NO: 25670 - DNA, 15 bp, Homo sapiens
ttgtttatgttcccc

SEQ ID NO: 25671 - DNA, 15 bp, Homo sapiens
attgtttatgttccc

SEQ ID NO: 25672 - DNA, 15 bp, Homo sapiens
cattgtttatgttcc

SEQ ID NO: 25673 - DNA, 15 bp, Homo sapiens
tcattgtttatgttc

SEQ ID NO: 25674 - DNA, 15 bp, Homo sapiens
ttcattgtttatgtt

SEQ ID NO: 25675 - DNA, 15 bp, Homo sapiens
gttcattgtttatgt

SEQ ID NO: 25676 - DNA, 15 bp, Homo sapiens
tgttcattgtttatg

SEQ ID NO: 25677 - DNA, 15 bp, Homo sapiens
gtgttcattgtttat

SEQ ID NO: 25678 - DNA, 15 bp, Homo sapiens
agtgttcattgttta

SEQ ID NO: 25679 - DNA, 15 bp, Homo sapiens
cagtgttcattgttt

SEQ ID NO: 25680 - DNA, 15 bp, Homo sapiens
tcagtgttcattgtt

SEQ ID NO: 25681 - DNA, 15 bp, Homo sapiens
ctcagtgttcattgt

SEQ ID NO: 25682 - DNA, 15 bp, Homo sapiens
tctcagtgttcattg

SEQ ID NO: 25683 - DNA, 15 bp, Homo sapiens
gtctcagtgttcatt

SEQ ID NO: 25684 - DNA, 15 bp, Homo sapiens
ggtctcagtgttcat

SEQ ID NO: 25685 - DNA, 15 bp, Homo sapiens
tggtctcagtgttca

SEQ ID NO: 25686 - DNA, 15 bp, Homo sapiens
ctggtctcagtgttc

SEQ ID NO: 25687 - DNA, 15 bp, Homo sapiens
cctggtctcagtgtt

SEQ ID NO: 25688 - DNA, 15 bp, Homo sapiens
acctggtctcagtgt

SEQ ID NO: 25689 - DNA, 15 bp, Homo sapiens
cacctggtctcagtg

SEQ ID NO: 25690 - DNA, 15 bp, Homo sapiens
acacctggtctcagt

SEQ ID NO: 25691 - DNA, 15 bp, Homo sapiens
cacacctggtctcag

SEQ ID NO: 25692 - DNA, 15 bp, Homo sapiens
gcacacctggtctca

SEQ ID NO: 25693 - DNA, 15 bp, Homo sapiens
agcacacctggtctc

SEQ ID NO: 25694 - DNA, 15 bp, Homo sapiens
aagcacacctggtct

SEQ ID NO: 25695 - DNA, 15 bp, Homo sapiens
caagcacacctggtc

SEQ ID NO: 25696 - DNA, 15 bp, Homo sapiens
tcaagcacacctggt

SEQ ID NO: 25697 - DNA, 15 bp, Homo sapiens
ttcaagcacacctgg

SEQ ID NO: 25698 - DNA, 15 bp, Homo sapiens
tttcaagcacacctg

SEQ ID NO: 25699 - DNA, 15 bp, Homo sapiens
atttcaagcacacct

SEQ ID NO: 25700 - DNA, 15 bp, Homo sapiens
catttcaagcacacc

SEQ ID NO: 25701 - DNA, 15 bp, Homo sapiens
tcatttcaagcacac

SEQ ID NO: 25702 - DNA, 15 bp, Homo sapiens
gtcatttcaagcaca

SEQ ID NO: 25703 - DNA, 15 bp, Homo sapiens
ggtcatttcaagcac

SEQ ID NO: 25704 - DNA, 15 bp, Homo sapiens
cggtcatttcaagca

SEQ ID NO: 25705 - DNA, 15 bp, Homo sapiens
acggtcatttcaagc

SEQ ID NO: 25706 - DNA, 15 bp, Homo sapiens
cacggtcatttcaag

SEQ ID NO: 25707 - DNA, 15 bp, Homo sapiens
acacggtcatttcaa

SEQ ID NO: 25708 - DNA, 15 bp, Homo sapiens
tacacggtcatttca

SEQ ID NO: 25709 - DNA, 15 bp, Homo sapiens
gtacacggtcatttc

SEQ ID NO: 25710 - DNA, 15 bp, Homo sapiens
tgtacacggtcattt

SEQ ID NO: 25711 - DNA, 15 bp, Homo sapiens
ctgtacacggtcatt

SEQ ID NO: 25712 - DNA, 15 bp, Homo sapiens
tctgtacacggtcat

SEQ ID NO: 25713 - DNA, 15 bp, Homo sapiens
ctctgtacacggtca

SEQ ID NO: 25714 - DNA, 15 bp, Homo sapiens
cctctgtacacggtc

SEQ ID NO: 25715 - DNA, 15 bp, Homo sapiens
acctctgtacacggt

SEQ ID NO: 25716 - DNA, 15 bp, Homo sapiens
gacctctgtacacgg

SEQ ID NO: 25717 - DNA, 15 bp, Homo sapiens
cgacctctgtacacg

SEQ ID NO: 25718 - DNA, 15 bp, Homo sapiens
gcgacctctgtacac

SEQ ID NO: 25719 - DNA, 15 bp, Homo sapiens
agcgacctctgtaca

SEQ ID NO: 25720 - DNA, 15 bp, Homo sapiens
cagcgacctctgtac

SEQ ID NO: 25721 - DNA, 15 bp, Homo sapiens
gcagcgacctctgta

SEQ ID NO: 25722 - DNA, 15 bp, Homo sapiens
ggcagcgacctctgt

SEQ ID NO: 25723 - DNA, 15 bp, Homo sapiens
gggcagcgacctctg

SEQ ID NO: 25724 - DNA, 15 bp, Homo sapiens
agggcagcgacctct

SEQ ID NO: 25725 - DNA, 15 bp, Homo sapiens
cagggcagcgacctc

SEQ ID NO: 25726 - DNA, 15 bp, Homo sapiens
tcagggcagcgacct

SEQ ID NO: 25727 - DNA, 15 bp, Homo sapiens
ctcagggcagcgacc

SEQ ID NO: 25728 - DNA, 15 bp, Homo sapiens
actcagggcagcgac

SEQ ID NO: 25729 - DNA, 15 bp, Homo sapiens
cactcagggcagcga

SEQ ID NO: 25730 - DNA, 15 bp, Homo sapiens
ccactcagggcagcg

SEQ ID NO: 25731 - DNA, 15 bp, Homo sapiens
cccactcagggcagc

SEQ ID NO: 25732 - DNA, 15 bp, Homo sapiens
tcccactcagggcag

SEQ ID NO: 25733 - DNA, 15 bp, Homo sapiens
ttcccactcagggca

SEQ ID NO: 25734 - DNA, 15 bp, Homo sapiens
cttcccactcagggc

SEQ ID NO: 25735 - DNA, 15 bp, Homo sapiens
acttcccactcaggg

SEQ ID NO: 25736 - DNA, 15 bp, Homo sapiens
aacttcccactcagg

SEQ ID NO: 25737 - DNA, 15 bp, Homo sapiens
gaacttcccactcag

SEQ ID NO: 25738 - DNA, 15 bp, Homo sapiens
agaacttcccactca

SEQ ID NO: 25739 - DNA, 15 bp, Homo sapiens
gagaacttcccactc

SEQ ID NO: 25740 - DNA, 15 bp, Homo sapiens
tgagaacttcccact

SEQ ID NO: 25741 - DNA, 15 bp, Homo sapiens
ttgagaacttcccac

SEQ ID NO: 25742 - DNA, 15 bp, Homo sapiens
cttgagaacttccca

SEQ ID NO: 25743 - DNA, 15 bp, Homo sapiens
ccttgagaacttccc

SEQ ID NO: 25744 - DNA, 15 bp, Homo sapiens
accttgagaacttcc

SEQ ID NO: 25745 - DNA, 15 bp, Homo sapiens
taccttgagaacttc

SEQ ID NO: 25746 - DNA, 15 bp, Homo sapiens
ctaccttgagaactt

SEQ ID NO: 25747 - DNA, 15 bp, Homo sapiens
gctaccttgagaact

SEQ ID NO: 25748 - DNA, 15 bp, Homo sapiens
tgctaccttgagaac

SEQ ID NO: 25749 - DNA, 15 bp, Homo sapiens
ctgctaccttgagaa

SEQ ID NO: 25750 - DNA, 15 bp, Homo sapiens
cctgctaccttgaga

SEQ ID NO: 25751 - DNA, 15 bp, Homo sapiens
gcctgctaccttgag

SEQ ID NO: 25752 - DNA, 15 bp, Homo sapiens
ggcctgctaccttga

SEQ ID NO: 25753 - DNA, 15 bp, Homo sapiens
gggcctgctaccttg

SEQ ID NO: 25754 - DNA, 15 bp, Homo sapiens
agggcctgctacctt

SEQ ID NO: 25755 - DNA, 15 bp, Homo sapiens
gagggcctgctacct

SEQ ID NO: 25756 - DNA, 15 bp, Homo sapiens
agagggcctgctacc

SEQ ID NO: 25757 - DNA, 15 bp, Homo sapiens
tagagggcctgctac

SEQ ID NO: 25758 - DNA, 15 bp, Homo sapiens
atagagggcctgcta

SEQ ID NO: 25759 - DNA, 15 bp, Homo sapiens
gatagagggcctgct

SEQ ID NO: 25760 - DNA, 15 bp, Homo sapiens
ggatagagggcctgc

SEQ ID NO: 25761 - DNA, 15 bp, Homo sapiens
aggatagagggcctg

SEQ ID NO: 25762 - DNA, 15 bp, Homo sapiens
gaggatagagggcct

SEQ ID NO: 25763 - DNA, 15 bp, Homo sapiens
agaggatagagggcc

SEQ ID NO: 25764 - DNA, 15 bp, Homo sapiens
gagaggatagagggc

SEQ ID NO: 25765 - DNA, 15 bp, Homo sapiens
ggagaggatagaggg

SEQ ID NO: 25766 - DNA, 15 bp, Homo sapiens
tggagaggatagagg

SEQ ID NO: 25767 - DNA, 15 bp, Homo sapiens
gtggagaggatagag

SEQ ID NO: 25768 - DNA, 15 bp, Homo sapiens
tgtggagaggataga

SEQ ID NO: 25769 - DNA, 15 bp, Homo sapiens
gtgtggagaggatag

SEQ ID NO: 25770 - DNA, 15 bp, Homo sapiens
ggtgtggagaggata

SEQ ID NO: 25771 - DNA, 15 bp, Homo sapiens
aggtgtggagaggat

SEQ ID NO: 25772 - DNA, 15 bp, Homo sapiens
gaggtgtggagagga

SEQ ID NO: 25773 - DNA, 15 bp, Homo sapiens
tgaggtgtggagagg

SEQ ID NO: 25774 - DNA, 15 bp, Homo sapiens
ttgaggtgtggagag

SEQ ID NO: 25775 - DNA, 15 bp, Homo sapiens
cttgaggtgtggaga

SEQ ID NO: 25776 - DNA, 15 bp, Homo sapiens
acttgaggtgtggag

SEQ ID NO: 25777 - DNA, 15 bp, Homo sapiens
gacttgaggtgtgga

SEQ ID NO: 25778 - DNA, 15 bp, Homo sapiens
agacttgaggtgtgg

SEQ ID NO: 25779 - DNA, 15 bp, Homo sapiens
aagacttgaggtgtg

SEQ ID NO: 25780 - DNA, 15 bp, Homo sapiens
aaagacttgaggtgt

SEQ ID NO: 25781 - DNA, 15 bp, Homo sapiens
taaagacttgaggtg

SEQ ID NO: 25782 - DNA, 15 bp, Homo sapiens
ataaagacttgaggt

SEQ ID NO: 25783 - DNA, 15 bp, Homo sapiens
gataaagacttgagg

SEQ ID NO: 25784 - DNA, 15 bp, Homo sapiens
agataaagacttgag

SEQ ID NO: 25785 - DNA, 15 bp, Homo sapiens
cagataaagacttga

SEQ ID NO: 25786 - DNA, 15 bp, Homo sapiens
ccagataaagacttg

SEQ ID NO: 25787 - DNA, 15 bp, Homo sapiens
cccagataaagactt

SEQ ID NO: 25788 - DNA, 15 bp, Homo sapiens
ccccagataaagact

SEQ ID NO: 25789 - DNA, 15 bp, Homo sapiens
tccccagataaagac

SEQ ID NO: 25790 - DNA, 15 bp, Homo sapiens
atccccagataaaga

SEQ ID NO: 25791 - DNA, 15 bp, Homo sapiens
catccccagataaag

SEQ ID NO: 25792 - DNA, 15 bp, Homo sapiens
ccatccccagataaa

SEQ ID NO: 25793 - DNA, 15 bp, Homo sapiens
tccatccccagataa

SEQ ID NO: 25794 - DNA, 15 bp, Homo sapiens
ttccatccccagata

SEQ ID NO: 25795 - DNA, 15 bp, Homo sapiens
attccatccccagat

SEQ ID NO: 25796 - DNA, 15 bp, Homo sapiens
tattccatccccaga

SEQ ID NO: 25797 - DNA, 15 bp, Homo sapiens
ctattccatccccag

SEQ ID NO: 25798 - DNA, 15 bp, Homo sapiens
gctattccatcccca

SEQ ID NO: 25799 - DNA, 15 bp, Homo sapiens
agctattccatcccc

SEQ ID NO: 25800 - DNA, 15 bp, Homo sapiens
cagctattccatccc

SEQ ID NO: 25801 - DNA, 15 bp, Homo sapiens
gcagctattccatcc

SEQ ID NO: 25802 - DNA, 15 bp, Homo sapiens
cgcagctattccatc

SEQ ID NO: 25803 - DNA, 15 bp, Homo sapiens
ccgcagctattccat

SEQ ID NO: 25804 - DNA, 15 bp, Homo sapiens
tccgcagctattcca

SEQ ID NO: 25805 - DNA, 15 bp, Homo sapiens
ttccgcagctattcc

SEQ ID NO: 25806 - DNA, 15 bp, Homo sapiens
cttccgcagctattc

SEQ ID NO: 25807 - DNA, 15 bp, Homo sapiens
gcttccgcagctatt

SEQ ID NO: 25808 - DNA, 15 bp, Homo sapiens
tgcttccgcagctat

SEQ ID NO: 25809 - DNA, 15 bp, Homo sapiens
ctgcttccgcagcta

SEQ ID NO: 25810 - DNA, 15 bp, Homo sapiens
tctgcttccgcagct

SEQ ID NO: 25811 - DNA, 15 bp, Homo sapiens
ctctgcttccgcagc

SEQ ID NO: 25812 - DNA, 15 bp, Homo sapiens
cctctgcttccgcag

SEQ ID NO: 25813 - DNA, 15 bp, Homo sapiens
tcctctgcttccgca

SEQ ID NO: 25814 - DNA, 15 bp, Homo sapiens
ttcctctgcttccgc

SEQ ID NO: 25815 - DNA, 15 bp, Homo sapiens
gttcctctgcttccg

SEQ ID NO: 25816 - DNA, 15 bp, Homo sapiens
agttcctctgcttcc

SEQ ID NO: 25817 - DNA, 15 bp, Homo sapiens
aagttcctctgcttc

SEQ ID NO: 25818 - DNA, 15 bp, Homo sapiens
caagttcctctgctt

SEQ ID NO: 25819 - DNA, 15 bp, Homo sapiens
gcaagttcctctgct

SEQ ID NO: 25820 - DNA, 15 bp, Homo sapiens
tgcaagttcctctgc

SEQ ID NO: 25821 - DNA, 15 bp, Homo sapiens
ctgcaagttcctctg

SEQ ID NO: 25822 - DNA, 15 bp, Homo sapiens
tctgcaagttcctct

SEQ ID NO: 25823 - DNA, 15 bp, Homo sapiens
ctctgcaagttcctc

SEQ ID NO: 25824 - DNA, 15 bp, Homo sapiens
gctctgcaagttcct

SEQ ID NO: 25825 - DNA, 15 bp, Homo sapiens
agctctgcaagttcc

SEQ ID NO: 25826 - DNA, 15 bp, Homo sapiens
tagctctgcaagttc

SEQ ID NO: 25827 - DNA, 15 bp, Homo sapiens
ctagctctgcaagtt

SEQ ID NO: 25828 - DNA, 15 bp, Homo sapiens
cctagctctgcaagt

SEQ ID NO: 25829 - DNA, 15 bp, Homo sapiens
ccctagctctgcaag

SEQ ID NO: 25830 - DNA, 15 bp, Homo sapiens
cccctagctctgcaa

SEQ ID NO: 25831 - DNA, 15 bp, Homo sapiens
acccctagctctgca

SEQ ID NO: 25832 - DNA, 15 bp, Homo sapiens
aacccctagctctgc

SEQ ID NO: 25833 - DNA, 15 bp, Homo sapiens
gaacccctagctctg

SEQ ID NO: 25834 - DNA, 15 bp, Homo sapiens
tgaacccctagctct

SEQ ID NO: 25835 - DNA, 15 bp, Homo sapiens
ctgaacccctagctc

SEQ ID NO: 25836 - DNA, 15 bp, Homo sapiens
tctgaacccctagct

SEQ ID NO: 25837 - DNA, 15 bp, Homo sapiens
ctctgaacccctagc

SEQ ID NO: 25838 - DNA, 15 bp, Homo sapiens
cctctgaacccctag

SEQ ID NO: 25839 - DNA, 15 bp, Homo sapiens
ccctctgaaccccta

SEQ ID NO: 25840 - DNA, 15 bp, Homo sapiens
cccctctgaacccct

SEQ ID NO: 25841 - DNA, 15 bp, Homo sapiens
acccctctgaacccc

SEQ ID NO: 25842 - DNA, 15 bp, Homo sapiens
cacccctctgaaccc

SEQ ID NO: 25843 - DNA, 15 bp, Homo sapiens
tcacccctctgaacc

SEQ ID NO: 25844 - DNA, 15 bp, Homo sapiens
ttcacccctctgaac

SEQ ID NO: 25845 - DNA, 15 bp, Homo sapiens
cttcacccctctgaa

SEQ ID NO: 25846 - DNA, 15 bp, Homo sapiens
tcttcacccctctga

SEQ ID NO: 25847 - DNA, 15 bp, Homo sapiens
ttcttcacccctctg

SEQ ID NO: 25848 - DNA, 15 bp, Homo sapiens
cttcttcacccctct

SEQ ID NO: 25849 - DNA, 15 bp, Homo sapiens
gcttcttcacccctc

SEQ ID NO: 25850 - DNA, 15 bp, Homo sapiens
tgcttcttcacccct

SEQ ID NO: 25851 - DNA, 15 bp, Homo sapiens
atgcttcttcacccc

SEQ ID NO: 25852 - DNA, 15 bp, Homo sapiens
catgcttcttcaccc

SEQ ID NO: 25853 - DNA, 15 bp, Homo sapiens
acatgcttcttcacc

SEQ ID NO: 25854 - DNA, 15 bp, Homo sapiens
aacatgcttcttcac

SEQ ID NO: 25855 - DNA, 15 bp, Homo sapiens
aaacatgcttcttca

SEQ ID NO: 25856 - DNA, 15 bp, Homo sapiens
gaaacatgcttcttc

SEQ ID NO: 25857 - DNA, 15 bp, Homo sapiens
tgaaacatgcttctt

SEQ ID NO: 25858 - DNA, 15 bp, Homo sapiens
ctgaaacatgcttct

SEQ ID NO: 25859 - DNA, 15 bp, Homo sapiens
actgaaacatgcttc

SEQ ID NO: 25860 - DNA, 15 bp, Homo sapiens
aactgaaacatgctt

SEQ ID NO: 25861 - DNA, 15 bp, Homo sapiens
gaactgaaacatgct

SEQ ID NO: 25862 - DNA, 15 bp, Homo sapiens
agaactgaaacatgc

SEQ ID NO: 25863 - DNA, 15 bp, Homo sapiens
cagaactgaaacatg

SEQ ID NO: 25864 - DNA, 15 bp, Homo sapiens
gcagaactgaaacat

SEQ ID NO: 25865 - DNA, 15 bp, Homo sapiens
ggcagaactgaaaca

SEQ ID NO: 25866 - DNA, 15 bp, Homo sapiens
aggcagaactgaaac

SEQ ID NO: 25867 - DNA, 15 bp, Homo sapiens
aaggcagaactgaaa

SEQ ID NO: 25868 - DNA, 15 bp, Homo sapiens
aaaggcagaactgaa

SEQ ID NO: 25869 - DNA, 15 bp, Homo sapiens
aaaaggcagaactga

SEQ ID NO: 25870 - DNA, 15 bp, Homo sapiens
taaaaggcagaactg

SEQ ID NO: 25871 - DNA, 15 bp, Homo sapiens
ttaaaaggcagaact

SEQ ID NO: 25872 - DNA, 15 bp, Homo sapiens
tttaaaaggcagaac

SEQ ID NO: 25873 - DNA, 15 bp, Homo sapiens
atttaaaaggcagaa

SEQ ID NO: 25874 - DNA, 15 bp, Homo sapiens
catttaaaaggcaga

SEQ ID NO: 25875 - DNA, 15 bp, Homo sapiens
tcatttaaaaggcag

SEQ ID NO: 25876 - DNA, 15 bp, Homo sapiens
atcatttaaaaggca

SEQ ID NO: 25877 - DNA, 15 bp, Homo sapiens
gatcatttaaaaggc

SEQ ID NO: 25878 - DNA, 15 bp, Homo sapiens
ggatcatttaaaagg

SEQ ID NO: 25879 - DNA, 15 bp, Homo sapiens
gggatcatttaaaag

SEQ ID NO: 25880 - DNA, 15 bp, Homo sapiens
tgggatcatttaaaa

SEQ ID NO: 25881 - DNA, 15 bp, Homo sapiens
ttgggatcatttaaa

SEQ ID NO: 25882 - DNA, 15 bp, Homo sapiens
tttgggatcatttaa

SEQ ID NO: 25883 - DNA, 15 bp, Homo sapiens
ttttgggatcattta

SEQ ID NO: 25884 - DNA, 15 bp, Homo sapiens
tttttgggatcattt

SEQ ID NO: 25885 - DNA, 15 bp, Homo sapiens
ctttttgggatcatt

SEQ ID NO: 25886 - DNA, 15 bp, Homo sapiens
cctttttgggatcat

SEQ ID NO: 25887 - DNA, 15 bp, Homo sapiens
acctttttgggatca

SEQ ID NO: 25888 - DNA, 15 bp, Homo sapiens
aacctttttgggatc

SEQ ID NO: 25889 - DNA, 15 bp, Homo sapiens
taacctttttgggat

SEQ ID NO: 25890 - DNA, 15 bp, Homo sapiens
ctaacctttttggga

SEQ ID NO: 25891 - DNA, 15 bp, Homo sapiens
gctaacctttttggg

SEQ ID NO: 25892 - DNA, 15 bp, Homo sapiens
tgctaacctttttgg

SEQ ID NO: 25893 - DNA, 15 bp, Homo sapiens
ctgctaacctttttg

SEQ ID NO: 25894 - DNA, 15 bp, Homo sapiens
actgctaaccttttt

SEQ ID NO: 25895 - DNA, 15 bp, Homo sapiens
aactgctaacctttt

SEQ ID NO: 25896 - DNA, 15 bp, Homo sapiens
aaactgctaaccttt

SEQ ID NO: 25897 - DNA, 15 bp, Homo sapiens
aaaactgctaacctt

SEQ ID NO: 25898 - DNA, 15 bp, Homo sapiens
gaaaactgctaacct

SEQ ID NO: 25899 - DNA, 15 bp, Homo sapiens
tgaaaactgctaacc

SEQ ID NO: 25900 - DNA, 15 bp, Homo sapiens
ttgaaaactgctaac

SEQ ID NO: 25901 - DNA, 15 bp, Homo sapiens
tttgaaaactgctaa

SEQ ID NO: 25902 - DNA, 15 bp, Homo sapiens
atttgaaaactgcta

SEQ ID NO: 25903 - DNA, 15 bp, Homo sapiens
catttgaaaactgct

SEQ ID NO: 25904 - DNA, 15 bp, Homo sapiens
tcatttgaaaactgc

SEQ ID NO: 25905 - DNA, 15 bp, Homo sapiens
gtcatttgaaaactg

SEQ ID NO: 25906 - DNA, 15 bp, Homo sapiens
tgtcatttgaaaact

SEQ ID NO: 25907 - DNA, 15 bp, Homo sapiens
atgtcatttgaaaac

SEQ ID NO: 25908 - DNA, 15 bp, Homo sapiens
aatgtcatttgaaaa

SEQ ID NO: 25909 - DNA, 15 bp, Homo sapiens
aaatgtcatttgaaa

SEQ ID NO: 25910 - DNA, 15 bp, Homo sapiens
caaatgtcatttgaa

SEQ ID NO: 25911 - DNA, 15 bp, Homo sapiens
gcaaatgtcatttga

SEQ ID NO: 25912 - DNA, 15 bp, Homo sapiens
tgcaaatgtcatttg

SEQ ID NO: 25913 - DNA, 15 bp, Homo sapiens
ctgcaaatgtcattt

SEQ ID NO: 25914 - DNA, 15 bp, Homo sapiens
tctgcaaatgtcatt

SEQ ID NO: 25915 - DNA, 15 bp, Homo sapiens
gtctgcaaatgtcat

SEQ ID NO: 25916 - DNA, 15 bp, Homo sapiens
tgtctgcaaatgtca

SEQ ID NO: 25917 - DNA, 15 bp, Homo sapiens
ctgtctgcaaatgtc

SEQ ID NO: 25918 - DNA, 15 bp, Homo sapiens
gctgtctgcaaatgt

SEQ ID NO: 25919 - DNA, 15 bp, Homo sapiens
ggctgtctgcaaatg

SEQ ID NO: 25920 - DNA, 15 bp, Homo sapiens
aggctgtctgcaaat

SEQ ID NO: 25921 - DNA, 15 bp, Homo sapiens
gaggctgtctgcaaa

SEQ ID NO: 25922 - DNA, 15 bp, Homo sapiens
tgaggctgtctgcaa

SEQ ID NO: 25923 - DNA, 15 bp, Homo sapiens
atgaggctgtctgca

SEQ ID NO: 25924 - DNA, 15 bp, Homo sapiens
aatgaggctgtctgc

SEQ ID NO: 25925 - DNA, 15 bp, Homo sapiens
aaatgaggctgtctg

SEQ ID NO: 25926 - DNA, 15 bp, Homo sapiens
taaatgaggctgtct

SEQ ID NO: 25927 - DNA, 15 bp, Homo sapiens
ttaaatgaggctgtc

SEQ ID NO: 25928 - DNA, 15 bp, Homo sapiens
attaaatgaggctgt

SEQ ID NO: 25929 - DNA, 15 bp, Homo sapiens
aattaaatgaggctg

SEQ ID NO: 25930 - DNA, 15 bp, Homo sapiens
gaattaaatgaggct

SEQ ID NO: 25931 - DNA, 15 bp, Homo sapiens
ggaattaaatgaggc

SEQ ID NO: 25932 - DNA, 15 bp, Homo sapiens
tggaattaaatgagg

SEQ ID NO: 25933 - DNA, 15 bp, Homo sapiens
atggaattaaatgag

SEQ ID NO: 25934 - DNA, 15 bp, Homo sapiens
catggaattaaatga

SEQ ID NO: 25935 - DNA, 15 bp, Homo sapiens
tcatggaattaaatg

SEQ ID NO: 25936 - DNA, 15 bp, Homo sapiens
ctcatggaattaaat

SEQ ID NO: 25937 - DNA, 15 bp, Homo sapiens
tctcatggaattaaa

SEQ ID NO: 25938 - DNA, 15 bp, Homo sapiens
ttctcatggaattaa

SEQ ID NO: 25939 - DNA, 15 bp, Homo sapiens
cttctcatggaatta

SEQ ID NO: 25940 - DNA, 15 bp, Homo sapiens
ccttctcatggaatt

SEQ ID NO: 25941 - DNA, 15 bp, Homo sapiens
cccttctcatggaat

SEQ ID NO: 25942 - DNA, 15 bp, Homo sapiens
acccttctcatggaa

SEQ ID NO: 25943 - DNA, 15 bp, Homo sapiens
cacccttctcatgga

SEQ ID NO: 25944 - DNA, 15 bp, Homo sapiens
tcacccttctcatgg

SEQ ID NO: 25945 - DNA, 15 bp, Homo sapiens
ctcacccttctcatg

SEQ ID NO: 25946 - DNA, 15 bp, Homo sapiens
gctcacccttctcat

SEQ ID NO: 25947 - DNA, 15 bp, Homo sapiens
tgctcacccttctca

SEQ ID NO: 25948 - DNA, 15 bp, Homo sapiens
ttgctcacccttctc

SEQ ID NO: 25949 - DNA, 15 bp, Homo sapiens
tttgctcacccttct

SEQ ID NO: 25950 - DNA, 15 bp, Homo sapiens
ctttgctcacccttc

SEQ ID NO: 25951 - DNA, 15 bp, Homo sapiens
cctttgctcaccctt

SEQ ID NO: 25952 - DNA, 15 bp, Homo sapiens
tcctttgctcaccct

SEQ ID NO: 25953 - DNA, 15 bp, Homo sapiens
atcctttgctcaccc

SEQ ID NO: 25954 - DNA, 15 bp, Homo sapiens
aatcctttgctcacc

SEQ ID NO: 25955 - DNA, 15 bp, Homo sapiens
taatcctttgctcac

SEQ ID NO: 25956 - DNA, 15 bp, Homo sapiens
ataatcctttgctca

SEQ ID NO: 25957 - DNA, 15 bp, Homo sapiens
gataatcctttgctc

SEQ ID NO: 25958 - DNA, 15 bp, Homo sapiens
agataatcctttgct

SEQ ID NO: 25959 - DNA, 15 bp, Homo sapiens
aagataatcctttgc

SEQ ID NO: 25960 - DNA, 15 bp, Homo sapiens
caagataatcctttg

SEQ ID NO: 25961 - DNA, 15 bp, Homo sapiens
acaagataatccttt

SEQ ID NO: 25962 - DNA, 15 bp, Homo sapiens
aacaagataatcctt

SEQ ID NO: 25963 - DNA, 15 bp, Homo sapiens
caacaagataatcct

SEQ ID NO: 25964 - DNA, 15 bp, Homo sapiens
tcaacaagataatcc

SEQ ID NO: 25965 - DNA, 15 bp, Homo sapiens
ttcaacaagataatc

SEQ ID NO: 25966 - DNA, 15 bp, Homo sapiens
tttcaacaagataat

SEQ ID NO: 25967 - DNA, 15 bp, Homo sapiens
gtttcaacaagataa

SEQ ID NO: 25968 - DNA, 15 bp, Homo sapiens
agtttcaacaagata

SEQ ID NO: 25969 - DNA, 15 bp, Homo sapiens
cagtttcaacaagat

SEQ ID NO: 25970 - DNA, 15 bp, Homo sapiens
tcagtttcaacaaga

SEQ ID NO: 25971 - DNA, 15 bp, Homo sapiens
atcagtttcaacaag

SEQ ID NO: 25972 - DNA, 15 bp, Homo sapiens
aatcagtttcaacaa

SEQ ID NO: 25973 - DNA, 15 bp, Homo sapiens
gaatcagtttcaaca

SEQ ID NO: 25974 - DNA, 15 bp, Homo sapiens
ggaatcagtttcaac

SEQ ID NO: 25975 - DNA, 15 bp, Homo sapiens
aggaatcagtttcaa

SEQ ID NO: 25976 - DNA, 15 bp, Homo sapiens
caggaatcagtttca

SEQ ID NO: 25977 - DNA, 15 bp, Homo sapiens
ccaggaatcagtttc

SEQ ID NO: 25978 - DNA, 15 bp, Homo sapiens
tccaggaatcagttt

SEQ ID NO: 25979 - DNA, 15 bp, Homo sapiens
ctccaggaatcagtt

SEQ ID NO: 25980 - DNA, 15 bp, Homo sapiens
tctccaggaatcagt

SEQ ID NO: 25981 - DNA, 15 bp, Homo sapiens
ctctccaggaatcag

SEQ ID NO: 25982 - DNA, 15 bp, Homo sapiens
tctctccaggaatca

SEQ ID NO: 25983 - DNA, 15 bp, Homo sapiens
gtctctccaggaatc

SEQ ID NO: 25984 - DNA, 15 bp, Homo sapiens
agtctctccaggaat

SEQ ID NO: 25985 - DNA, 15 bp, Homo sapiens
cagtctctccaggaa

SEQ ID NO: 25986 - DNA, 15 bp, Homo sapiens
tcagtctctccagga

SEQ ID NO: 25987 - DNA, 15 bp, Homo sapiens
ctcagtctctccagg

SEQ ID NO: 25988 - DNA, 15 bp, Homo sapiens
gctcagtctctccag

SEQ ID NO: 25989 - DNA, 15 bp, Homo sapiens
tgctcagtctctcca

SEQ ID NO: 25990 - DNA, 15 bp, Homo sapiens
gtgctcagtctctcc

SEQ ID NO: 25991 - DNA, 15 bp, Homo sapiens
ggtgctcagtctctc

SEQ ID NO: 25992 - DNA, 15 bp, Homo sapiens
cggtgctcagtctct

SEQ ID NO: 25993 - DNA, 15 bp, Homo sapiens
acggtgctcagtctc

SEQ ID NO: 25994 - DNA, 15 bp, Homo sapiens
tacggtgctcagtct

SEQ ID NO: 25995 - DNA, 15 bp, Homo sapiens
gtacggtgctcagtc

SEQ ID NO: 25996 - DNA, 15 bp, Homo sapiens
ggtacggtgctcagt

SEQ ID NO: 25997 - DNA, 15 bp, Homo sapiens
aggtacggtgctcag

SEQ ID NO: 25998 - DNA, 15 bp, Homo sapiens
caggtacggtgctca

SEQ ID NO: 25999 - DNA, 15 bp, Homo sapiens
tcaggtacggtgctc

SEQ ID NO: 26000 - DNA, 15 bp, Homo sapiens
ctcaggtacggtgct

SEQ ID NO: 26001 - DNA, 15 bp, Homo sapiens
actcaggtacggtgc

SEQ ID NO: 26002 - DNA, 15 bp, Homo sapiens
aactcaggtacggtg

SEQ ID NO: 26003 - DNA, 15 bp, Homo sapiens
gaactcaggtacggt

SEQ ID NO: 26004 - DNA, 15 bp, Homo sapiens
tgaactcaggtacgg

SEQ ID NO: 26005 - DNA, 15 bp, Homo sapiens
ttgaactcaggtacg

SEQ ID NO: 26006 - DNA, 15 bp, Homo sapiens
tttgaactcaggtac

SEQ ID NO: 26007 - DNA, 15 bp, Homo sapiens
gtttgaactcaggta

SEQ ID NO: 26008 - DNA, 15 bp, Homo sapiens
agtttgaactcaggt

SEQ ID NO: 26009 - DNA, 15 bp, Homo sapiens
aagtttgaactcagg

SEQ ID NO: 26010 - DNA, 15 bp, Homo sapiens
caagtttgaactcag

SEQ ID NO: 26011 - DNA, 15 bp, Homo sapiens
ccaagtttgaactca

SEQ ID NO: 26012 - DNA, 15 bp, Homo sapiens
cccaagtttgaactc

SEQ ID NO: 26013 - DNA, 15 bp, Homo sapiens
tcccaagtttgaact

SEQ ID NO: 26014 - DNA, 15 bp, Homo sapiens
ttcccaagtttgaac

SEQ ID NO: 26015 - DNA, 15 bp, Homo sapiens
attcccaagtttgaa

SEQ ID NO: 26016 - DNA, 15 bp, Homo sapiens
cattcccaagtttga

SEQ ID NO: 26017 - DNA, 15 bp, Homo sapiens
acattcccaagtttg

SEQ ID NO: 26018 - DNA, 15 bp, Homo sapiens
aacattcccaagttt

SEQ ID NO: 26019 - DNA, 15 bp, Homo sapiens
gaacattcccaagtt

SEQ ID NO: 26020 - DNA, 15 bp, Homo sapiens
agaacattcccaagt

SEQ ID NO: 26021 - DNA, 15 bp, Homo sapiens
tagaacattcccaag

SEQ ID NO: 26022 - DNA, 15 bp, Homo sapiens
ctagaacattcccaa

SEQ ID NO: 26023 - DNA, 15 bp, Homo sapiens
tctagaacattccca

SEQ ID NO: 26024 - DNA, 15 bp, Homo sapiens
atctagaacattccc

SEQ ID NO: 26025 - DNA, 15 bp, Homo sapiens
catctagaacattcc

SEQ ID NO: 26026 - DNA, 15 bp, Homo sapiens
ccatctagaacattc

SEQ ID NO: 26027 - DNA, 15 bp, Homo sapiens
accatctagaacatt

SEQ ID NO: 26028 - DNA, 15 bp, Homo sapiens
caccatctagaacat

SEQ ID NO: 26029 - DNA, 15 bp, Homo sapiens
tcaccatctagaaca

SEQ ID NO: 26030 - DNA, 15 bp, Homo sapiens
gtcaccatctagaac

SEQ ID NO: 26031 - DNA, 15 bp, Homo sapiens
agtcaccatctagaa

SEQ ID NO: 26032 - DNA, 15 bp, Homo sapiens
gagtcaccatctaga

SEQ ID NO: 26033 - DNA, 15 bp, Homo sapiens
tgagtcaccatctag

SEQ ID NO: 26034 - DNA, 15 bp, Homo sapiens
ctgagtcaccatcta

SEQ ID NO: 26035 - DNA, 15 bp, Homo sapiens
cctgagtcaccatct

SEQ ID NO: 26036 - DNA, 15 bp, Homo sapiens
gcctgagtcaccatc

SEQ ID NO: 26037 - DNA, 15 bp, Homo sapiens
ggcctgagtcaccat

SEQ ID NO: 26038 - DNA, 15 bp, Homo sapiens
gggcctgagtcacca

SEQ ID NO: 26039 - DNA, 15 bp, Homo sapiens
tgggcctgagtcacc

SEQ ID NO: 26040 - DNA, 15 bp, Homo sapiens
ctgggcctgagtcac

SEQ ID NO: 26041 - DNA, 15 bp, Homo sapiens
cctgggcctgagtca

SEQ ID NO: 26042 - DNA, 15 bp, Homo sapiens
gcctgggcctgagtc

SEQ ID NO: 26043 - DNA, 15 bp, Homo sapiens
tgcctgggcctgagt

SEQ ID NO: 26044 - DNA, 15 bp, Homo sapiens
gtgcctgggcctgag

SEQ ID NO: 26045 - DNA, 15 bp, Homo sapiens
ggtgcctgggcctga

SEQ ID NO: 26046 - DNA, 15 bp, Homo sapiens
tggtgcctgggcctg

SEQ ID NO: 26047 - DNA, 15 bp, Homo sapiens
ttggtgcctgggcct

SEQ ID NO: 26048 - DNA, 15 bp, Homo sapiens
gttggtgcctgggcc

SEQ ID NO: 26049 - DNA, 15 bp, Homo sapiens
ggttggtgcctgggc

SEQ ID NO: 26050 - DNA, 15 bp, Homo sapiens
tggttggtgcctggg

SEQ ID NO: 26051 - DNA, 15 bp, Homo sapiens
ctggttggtgcctgg

SEQ ID NO: 26052 - DNA, 15 bp, Homo sapiens
gctggttggtgcctg

SEQ ID NO: 26053 - DNA, 15 bp, Homo sapiens
tgctggttggtgcct

SEQ ID NO: 26054 - DNA, 15 bp, Homo sapiens
ctgctggttggtgcc

SEQ ID NO: 26055 - DNA, 15 bp, Homo sapiens
tctgctggttggtgc

SEQ ID NO: 26056 - DNA, 15 bp, Homo sapiens
ttctgctggttggtg

SEQ ID NO: 26057 - DNA, 15 bp, Homo sapiens
attctgctggttggt

SEQ ID NO: 26058 - DNA, 15 bp, Homo sapiens
cattctgctggttgg

SEQ ID NO: 26059 - DNA, 15 bp, Homo sapiens
ccattctgctggttg

SEQ ID NO: 26060 - DNA, 15 bp, Homo sapiens
cccattctgctggtt

SEQ ID NO: 26061 - DNA, 15 bp, Homo sapiens
gcccattctgctggt

SEQ ID NO: 26062 - DNA, 15 bp, Homo sapiens
ggcccattctgctgg

SEQ ID NO: 26063 - DNA, 15 bp, Homo sapiens
aggcccattctgctg

SEQ ID NO: 26064 - DNA, 15 bp, Homo sapiens
gaggcccattctgct

SEQ ID NO: 26065 - DNA, 15 bp, Homo sapiens
tgaggcccattctgc

SEQ ID NO: 26066 - DNA, 15 bp, Homo sapiens
ctgaggcccattctg

SEQ ID NO: 26067 - DNA, 15 bp, Homo sapiens
gctgaggcccattct

SEQ ID NO: 26068 - DNA, 15 bp, Homo sapiens
ggctgaggcccattc

SEQ ID NO: 26069 - DNA, 15 bp, Homo sapiens
aggctgaggcccatt

SEQ ID NO: 26070 - DNA, 15 bp, Homo sapiens
caggctgaggcccat

SEQ ID NO: 26071 - DNA, 15 bp, Homo sapiens
tcaggctgaggccca

SEQ ID NO: 26072 - DNA, 15 bp, Homo sapiens
gtcaggctgaggccc

SEQ ID NO: 26073 - DNA, 15 bp, Homo sapiens
tgtcaggctgaggcc

SEQ ID NO: 26074 - DNA, 15 bp, Homo sapiens
ttgtcaggctgaggc

SEQ ID NO: 26075 - DNA, 15 bp, Homo sapiens
gttgtcaggctgagg

SEQ ID NO: 26076 - DNA, 15 bp, Homo sapiens
ggttgtcaggctgag

SEQ ID NO: 26077 - DNA, 15 bp, Homo sapiens
gggttgtcaggctga

SEQ ID NO: 26078 - DNA, 15 bp, Homo sapiens
agggttgtcaggctg

SEQ ID NO: 26079 - DNA, 15 bp, Homo sapiens
aagggttgtcaggct

SEQ ID NO: 26080 - DNA, 15 bp, Homo sapiens
gaagggttgtcaggc

SEQ ID NO: 26081 - DNA, 15 bp, Homo sapiens
agaagggttgtcagg

SEQ ID NO: 26082 - DNA, 15 bp, Homo sapiens
cagaagggttgtcag

SEQ ID NO: 26083 - DNA, 15 bp, Homo sapiens
acagaagggttgtca

SEQ ID NO: 26084 - DNA, 15 bp, Homo sapiens
tacagaagggttgtc

SEQ ID NO: 26085 - DNA, 15 bp, Homo sapiens
gtacagaagggttgt

SEQ ID NO: 26086 - DNA, 15 bp, Homo sapiens
ggtacagaagggttg

SEQ ID NO: 26087 - DNA, 15 bp, Homo sapiens
tggtacagaagggtt

SEQ ID NO: 26088 - DNA, 15 bp, Homo sapiens
ctggtacagaagggt

SEQ ID NO: 26089 - DNA, 15 bp, Homo sapiens
cctggtacagaaggg

SEQ ID NO: 26090 - DNA, 15 bp, Homo sapiens
gcctggtacagaagg

SEQ ID NO: 26091 - DNA, 15 bp, Homo sapiens
ggcctggtacagaag

SEQ ID NO: 26092 - DNA, 15 bp, Homo sapiens
aggcctggtacagaa

SEQ ID NO: 26093 - DNA, 15 bp, Homo sapiens
caggcctggtacaga

SEQ ID NO: 26094 - DNA, 15 bp, Homo sapiens
tcaggcctggtacag

SEQ ID NO: 26095 - DNA, 15 bp, Homo sapiens
gtcaggcctggtaca

SEQ ID NO: 26096 - DNA, 15 bp, Homo sapiens
agtcaggcctggtac

SEQ ID NO: 26097 - DNA, 15 bp, Homo sapiens
gagtcaggcctggta

SEQ ID NO: 26098 - DNA, 15 bp, Homo sapiens
agagtcaggcctggt

SEQ ID NO: 26099 - DNA, 15 bp, Homo sapiens
aagagtcaggcctgg

SEQ ID NO: 26100 - DNA, 15 bp, Homo sapiens
aaagagtcaggcctg

SEQ ID NO: 26101 - DNA, 15 bp, Homo sapiens
caaagagtcaggcct

SEQ ID NO: 26102 - DNA, 15 bp, Homo sapiens
ccaaagagtcaggcc

SEQ ID NO: 26103 - DNA, 15 bp, Homo sapiens
accaaagagtcaggc

SEQ ID NO: 26104 - DNA, 15 bp, Homo sapiens
aaccaaagagtcagg

SEQ ID NO: 26105 - DNA, 15 bp, Homo sapiens
caaccaaagagtcag

SEQ ID NO: 26106 - DNA, 15 bp, Homo sapiens
gcaaccaaagagtca

SEQ ID NO: 26107 - DNA, 15 bp, Homo sapiens
agcaaccaaagagtc

SEQ ID NO: 26108 - DNA, 15 bp, Homo sapiens
cagcaaccaaagagt

SEQ ID NO: 26109 - DNA, 15 bp, Homo sapiens
tcagcaaccaaagag

SEQ ID NO: 26110 - DNA, 15 bp, Homo sapiens
ttcagcaaccaaaga

SEQ ID NO: 26111 - DNA, 15 bp, Homo sapiens
gttcagcaaccaaag

SEQ ID NO: 26112 - DNA, 15 bp, Homo sapiens
agttcagcaaccaaa

SEQ ID NO: 26113 - DNA, 15 bp, Homo sapiens
aagttcagcaaccaa

SEQ ID NO: 26114 - DNA, 15 bp, Homo sapiens
aaagttcagcaacca

SEQ ID NO: 26115 - DNA, 15 bp, Homo sapiens
caaagttcagcaacc

SEQ ID NO: 26116 - DNA, 15 bp, Homo sapiens
ccaaagttcagcaac

SEQ ID NO: 26117 - DNA, 15 bp, Homo sapiens
tccaaagttcagcaa

SEQ ID NO: 26118 - DNA, 15 bp, Homo sapiens
ctccaaagttcagca

SEQ ID NO: 26119 - DNA, 15 bp, Homo sapiens
tctccaaagttcagc

SEQ ID NO: 26120 - DNA, 15 bp, Homo sapiens
ctctccaaagttcag

SEQ ID NO: 26121 - DNA, 15 bp, Homo sapiens
cctctccaaagttca

SEQ ID NO: 26122 - DNA, 15 bp, Homo sapiens
gcctctccaaagttc

SEQ ID NO: 26123 - DNA, 15 bp, Homo sapiens
ggcctctccaaagtt

SEQ ID NO: 26124 - DNA, 15 bp, Homo sapiens
aggcctctccaaagt

SEQ ID NO: 26125 - DNA, 15 bp, Homo sapiens
caggcctctccaaag

SEQ ID NO: 26126 - DNA, 15 bp, Homo sapiens
ccaggcctctccaaa

SEQ ID NO: 26127 - DNA, 15 bp, Homo sapiens
cccaggcctctccaa

SEQ ID NO: 26128 - DNA, 15 bp, Homo sapiens
ccccaggcctctcca

SEQ ID NO: 26129 - DNA, 15 bp, Homo sapiens
cccccaggcctctcc

SEQ ID NO: 26130 - DNA, 15 bp, Homo sapiens
ccccccaggcctctc

SEQ ID NO: 26131 - DNA, 15 bp, Homo sapiens
cccccccaggcctct

SEQ ID NO: 26132 - DNA, 15 bp, Homo sapiens
acccccccaggcctc

SEQ ID NO: 26133 - DNA, 15 bp, Homo sapiens
gacccccccaggcct

SEQ ID NO: 26134 - DNA, 15 bp, Homo sapiens
tgacccccccaggcc

SEQ ID NO: 26135 - DNA, 15 bp, Homo sapiens
ctgacccccccaggc

SEQ ID NO: 26136 - DNA, 15 bp, Homo sapiens
gctgacccccccagg

SEQ ID NO: 26137 - DNA, 15 bp, Homo sapiens
cgctgacccccccag

SEQ ID NO: 26138 - DNA, 15 bp, Homo sapiens
ccgctgaccccccca

SEQ ID NO: 26139 - DNA, 15 bp, Homo sapiens
gccgctgaccccccc

SEQ ID NO: 26140 - DNA, 15 bp, Homo sapiens
tgccgctgacccccc

SEQ ID NO: 26141 - DNA, 15 bp, Homo sapiens
ctgccgctgaccccc

SEQ ID NO: 26142 - DNA, 15 bp, Homo sapiens
cctgccgctgacccc

SEQ ID NO: 26143 - DNA, 15 bp, Homo sapiens
gcctgccgctgaccc

SEQ ID NO: 26144 - DNA, 15 bp, Homo sapiens
tgcctgccgctgacc

SEQ ID NO: 26145 - DNA, 15 bp, Homo sapiens
ctgcctgccgctgac

SEQ ID NO: 26146 - DNA, 15 bp, Homo sapiens
tctgcctgccgctga

SEQ ID NO: 26147 - DNA, 15 bp, Homo sapiens
gtctgcctgccgctg

SEQ ID NO: 26148 - DNA, 15 bp, Homo sapiens
cgtctgcctgccgct

SEQ ID NO: 26149 - DNA, 15 bp, Homo sapiens
tcgtctgcctgccgc

SEQ ID NO: 26150 - DNA, 15 bp, Homo sapiens
ctcgtctgcctgccg

SEQ ID NO: 26151 - DNA, 15 bp, Homo sapiens
actcgtctgcctgcc

SEQ ID NO: 26152 - DNA, 15 bp, Homo sapiens
cactcgtctgcctgc

SEQ ID NO: 26153 - DNA, 15 bp, Homo sapiens
tcactcgtctgcctg

SEQ ID NO: 26154 - DNA, 15 bp, Homo sapiens
ctcactcgtctgcct

SEQ ID NO: 26155 - DNA, 15 bp, Homo sapiens
actcactcgtctgcc

SEQ ID NO: 26156 - DNA, 15 bp, Homo sapiens
cactcactcgtctgc

SEQ ID NO: 26157 - DNA, 15 bp, Homo sapiens
ccactcactcgtctg

SEQ ID NO: 26158 - DNA, 15 bp, Homo sapiens
gccactcactcgtct

SEQ ID NO: 26159 - DNA, 15 bp, Homo sapiens
agccactcactcgtc

SEQ ID NO: 26160 - DNA, 15 bp, Homo sapiens
aagccactcactcgt

SEQ ID NO: 26161 - DNA, 15 bp, Homo sapiens
aaagccactcactcg

SEQ ID NO: 26162 - DNA, 15 bp, Homo sapiens
caaagccactcactc

SEQ ID NO: 26163 - DNA, 15 bp, Homo sapiens
ccaaagccactcact

SEQ ID NO: 26164 - DNA, 15 bp, Homo sapiens
accaaagccactcac

SEQ ID NO: 26165 - DNA, 15 bp, Homo sapiens
caccaaagccactca

SEQ ID NO: 26166 - DNA, 15 bp, Homo sapiens
tcaccaaagccactc

SEQ ID NO: 26167 - DNA, 15 bp, Homo sapiens
gtcaccaaagccact

SEQ ID NO: 26168 - DNA, 15 bp, Homo sapiens
tgtcaccaaagccac

SEQ ID NO: 26169 - DNA, 15 bp, Homo sapiens
ctgtcaccaaagcca

SEQ ID NO: 26170 - DNA, 15 bp, Homo sapiens
cctgtcaccaaagcc

SEQ ID NO: 26171 - DNA, 15 bp, Homo sapiens
acctgtcaccaaagc

SEQ ID NO: 26172 - DNA, 15 bp, Homo sapiens
gacctgtcaccaaag

SEQ ID NO: 26173 - DNA, 15 bp, Homo sapiens
ggacctgtcaccaaa

SEQ ID NO: 26174 - DNA, 15 bp, Homo sapiens
aggacctgtcaccaa

SEQ ID NO: 26175 - DNA, 15 bp, Homo sapiens
gaggacctgtcacca

SEQ ID NO: 26176 - DNA, 15 bp, Homo sapiens
tgaggacctgtcacc

SEQ ID NO: 26177 - DNA, 15 bp, Homo sapiens
ctgaggacctgtcac

SEQ ID NO: 26178 - DNA, 15 bp, Homo sapiens
cctgaggacctgtca

SEQ ID NO: 26179 - DNA, 15 bp, Homo sapiens
ccctgaggacctgtc

SEQ ID NO: 26180 - DNA, 15 bp, Homo sapiens
cccctgaggacctgt

SEQ ID NO: 26181 - DNA, 15 bp, Homo sapiens
gcccctgaggacctg

SEQ ID NO: 26182 - DNA, 15 bp, Homo sapiens
tgcccctgaggacct

SEQ ID NO: 26183 - DNA, 15 bp, Homo sapiens
ctgcccctgaggacc

SEQ ID NO: 26184 - DNA, 15 bp, Homo sapiens
gctgcccctgaggac

SEQ ID NO: 26185 - DNA, 15 bp, Homo sapiens
ggctgcccctgagga

SEQ ID NO: 26186 - DNA, 15 bp, Homo sapiens
tggctgcccctgagg

SEQ ID NO: 26187 - DNA, 15 bp, Homo sapiens
ctggctgcccctgag

SEQ ID NO: 26188 - DNA, 15 bp, Homo sapiens
cctggctgcccctga

SEQ ID NO: 26189 - DNA, 15 bp, Homo sapiens
gcctggctgcccctg

SEQ ID NO: 26190 - DNA, 15 bp, Homo sapiens
tgcctggctgcccct

SEQ ID NO: 26191 - DNA, 15 bp, Homo sapiens
ctgcctggctgcccc

SEQ ID NO: 26192 - DNA, 15 bp, Homo sapiens
actgcctggctgccc

SEQ ID NO: 26193 - DNA, 15 bp, Homo sapiens
cactgcctggctgcc

SEQ ID NO: 26194 - DNA, 15 bp, Homo sapiens
acactgcctggctgc

SEQ ID NO: 26195 - DNA, 15 bp, Homo sapiens
cacactgcctggctg

SEQ ID NO: 26196 - DNA, 15 bp, Homo sapiens
tcacactgcctggct

SEQ ID NO: 26197 - DNA, 15 bp, Homo sapiens
gtcacactgcctggc

SEQ ID NO: 26198 - DNA, 15 bp, Homo sapiens
agtcacactgcctgg

SEQ ID NO: 26199 - DNA, 15 bp, Homo sapiens
gagtcacactgcctg

SEQ ID NO: 26200 - DNA, 15 bp, Homo sapiens
agagtcacactgcct

SEQ ID NO: 26201 - DNA, 15 bp, Homo sapiens
gagagtcacactgcc

SEQ ID NO: 26202 - DNA, 15 bp, Homo sapiens
cgagagtcacactgc

SEQ ID NO: 26203 - DNA, 15 bp, Homo sapiens
acgagagtcacactg

SEQ ID NO: 26204 - DNA, 15 bp, Homo sapiens
aacgagagtcacact

SEQ ID NO: 26205 - DNA, 15 bp, Homo sapiens
gaacgagagtcacac

SEQ ID NO: 26206 - DNA, 15 bp, Homo sapiens
tgaacgagagtcaca

SEQ ID NO: 26207 - DNA, 15 bp, Homo sapiens
ttgaacgagagtcac

SEQ ID NO: 26208 - DNA, 15 bp, Homo sapiens
attgaacgagagtca

SEQ ID NO: 26209 - DNA, 15 bp, Homo sapiens
tattgaacgagagtc

SEQ ID NO: 26210 - DNA, 15 bp, Homo sapiens
ctattgaacgagagt

SEQ ID NO: 26211 - DNA, 15 bp, Homo sapiens
actattgaacgagag

SEQ ID NO: 26212 - DNA, 15 bp, Homo sapiens
tactattgaacgaga

SEQ ID NO: 26213 - DNA, 15 bp, Homo sapiens
ttactattgaacgag

SEQ ID NO: 26214 - DNA, 15 bp, Homo sapiens
gttactattgaacga

SEQ ID NO: 26215 - DNA, 15 bp, Homo sapiens
cgttactattgaacg

SEQ ID NO: 26216 - DNA, 15 bp, Homo sapiens
acgttactattgaac

SEQ ID NO: 26217 - DNA, 15 bp, Homo sapiens
aacgttactattgaa

SEQ ID NO: 26218 - DNA, 15 bp, Homo sapiens
aaacgttactattga

SEQ ID NO: 26219 - DNA, 15 bp, Homo sapiens
caaacgttactattg

SEQ ID NO: 26220 - DNA, 15 bp, Homo sapiens
acaaacgttactatt

SEQ ID NO: 26221 - DNA, 15 bp, Homo sapiens
gacaaacgttactat

SEQ ID NO: 26222 - DNA, 15 bp, Homo sapiens
tgacaaacgttacta

SEQ ID NO: 26223 - DNA, 15 bp, Homo sapiens
ctgacaaacgttact

SEQ ID NO: 26224 - DNA, 15 bp, Homo sapiens
tctgacaaacgttac

SEQ ID NO: 26225 - DNA, 15 bp, Homo sapiens
ctctgacaaacgtta

SEQ ID NO: 26226 - DNA, 15 bp, Homo sapiens
gctctgacaaacgtt

SEQ ID NO: 26227 - DNA, 15 bp, Homo sapiens
cgctctgacaaacgt

SEQ ID NO: 26228 - DNA, 15 bp, Homo sapiens
acgctctgacaaacg

SEQ ID NO: 26229 - DNA, 15 bp, Homo sapiens
aacgctctgacaaac

SEQ ID NO: 26230 - DNA, 15 bp, Homo sapiens
caacgctctgacaaa

SEQ ID NO: 26231 - DNA, 15 bp, Homo sapiens
acaacgctctgacaa

SEQ ID NO: 26232 - DNA, 15 bp, Homo sapiens
gacaacgctctgaca

SEQ ID NO: 26233 - DNA, 15 bp, Homo sapiens
tgacaacgctctgac

SEQ ID NO: 26234 - DNA, 15 bp, Homo sapiens
gtgacaacgctctga

SEQ ID NO: 26235 - DNA, 15 bp, Homo sapiens
ggtgacaacgctctg

SEQ ID NO: 26236 - DNA, 15 bp, Homo sapiens
tggtgacaacgctct

SEQ ID NO: 26237 - DNA, 15 bp, Homo sapiens
gtggtgacaacgctc

SEQ ID NO: 26238 - DNA, 15 bp, Homo sapiens
ggtggtgacaacgct

SEQ ID NO: 26239 - DNA, 15 bp, Homo sapiens
tggtggtgacaacgc

SEQ ID NO: 26240 - DNA, 15 bp, Homo sapiens
atggtggtgacaacg

SEQ ID NO: 26241 - DNA, 15 bp, Homo sapiens
gatggtggtgacaac

SEQ ID NO: 26242 - DNA, 15 bp, Homo sapiens
ggatggtggtgacaa

SEQ ID NO: 26243 - DNA, 15 bp, Homo sapiens
cggatggtggtgaca

SEQ ID NO: 26244 - DNA, 15 bp, Homo sapiens
gcggatggtggtgac

SEQ ID NO: 26245 - DNA, 15 bp, Homo sapiens
agcggatggtggtga

SEQ ID NO: 26246 - DNA, 15 bp, Homo sapiens
gagcggatggtggtg

SEQ ID NO: 26247 - DNA, 15 bp, Homo sapiens
agagcggatggtggt

SEQ ID NO: 26248 - DNA, 15 bp, Homo sapiens
cagagcggatggtgg

SEQ ID NO: 26249 - DNA, 15 bp, Homo sapiens
gcagagcggatggtg

SEQ ID NO: 26250 - DNA, 15 bp, Homo sapiens
ggcagagcggatggt

SEQ ID NO: 26251 - DNA, 15 bp, Homo sapiens
gggcagagcggatgg

SEQ ID NO: 26252 - DNA, 15 bp, Homo sapiens
agggcagagcggatg

SEQ ID NO: 26253 - DNA, 15 bp, Homo sapiens
tagggcagagcggat

SEQ ID NO: 26254 - DNA, 15 bp, Homo sapiens
atagggcagagcgga

SEQ ID NO: 26255 - DNA, 15 bp, Homo sapiens
gatagggcagagcgg

SEQ ID NO: 26256 - DNA, 15 bp, Homo sapiens
agatagggcagagcg

SEQ ID NO: 26257 - DNA, 15 bp, Homo sapiens
gagatagggcagagc

SEQ ID NO: 26258 - DNA, 15 bp, Homo sapiens
agagatagggcagag

SEQ ID NO: 26259 - DNA, 15 bp, Homo sapiens
cagagatagggcaga

SEQ ID NO: 26260 - DNA, 15 bp, Homo sapiens
tcagagatagggcag

SEQ ID NO: 26261 - DNA, 15 bp, Homo sapiens
gtcagagatagggca

SEQ ID NO: 26262 - DNA, 15 bp, Homo sapiens
tgtcagagatagggc

SEQ ID NO: 26263 - DNA, 15 bp, Homo sapiens
atgtcagagataggg

SEQ ID NO: 26264 - DNA, 15 bp, Homo sapiens
aatgtcagagatagg

SEQ ID NO: 26265 - DNA, 15 bp, Homo sapiens
caatgtcagagatag

SEQ ID NO: 26266 - DNA, 15 bp, Homo sapiens
gcaatgtcagagata

SEQ ID NO: 26267 - DNA, 15 bp, Homo sapiens
agcaatgtcagagat

SEQ ID NO: 26268 - DNA, 15 bp, Homo sapiens
tagcaatgtcagaga

SEQ ID NO: 26269 - DNA, 15 bp, Homo sapiens
atagcaatgtcagag

SEQ ID NO: 26270 - DNA, 15 bp, Homo sapiens
catagcaatgtcaga

SEQ ID NO: 26271 - DNA, 15 bp, Homo sapiens
ccatagcaatgtcag

SEQ ID NO: 26272 - DNA, 15 bp, Homo sapiens
tccatagcaatgtca

SEQ ID NO: 26273 - DNA, 15 bp, Homo sapiens
ctccatagcaatgtc

SEQ ID NO: 26274 - DNA, 15 bp, Homo sapiens
tctccatagcaatgt

SEQ ID NO: 26275 - DNA, 15 bp, Homo sapiens
ctctccatagcaatg

SEQ ID NO: 26276 - DNA, 15 bp, Homo sapiens
gctctccatagcaat

SEQ ID NO: 26277 - DNA, 15 bp, Homo sapiens
ggctctccatagcaa

SEQ ID NO: 26278 - DNA, 15 bp, Homo sapiens
aggctctccatagca

SEQ ID NO: 26279 - DNA, 15 bp, Homo sapiens
gaggctctccatagc

SEQ ID NO: 26280 - DNA, 15 bp, Homo sapiens
agaggctctccatag

SEQ ID NO: 26281 - DNA, 15 bp, Homo sapiens
tagaggctctccata

SEQ ID NO: 26282 - DNA, 15 bp, Homo sapiens
ttagaggctctccat

SEQ ID NO: 26283 - DNA, 15 bp, Homo sapiens
attagaggctctcca

SEQ ID NO: 26284 - DNA, 15 bp, Homo sapiens
aattagaggctctcc

SEQ ID NO: 26285 - DNA, 15 bp, Homo sapiens
caattagaggctctc

SEQ ID NO: 26286 - DNA, 15 bp, Homo sapiens
acaattagaggctct

SEQ ID NO: 26287 - DNA, 15 bp, Homo sapiens
aacaattagaggctc

SEQ ID NO: 26288 - DNA, 15 bp, Homo sapiens
gaacaattagaggct

SEQ ID NO: 26289 - DNA, 15 bp, Homo sapiens
ggaacaattagaggc

SEQ ID NO: 26290 - DNA, 15 bp, Homo sapiens
aggaacaattagagg

SEQ ID NO: 26291 - DNA, 15 bp, Homo sapiens
aaggaacaattagag

SEQ ID NO: 26292 - DNA, 15 bp, Homo sapiens
caaggaacaattaga

SEQ ID NO: 26293 - DNA, 15 bp, Homo sapiens
acaaggaacaattag

SEQ ID NO: 26294 - DNA, 15 bp, Homo sapiens
cacaaggaacaatta

SEQ ID NO: 26295 - DNA, 15 bp, Homo sapiens
acacaaggaacaatt

SEQ ID NO: 26296 - DNA, 15 bp, Homo sapiens
gacacaaggaacaat

SEQ ID NO: 26297 - DNA, 15 bp, Homo sapiens
agacacaaggaacaa

SEQ ID NO: 26298 - DNA, 15 bp, Homo sapiens
aagacacaaggaaca

SEQ ID NO: 26299 - DNA, 15 bp, Homo sapiens
aaagacacaaggaac

SEQ ID NO: 26300 - DNA, 15 bp, Homo sapiens
gaaagacacaaggaa

SEQ ID NO: 26301 - DNA, 15 bp, Homo sapiens
agaaagacacaagga

SEQ ID NO: 26302 - DNA, 15 bp, Homo sapiens
cagaaagacacaagg

SEQ ID NO: 26303 - DNA, 15 bp, Homo sapiens
acagaaagacacaag

SEQ ID NO: 26304 - DNA, 15 bp, Homo sapiens
aacagaaagacacaa

SEQ ID NO: 26305 - DNA, 15 bp, Homo sapiens
aaacagaaagacaca

SEQ ID NO: 26306 - DNA, 15 bp, Homo sapiens
caaacagaaagacac

SEQ ID NO: 26307 - DNA, 15 bp, Homo sapiens
acaaacagaaagaca

SEQ ID NO: 26308 - DNA, 15 bp, Homo sapiens
gacaaacagaaagac

SEQ ID NO: 26309 - DNA, 15 bp, Homo sapiens
ggacaaacagaaaga

SEQ ID NO: 26310 - DNA, 15 bp, Homo sapiens
gggacaaacagaaag

SEQ ID NO: 26311 - DNA, 15 bp, Homo sapiens
ggggacaaacagaaa

SEQ ID NO: 26312 - DNA, 15 bp, Homo sapiens
tggggacaaacagaa

SEQ ID NO: 26313 - DNA, 15 bp, Homo sapiens
gtggggacaaacaga

SEQ ID NO: 26314 - DNA, 15 bp, Homo sapiens
tgtggggacaaacag

SEQ ID NO: 26315 - DNA, 15 bp, Homo sapiens
ctgtggggacaaaca

SEQ ID NO: 26316 - DNA, 15 bp, Homo sapiens
actgtggggacaaac

SEQ ID NO: 26317 - DNA, 15 bp, Homo sapiens
gactgtggggacaaa

SEQ ID NO: 26318 - DNA, 15 bp, Homo sapiens
ggactgtggggacaa

SEQ ID NO: 26319 - DNA, 15 bp, Homo sapiens
gggactgtggggaca

SEQ ID NO: 26320 - DNA, 15 bp, Homo sapiens
ggggactgtggggac

SEQ ID NO: 26321 - DNA, 15 bp, Homo sapiens
tggggactgtgggga

SEQ ID NO: 26322 - DNA, 15 bp, Homo sapiens
ctggggactgtgggg

SEQ ID NO: 26323 - DNA, 15 bp, Homo sapiens
cctggggactgtggg

SEQ ID NO: 26324 - DNA, 15 bp, Homo sapiens
ccctggggactgtgg

SEQ ID NO: 26325 - DNA, 15 bp, Homo sapiens
tccctggggactgtg

SEQ ID NO: 26326 - DNA, 15 bp, Homo sapiens
ttccctggggactgt

SEQ ID NO: 26327 - DNA, 15 bp, Homo sapiens
tttccctggggactg

SEQ ID NO: 26328 - DNA, 15 bp, Homo sapiens
ttttccctggggact

SEQ ID NO: 26329 - DNA, 15 bp, Homo sapiens
cttttccctggggac

SEQ ID NO: 26330 - DNA, 15 bp, Homo sapiens
gcttttccctgggga

SEQ ID NO: 26331 - DNA, 15 bp, Homo sapiens
ggcttttccctgggg

SEQ ID NO: 26332 - DNA, 15 bp, Homo sapiens
aggcttttccctggg

SEQ ID NO: 26333 - DNA, 15 bp, Homo sapiens
aaggcttttccctgg

SEQ ID NO: 26334 - DNA, 15 bp, Homo sapiens
aaaggcttttccctg

SEQ ID NO: 26335 - DNA, 15 bp, Homo sapiens
gaaaggcttttccct

SEQ ID NO: 26336 - DNA, 15 bp, Homo sapiens
cgaaaggcttttccc

SEQ ID NO: 26337 - DNA, 15 bp, Homo sapiens
gcgaaaggcttttcc

SEQ ID NO: 26338 - DNA, 15 bp, Homo sapiens
agcgaaaggcttttc

SEQ ID NO: 26339 - DNA, 15 bp, Homo sapiens
gagcgaaaggctttt

SEQ ID NO: 26340 - DNA, 15 bp, Homo sapiens
agagcgaaaggcttt

SEQ ID NO: 26341 - DNA, 15 bp, Homo sapiens
tagagcgaaaggctt

SEQ ID NO: 26342 - DNA, 15 bp, Homo sapiens
ttagagcgaaaggct

SEQ ID NO: 26343 - DNA, 15 bp, Homo sapiens
tttagagcgaaaggc

SEQ ID NO: 26344 - DNA, 15 bp, Homo sapiens
ctttagagcgaaagg

SEQ ID NO: 26345 - DNA, 15 bp, Homo sapiens
actttagagcgaaag

SEQ ID NO: 26346 - DNA, 15 bp, Homo sapiens
cactttagagcgaaa

SEQ ID NO: 26347 - DNA, 15 bp, Homo sapiens
ccactttagagcgaa

SEQ ID NO: 26348 - DNA, 15 bp, Homo sapiens
tccactttagagcga

SEQ ID NO: 26349 - DNA, 15 bp, Homo sapiens
ctccactttagagcg

SEQ ID NO: 26350 - DNA, 15 bp, Homo sapiens
actccactttagagc

SEQ ID NO: 26351 - DNA, 15 bp, Homo sapiens
aactccactttagag

SEQ ID NO: 26352 - DNA, 15 bp, Homo sapiens
caactccactttaga

SEQ ID NO: 26353 - DNA, 15 bp, Homo sapiens
tcaactccactttag

SEQ ID NO: 26354 - DNA, 15 bp, Homo sapiens
atcaactccacttta

SEQ ID NO: 26355 - DNA, 15 bp, Homo sapiens
aatcaactccacttt

SEQ ID NO: 26356 - DNA, 15 bp, Homo sapiens
caatcaactccactt

SEQ ID NO: 26357 - DNA, 15 bp, Homo sapiens
gcaatcaactccact

SEQ ID NO: 26358 - DNA, 15 bp, Homo sapiens
cgcaatcaactccac

SEQ ID NO: 26359 - DNA, 15 bp, Homo sapiens
acgcaatcaactcca

SEQ ID NO: 26360 - DNA, 15 bp, Homo sapiens
tacgcaatcaactcc

SEQ ID NO: 26361 - DNA, 15 bp, Homo sapiens
gtacgcaatcaactc

SEQ ID NO: 26362 - DNA, 15 bp, Homo sapiens
agtacgcaatcaact

SEQ ID NO: 26363 - DNA, 15 bp, Homo sapiens
aagtacgcaatcaac

SEQ ID NO: 26364 - DNA, 15 bp, Homo sapiens
gaagtacgcaatcaa

SEQ ID NO: 26365 - DNA, 15 bp, Homo sapiens
cgaagtacgcaatca

SEQ ID NO: 26366 - DNA, 15 bp, Homo sapiens
tcgaagtacgcaatc

SEQ ID NO: 26367 - DNA, 15 bp, Homo sapiens
ttcgaagtacgcaat

SEQ ID NO: 26368 - DNA, 15 bp, Homo sapiens
tttcgaagtacgcaa

SEQ ID NO: 26369 - DNA, 15 bp, Homo sapiens
ttttcgaagtacgca

SEQ ID NO: 26370 - DNA, 15 bp, Homo sapiens
cttttcgaagtacgc

SEQ ID NO: 26371 - DNA, 15 bp, Homo sapiens
ccttttcgaagtacg

SEQ ID NO: 26372 - DNA, 15 bp, Homo sapiens
accttttcgaagtac

SEQ ID NO: 26373 - DNA, 15 bp, Homo sapiens
taccttttcgaagta

SEQ ID NO: 26374 - DNA, 15 bp, Homo sapiens
ctaccttttcgaagt

SEQ ID NO: 26375 - DNA, 15 bp, Homo sapiens
cctaccttttcgaag

SEQ ID NO: 26376 - DNA, 15 bp, Homo sapiens
gcctaccttttcgaa

SEQ ID NO: 26377 - DNA, 15 bp, Homo sapiens
cgcctaccttttcga

SEQ ID NO: 26378 - DNA, 15 bp, Homo sapiens
tcgcctaccttttcg

SEQ ID NO: 26379 - DNA, 15 bp, Homo sapiens
gtcgcctaccttttc

SEQ ID NO: 26380 - DNA, 15 bp, Homo sapiens
tgtcgcctacctttt

SEQ ID NO: 26381 - DNA, 15 bp, Homo sapiens
gtgtcgcctaccttt

SEQ ID NO: 26382 - DNA, 15 bp, Homo sapiens
tgtgtcgcctacctt

SEQ ID NO: 26383 - DNA, 15 bp, Homo sapiens
atgtgtcgcctacct

SEQ ID NO: 26384 - DNA, 15 bp, Homo sapiens
gatgtgtcgcctacc

SEQ ID NO: 26385 - DNA, 15 bp, Homo sapiens
ggatgtgtcgcctac

SEQ ID NO: 26386 - DNA, 15 bp, Homo sapiens
gggatgtgtcgccta

SEQ ID NO: 26387 - DNA, 15 bp, Homo sapiens
agggatgtgtcgcct

SEQ ID NO: 26388 - DNA, 15 bp, Homo sapiens
cagggatgtgtcgcc

SEQ ID NO: 26389 - DNA, 15 bp, Homo sapiens
ccagggatgtgtcgc

SEQ ID NO: 26390 - DNA, 15 bp, Homo sapiens
tccagggatgtgtcg

SEQ ID NO: 26391 - DNA, 15 bp, Homo sapiens
gtccagggatgtgtc

SEQ ID NO: 26392 - DNA, 15 bp, Homo sapiens
ggtccagggatgtgt

SEQ ID NO: 26393 - DNA, 15 bp, Homo sapiens
gggtccagggatgtg

SEQ ID NO: 26394 - DNA, 15 bp, Homo sapiens
agggtccagggatgt

SEQ ID NO: 26395 - DNA, 15 bp, Homo sapiens
tagggtccagggatg

SEQ ID NO: 26396 - DNA, 15 bp, Homo sapiens
ttagggtccagggat

SEQ ID NO: 26397 - DNA, 15 bp, Homo sapiens
attagggtccaggga

SEQ ID NO: 26398 - DNA, 15 bp, Homo sapiens
cattagggtccaggg

SEQ ID NO: 26399 - DNA, 15 bp, Homo sapiens
tcattagggtccagg

SEQ ID NO: 26400 - DNA, 15 bp, Homo sapiens
atcattagggtccag

SEQ ID NO: 26401 - DNA, 15 bp, Homo sapiens
aatcattagggtcca

SEQ ID NO: 26402 - DNA, 15 bp, Homo sapiens
aaatcattagggtcc

SEQ ID NO: 26403 - DNA, 15 bp, Homo sapiens
aaaatcattagggtc

SEQ ID NO: 26404 - DNA, 15 bp, Homo sapiens
caaaatcattagggt

SEQ ID NO: 26405 - DNA, 15 bp, Homo sapiens
tcaaaatcattaggg

SEQ ID NO: 26406 - DNA, 15 bp, Homo sapiens
gtcaaaatcattagg

SEQ ID NO: 26407 - DNA, 15 bp, Homo sapiens
agtcaaaatcattag

SEQ ID NO: 26408 - DNA, 15 bp, Homo sapiens
aagtcaaaatcatta

SEQ ID NO: 26409 - DNA, 15 bp, Homo sapiens
gaagtcaaaatcatt

SEQ ID NO: 26410 - DNA, 15 bp, Homo sapiens
tgaagtcaaaatcat

SEQ ID NO: 26411 - DNA, 15 bp, Homo sapiens
gtgaagtcaaaatca

SEQ ID NO: 26412 - DNA, 15 bp, Homo sapiens
cgtgaagtcaaaatc

SEQ ID NO: 26413 - DNA, 15 bp, Homo sapiens
ccgtgaagtcaaaat

SEQ ID NO: 26414 - DNA, 15 bp, Homo sapiens
accgtgaagtcaaaa

SEQ ID NO: 26415 - DNA, 15 bp, Homo sapiens
taccgtgaagtcaaa

SEQ ID NO: 26416 - DNA, 15 bp, Homo sapiens
ttaccgtgaagtcaa

SEQ ID NO: 26417 - DNA, 15 bp, Homo sapiens
gttaccgtgaagtca

SEQ ID NO: 26418 - DNA, 15 bp, Homo sapiens
agttaccgtgaagtc

SEQ ID NO: 26419 - DNA, 15 bp, Homo sapiens
cagttaccgtgaagt

SEQ ID NO: 26420 - DNA, 15 bp, Homo sapiens
ccagttaccgtgaag

SEQ ID NO: 26421 - DNA, 15 bp, Homo sapiens
cccagttaccgtgaa

SEQ ID NO: 26422 - DNA, 15 bp, Homo sapiens
tcccagttaccgtga

SEQ ID NO: 26423 - DNA, 15 bp, Homo sapiens
ctcccagttaccgtg

SEQ ID NO: 26424 - DNA, 15 bp, Homo sapiens
tctcccagttaccgt

SEQ ID NO: 26425 - DNA, 15 bp, Homo sapiens
ctctcccagttaccg

SEQ ID NO: 26426 - DNA, 15 bp, Homo sapiens
cctctcccagttacc

SEQ ID NO: 26427 - DNA, 15 bp, Homo sapiens
ccctctcccagttac

SEQ ID NO: 26428 - DNA, 15 bp, Homo sapiens
tccctctcccagtta

SEQ ID NO: 26429 - DNA, 15 bp, Homo sapiens
ctccctctcccagtt

SEQ ID NO: 26430 - DNA, 15 bp, Homo sapiens
gctccctctcccagt

SEQ ID NO: 26431 - DNA, 15 bp, Homo sapiens
ggctccctctcccag

SEQ ID NO: 26432 - DNA, 15 bp, Homo sapiens
gggctccctctccca

SEQ ID NO: 26433 - DNA, 15 bp, Homo sapiens
ggggctccctctccc

SEQ ID NO: 26434 - DNA, 15 bp, Homo sapiens
aggggctccctctcc

SEQ ID NO: 26435 - DNA, 15 bp, Homo sapiens
gaggggctccctctc

SEQ ID NO: 26436 - DNA, 15 bp, Homo sapiens
ggaggggctccctct

SEQ ID NO: 26437 - DNA, 15 bp, Homo sapiens
gggaggggctccctc

SEQ ID NO: 26438 - DNA, 15 bp, Homo sapiens
cgggaggggctccct

SEQ ID NO: 26439 - DNA, 15 bp, Homo sapiens
ccgggaggggctccc

SEQ ID NO: 26440 - DNA, 15 bp, Homo sapiens
gccgggaggggctcc

SEQ ID NO: 26441 - DNA, 15 bp, Homo sapiens
cgccgggaggggctc

SEQ ID NO: 26442 - DNA, 15 bp, Homo sapiens
tcgccgggaggggct

SEQ ID NO: 26443 - DNA, 15 bp, Homo sapiens
ctcgccgggaggggc

SEQ ID NO: 26444 - DNA, 15 bp, Homo sapiens
tctcgccgggagggg

SEQ ID NO: 26445 - DNA, 15 bp, Homo sapiens
ctctcgccgggaggg

SEQ ID NO: 26446 - DNA, 15 bp, Homo sapiens
gctctcgccgggagg

SEQ ID NO: 26447 - DNA, 15 bp, Homo sapiens
tgctctcgccgggag

SEQ ID NO: 26448 - DNA, 15 bp, Homo sapiens
ctgctctcgccggga

SEQ ID NO: 26449 - DNA, 15 bp, Homo sapiens
tctgctctcgccggg

SEQ ID NO: 26450 - DNA, 15 bp, Homo sapiens
ttctgctctcgccgg

SEQ ID NO: 26451 - DNA, 15 bp, Homo sapiens
tttctgctctcgccg

SEQ ID NO: 26452 - DNA, 15 bp, Homo sapiens
gtttctgctctcgcc

SEQ ID NO: 26453 - DNA, 15 bp, Homo sapiens
ggtttctgctctcgc

SEQ ID NO: 26454 - DNA, 15 bp, Homo sapiens
tggtttctgctctcg

SEQ ID NO: 26455 - DNA, 15 bp, Homo sapiens
gtggtttctgctctc

SEQ ID NO: 26456 - DNA, 15 bp, Homo sapiens
ggtggtttctgctct

SEQ ID NO: 26457 - DNA, 15 bp, Homo sapiens
aggtggtttctgctc

SEQ ID NO: 26458 - DNA, 15 bp, Homo sapiens
taggtggtttctgct

SEQ ID NO: 26459 - DNA, 15 bp, Homo sapiens
ttaggtggtttctgc

SEQ ID NO: 26460 - DNA, 15 bp, Homo sapiens
cttaggtggtttctg

SEQ ID NO: 26461 - DNA, 15 bp, Homo sapiens
tcttaggtggtttct

SEQ ID NO: 26462 - DNA, 15 bp, Homo sapiens
ttcttaggtggtttc

SEQ ID NO: 26463 - DNA, 15 bp, Homo sapiens
cttcttaggtggttt

SEQ ID NO: 26464 - DNA, 15 bp, Homo sapiens
gcttcttaggtggtt

SEQ ID NO: 26465 - DNA, 15 bp, Homo sapiens
ggcttcttaggtggt

SEQ ID NO: 26466 - DNA, 15 bp, Homo sapiens
gggcttcttaggtgg

SEQ ID NO: 26467 - DNA, 15 bp, Homo sapiens
tgggcttcttaggtg

SEQ ID NO: 26468 - DNA, 15 bp, Homo sapiens
ttgggcttcttaggt

SEQ ID NO: 26469 - DNA, 15 bp, Homo sapiens
tttgggcttcttagg

SEQ ID NO: 26470 - DNA, 15 bp, Homo sapiens
atttgggcttcttag

SEQ ID NO: 26471 - DNA, 15 bp, Homo sapiens
gatttgggcttctta

SEQ ID NO: 26472 - DNA, 15 bp, Homo sapiens
agatttgggcttctt

SEQ ID NO: 26473 - DNA, 15 bp, Homo sapiens
gagatttgggcttct

SEQ ID NO: 26474 - DNA, 15 bp, Homo sapiens
ggagatttgggcttc

SEQ ID NO: 26475 - DNA, 15 bp, Homo sapiens
gggagatttgggctt

SEQ ID NO: 26476 - DNA, 15 bp, Homo sapiens
tgggagatttgggct

SEQ ID NO: 26477 - DNA, 15 bp, Homo sapiens
ttgggagatttgggc

SEQ ID NO: 26478 - DNA, 15 bp, Homo sapiens
tttgggagatttggg

SEQ ID NO: 26479 - DNA, 15 bp, Homo sapiens
ctttgggagatttgg

SEQ ID NO: 26480 - DNA, 15 bp, Homo sapiens
gctttgggagatttg

SEQ ID NO: 26481 - DNA, 15 bp, Homo sapiens
agctttgggagattt

SEQ ID NO: 26482 - DNA, 15 bp, Homo sapiens
gagctttgggagatt

SEQ ID NO: 26483 - DNA, 15 bp, Homo sapiens
ggagctttgggagat

SEQ ID NO: 26484 - DNA, 15 bp, Homo sapiens
tggagctttgggaga

SEQ ID NO: 26485 - DNA, 15 bp, Homo sapiens
ctggagctttgggag

SEQ ID NO: 26486 - DNA, 15 bp, Homo sapiens
cctggagctttggga

SEQ ID NO: 26487 - DNA, 15 bp, Homo sapiens
tcctggagctttggg

SEQ ID NO: 26488 - DNA, 15 bp, Homo sapiens
ttcctggagctttgg

SEQ ID NO: 26489 - DNA, 15 bp, Homo sapiens
gttcctggagctttg

SEQ ID NO: 26490 - DNA, 15 bp, Homo sapiens
agttcctggagcttt

SEQ ID NO: 26491 - DNA, 15 bp, Homo sapiens
cagttcctggagctt

SEQ ID NO: 26492 - DNA, 15 bp, Homo sapiens
ccagttcctggagct

SEQ ID NO: 26493 - DNA, 15 bp, Homo sapiens
gccagttcctggagc

SEQ ID NO: 26494 - DNA, 15 bp, Homo sapiens
tgccagttcctggag

SEQ ID NO: 26495 - DNA, 15 bp, Homo sapiens
ctgccagttcctgga

SEQ ID NO: 26496 - DNA, 15 bp, Homo sapiens
tctgccagttcctgg

SEQ ID NO: 26497 - DNA, 15 bp, Homo sapiens
ctctgccagttcctg

SEQ ID NO: 26498 - DNA, 15 bp, Homo sapiens
cctctgccagttcct

SEQ ID NO: 26499 - DNA, 15 bp, Homo sapiens
gcctctgccagttcc

SEQ ID NO: 26500 - DNA, 15 bp, Homo sapiens
ggcctctgccagttc

SEQ ID NO: 26501 - DNA, 15 bp, Homo sapiens
cggcctctgccagtt

SEQ ID NO: 26502 - DNA, 15 bp, Homo sapiens
ccggcctctgccagt

SEQ ID NO: 26503 - DNA, 15 bp, Homo sapiens
cccggcctctgccag

SEQ ID NO: 26504 - DNA, 15 bp, Homo sapiens
ccccggcctctgcca

SEQ ID NO: 26505 - DNA, 15 bp, Homo sapiens
tccccggcctctgcc

SEQ ID NO: 26506 - DNA, 15 bp, Homo sapiens
gtccccggcctctgc

SEQ ID NO: 26507 - DNA, 15 bp, Homo sapiens
cgtccccggcctctg

SEQ ID NO: 26508 - DNA, 15 bp, Homo sapiens
gcgtccccggcctct

SEQ ID NO: 26509 - DNA, 15 bp, Homo sapiens
ggcgtccccggcctc

SEQ ID NO: 26510 - DNA, 15 bp, Homo sapiens
gggcgtccccggcct

SEQ ID NO: 26511 - DNA, 15 bp, Homo sapiens
ggggcgtccccggcc

SEQ ID NO: 26512 - DNA, 15 bp, Homo sapiens
tggggcgtccccggc

SEQ ID NO: 26513 - DNA, 15 bp, Homo sapiens
ttggggcgtccccgg

SEQ ID NO: 26514 - DNA, 15 bp, Homo sapiens
tttggggcgtccccg

SEQ ID NO: 26515 - DNA, 15 bp, Homo sapiens
ctttggggcgtcccc

SEQ ID NO: 26516 - DNA, 15 bp, Homo sapiens
cctttggggcgtccc

SEQ ID NO: 26517 - DNA, 15 bp, Homo sapiens
ccctttggggcgtcc

SEQ ID NO: 26518 - DNA, 15 bp, Homo sapiens
tccctttggggcgtc

SEQ ID NO: 26519 - DNA, 15 bp, Homo sapiens
ctccctttggggcgt

SEQ ID NO: 26520 - DNA, 15 bp, Homo sapiens
gctccctttggggcg

SEQ ID NO: 26521 - DNA, 15 bp, Homo sapiens
cgctccctttggggc

SEQ ID NO: 26522 - DNA, 15 bp, Homo sapiens
ccgctccctttgggg

SEQ ID NO: 26523 - DNA, 15 bp, Homo sapiens
gccgctccctttggg

SEQ ID NO: 26524 - DNA, 15 bp, Homo sapiens
tgccgctccctttgg

SEQ ID NO: 26525 - DNA, 15 bp, Homo sapiens
gtgccgctccctttg

SEQ ID NO: 26526 - DNA, 15 bp, Homo sapiens
ggtgccgctcccttt

SEQ ID NO: 26527 - DNA, 15 bp, Homo sapiens
tggtgccgctccctt

SEQ ID NO: 26528 - DNA, 15 bp, Homo sapiens
gtggtgccgctccct

SEQ ID NO: 26529 - DNA, 15 bp, Homo sapiens
cgtggtgccgctccc

SEQ ID NO: 26530 - DNA, 15 bp, Homo sapiens
tcgtggtgccgctcc

SEQ ID NO: 26531 - DNA, 15 bp, Homo sapiens
ctcgtggtgccgctc

SEQ ID NO: 26532 - DNA, 15 bp, Homo sapiens
tctcgtggtgccgct

SEQ ID NO: 26533 - DNA, 15 bp, Homo sapiens
gtctcgtggtgccgc

SEQ ID NO: 26534 - DNA, 15 bp, Homo sapiens
ggtctcgtggtgccg

SEQ ID NO: 26535 - DNA, 15 bp, Homo sapiens
gggtctcgtggtgcc

SEQ ID NO: 26536 - DNA, 15 bp, Homo sapiens
tgggtctcgtggtgc

SEQ ID NO: 26537 - DNA, 15 bp, Homo sapiens
ttgggtctcgtggtg

SEQ ID NO: 26538 - DNA, 15 bp, Homo sapiens
cttgggtctcgtggt

SEQ ID NO: 26539 - DNA, 15 bp, Homo sapiens
ccttgggtctcgtgg

SEQ ID NO: 26540 - DNA, 15 bp, Homo sapiens
gccttgggtctcgtg

SEQ ID NO: 26541 - DNA, 15 bp, Homo sapiens
cgccttgggtctcgt

SEQ ID NO: 26542 - DNA, 15 bp, Homo sapiens
ccgccttgggtctcg

SEQ ID NO: 26543 - DNA, 15 bp, Homo sapiens
gccgccttgggtctc

SEQ ID NO: 26544 - DNA, 15 bp, Homo sapiens
ggccgccttgggtct

SEQ ID NO: 26545 - DNA, 15 bp, Homo sapiens
tggccgccttgggtc

SEQ ID NO: 26546 - DNA, 15 bp, Homo sapiens
gtggccgccttgggt

SEQ ID NO: 26547 - DNA, 15 bp, Homo sapiens
cgtggccgccttggg

SEQ ID NO: 26548 - DNA, 15 bp, Homo sapiens
acgtggccgccttgg

SEQ ID NO: 26549 - DNA, 15 bp, Homo sapiens
gacgtggccgccttg

SEQ ID NO: 26550 - DNA, 15 bp, Homo sapiens
tgacgtggccgcctt

SEQ ID NO: 26551 - DNA, 15 bp, Homo sapiens
ctgacgtggccgcct

SEQ ID NO: 26552 - DNA, 15 bp, Homo sapiens
tctgacgtggccgcc

SEQ ID NO: 26553 - DNA, 15 bp, Homo sapiens
ctctgacgtggccgc

SEQ ID NO: 26554 - DNA, 15 bp, Homo sapiens
cctctgacgtggccg

SEQ ID NO: 26555 - DNA, 15 bp, Homo sapiens
ccctctgacgtggcc

SEQ ID NO: 26556 - DNA, 15 bp, Homo sapiens
accctctgacgtggc

SEQ ID NO: 26557 - DNA, 15 bp, Homo sapiens
caccctctgacgtgg

SEQ ID NO: 26558 - DNA, 15 bp, Homo sapiens
acaccctctgacgtg

SEQ ID NO: 26559 - DNA, 15 bp, Homo sapiens
cacaccctctgacgt

SEQ ID NO: 26560 - DNA, 15 bp, Homo sapiens
gcacaccctctgacg

SEQ ID NO: 26561 - DNA, 15 bp, Homo sapiens
tgcacaccctctgac

SEQ ID NO: 26562 - DNA, 15 bp, Homo sapiens
ctgcacaccctctga

SEQ ID NO: 26563 - DNA, 15 bp, Homo sapiens
cctgcacaccctctg

SEQ ID NO: 26564 - DNA, 15 bp, Homo sapiens
acctgcacaccctct

SEQ ID NO: 26565 - DNA, 15 bp, Homo sapiens
cacctgcacaccctc

SEQ ID NO: 26566 - DNA, 15 bp, Homo sapiens
tcacctgcacaccct

SEQ ID NO: 26567 - DNA, 15 bp, Homo sapiens
ttcacctgcacaccc

SEQ ID NO: 26568 - DNA, 15 bp, Homo sapiens
tttcacctgcacacc

SEQ ID NO: 26569 - DNA, 15 bp, Homo sapiens
ttttcacctgcacac

SEQ ID NO: 26570 - DNA, 15 bp, Homo sapiens
cttttcacctgcaca

SEQ ID NO: 26571 - DNA, 15 bp, Homo sapiens
ccttttcacctgcac

SEQ ID NO: 26572 - DNA, 15 bp, Homo sapiens
cccttttcacctgca

SEQ ID NO: 26573 - DNA, 15 bp, Homo sapiens
acccttttcacctgc

SEQ ID NO: 26574 - DNA, 15 bp, Homo sapiens
gacccttttcacctg

SEQ ID NO: 26575 - DNA, 15 bp, Homo sapiens
ggacccttttcacct

SEQ ID NO: 26576 - DNA, 15 bp, Homo sapiens
aggacccttttcacc

SEQ ID NO: 26577 - DNA, 15 bp, Homo sapiens
caggacccttttcac

SEQ ID NO: 26578 - DNA, 15 bp, Homo sapiens
ccaggacccttttca

SEQ ID NO: 26579 - DNA, 15 bp, Homo sapiens
tccaggacccttttc

SEQ ID NO: 26580 - DNA, 15 bp, Homo sapiens
ctccaggaccctttt

SEQ ID NO: 26581 - DNA, 15 bp, Homo sapiens
tctccaggacccttt

SEQ ID NO: 26582 - DNA, 15 bp, Homo sapiens
ttctccaggaccctt

SEQ ID NO: 26583 - DNA, 15 bp, Homo sapiens
tttctccaggaccct

SEQ ID NO: 26584 - DNA, 15 bp, Homo sapiens
ttttctccaggaccc

SEQ ID NO: 26585 - DNA, 15 bp, Homo sapiens
cttttctccaggacc

SEQ ID NO: 26586 - DNA, 15 bp, Homo sapiens
acttttctccaggac

SEQ ID NO: 26587 - DNA, 15 bp, Homo sapiens
gacttttctccagga

SEQ ID NO: 26588 - DNA, 15 bp, Homo sapiens
ggacttttctccagg

SEQ ID NO: 26589 - DNA, 15 bp, Homo sapiens
aggacttttctccag

SEQ ID NO: 26590 - DNA, 15 bp, Homo sapiens
caggacttttctcca

SEQ ID NO: 26591 - DNA, 15 bp, Homo sapiens
ccaggacttttctcc

SEQ ID NO: 26592 - DNA, 15 bp, Homo sapiens
cccaggacttttctc

SEQ ID NO: 26593 - DNA, 15 bp, Homo sapiens
tcccaggacttttct

SEQ ID NO: 26594 - DNA, 15 bp, Homo sapiens
ttcccaggacttttc

SEQ ID NO: 26595 - DNA, 15 bp, Homo sapiens
cttcccaggactttt

SEQ ID NO: 26596 - DNA, 15 bp, Homo sapiens
gcttcccaggacttt

SEQ ID NO: 26597 - DNA, 15 bp, Homo sapiens
agcttcccaggactt

SEQ ID NO: 26598 - DNA, 15 bp, Homo sapiens
gagcttcccaggact

SEQ ID NO: 26599 - DNA, 15 bp, Homo sapiens
ggagcttcccaggac

SEQ ID NO: 26600 - DNA, 15 bp, Homo sapiens
aggagcttcccagga

SEQ ID NO: 26601 - DNA, 15 bp, Homo sapiens
aaggagcttcccagg

SEQ ID NO: 26602 - DNA, 15 bp, Homo sapiens
caaggagcttcccag

SEQ ID NO: 26603 - DNA, 15 bp, Homo sapiens
acaaggagcttccca

SEQ ID NO: 26604 - DNA, 15 bp, Homo sapiens
gacaaggagcttccc

SEQ ID NO: 26605 - DNA, 15 bp, Homo sapiens
tgacaaggagcttcc

SEQ ID NO: 26606 - DNA, 15 bp, Homo sapiens
ttgacaaggagcttc

SEQ ID NO: 26607 - DNA, 15 bp, Homo sapiens
cttgacaaggagctt

SEQ ID NO: 26608 - DNA, 15 bp, Homo sapiens
tcttgacaaggagct

SEQ ID NO: 26609 - DNA, 15 bp, Homo sapiens
atcttgacaaggagc

SEQ ID NO: 26610 - DNA, 15 bp, Homo sapiens
catcttgacaaggag

SEQ ID NO: 26611 - DNA, 15 bp, Homo sapiens
gcatcttgacaagga

SEQ ID NO: 26612 - DNA, 15 bp, Homo sapiens
ggcatcttgacaagg

SEQ ID NO: 26613 - DNA, 15 bp, Homo sapiens
aggcatcttgacaag

SEQ ID NO: 26614 - DNA, 15 bp, Homo sapiens
aaggcatcttgacaa

SEQ ID NO: 26615 - DNA, 15 bp, Homo sapiens
aaaggcatcttgaca

SEQ ID NO: 26616 - DNA, 15 bp, Homo sapiens
aaaaggcatcttgac

SEQ ID NO: 26617 - DNA, 15 bp, Homo sapiens
gaaaaggcatcttga

SEQ ID NO: 26618 - DNA, 15 bp, Homo sapiens
tgaaaaggcatcttg

SEQ ID NO: 26619 - DNA, 15 bp, Homo sapiens
ttgaaaaggcatctt

SEQ ID NO: 26620 - DNA, 15 bp, Homo sapiens
tttgaaaaggcatct

SEQ ID NO: 26621 - DNA, 15 bp, Homo sapiens
gtttgaaaaggcatc

SEQ ID NO: 26622 - DNA, 15 bp, Homo sapiens
agtttgaaaaggcat

SEQ ID NO: 26623 - DNA, 15 bp, Homo sapiens
aagtttgaaaaggca

SEQ ID NO: 26624 - DNA, 15 bp, Homo sapiens
gaagtttgaaaaggc

SEQ ID NO: 26625 - DNA, 15 bp, Homo sapiens
cgaagtttgaaaagg

SEQ ID NO: 26626 - DNA, 15 bp, Homo sapiens
gcgaagtttgaaaag

SEQ ID NO: 26627 - DNA, 15 bp, Homo sapiens
ggcgaagtttgaaaa

SEQ ID NO: 26628 - DNA, 15 bp, Homo sapiens
tggcgaagtttgaaa

SEQ ID NO: 26629 - DNA, 15 bp, Homo sapiens
ctggcgaagtttgaa

SEQ ID NO: 26630 - DNA, 15 bp, Homo sapiens
cctggcgaagtttga

SEQ ID NO: 26631 - DNA, 15 bp, Homo sapiens
ccctggcgaagtttg

SEQ ID NO: 26632 - DNA, 15 bp, Homo sapiens
cccctggcgaagttt

SEQ ID NO: 26633 - DNA, 15 bp, Homo sapiens
ccccctggcgaagtt

SEQ ID NO: 26634 - DNA, 15 bp, Homo sapiens
gccccctggcgaagt

SEQ ID NO: 26635 - DNA, 15 bp, Homo sapiens
tgccccctggcgaag

SEQ ID NO: 26636 - DNA, 15 bp, Homo sapiens
ttgccccctggcgaa

SEQ ID NO: 26637 - DNA, 15 bp, Homo sapiens
cttgccccctggcga

SEQ ID NO: 26638 - DNA, 15 bp, Homo sapiens
ccttgccccctggcg

SEQ ID NO: 26639 - DNA, 15 bp, Homo sapiens
gccttgccccctggc

SEQ ID NO: 26640 - DNA, 15 bp, Homo sapiens
agccttgccccctgg

SEQ ID NO: 26641 - DNA, 15 bp, Homo sapiens
cagccttgccccctg

SEQ ID NO: 26642 - DNA, 15 bp, Homo sapiens
tcagccttgccccct

SEQ ID NO: 26643 - DNA, 15 bp, Homo sapiens
ctcagccttgccccc

SEQ ID NO: 26644 - DNA, 15 bp, Homo sapiens
cctcagccttgcccc

SEQ ID NO: 26645 - DNA, 15 bp, Homo sapiens
ccctcagccttgccc

SEQ ID NO: 26646 - DNA, 15 bp, Homo sapiens
cccctcagccttgcc

SEQ ID NO: 26647 - DNA, 15 bp, Homo sapiens
ccccctcagccttgc

SEQ ID NO: 26648 - DNA, 15 bp, Homo sapiens
cccccctcagccttg

SEQ ID NO: 26649 - DNA, 15 bp, Homo sapiens
acccccctcagcctt

SEQ ID NO: 26650 - DNA, 15 bp, Homo sapiens
cacccccctcagcct

SEQ ID NO: 26651 - DNA, 15 bp, Homo sapiens
ccacccccctcagcc

SEQ ID NO: 26652 - DNA, 15 bp, Homo sapiens
cccacccccctcagc

SEQ ID NO: 26653 - DNA, 15 bp, Homo sapiens
ccccacccccctcag

SEQ ID NO: 26654 - DNA, 15 bp, Homo sapiens
gccccacccccctca

SEQ ID NO: 26655 - DNA, 15 bp, Homo sapiens
ggccccacccccctc

SEQ ID NO: 26656 - DNA, 15 bp, Homo sapiens
tggccccacccccct

SEQ ID NO: 26657 - DNA, 15 bp, Homo sapiens
gtggccccacccccc

SEQ ID NO: 26658 - DNA, 15 bp, Homo sapiens
ggtggccccaccccc

SEQ ID NO: 26659 - DNA, 15 bp, Homo sapiens
tggtggccccacccc

SEQ ID NO: 26660 - DNA, 15 bp, Homo sapiens
gtggtggccccaccc

SEQ ID NO: 26661 - DNA, 15 bp, Homo sapiens
tgtggtggccccacc

SEQ ID NO: 26662 - DNA, 15 bp, Homo sapiens
atgtggtggccccac

SEQ ID NO: 26663 - DNA, 15 bp, Homo sapiens
gatgtggtggcccca

SEQ ID NO: 26664 - DNA, 15 bp, Homo sapiens
ggatgtggtggcccc

SEQ ID NO: 26665 - DNA, 15 bp, Homo sapiens
tggatgtggtggccc

SEQ ID NO: 26666 - DNA, 15 bp, Homo sapiens
gtggatgtggtggcc

SEQ ID NO: 26667 - DNA, 15 bp, Homo sapiens
ggtggatgtggtggc

SEQ ID NO: 26668 - DNA, 15 bp, Homo sapiens
gggtggatgtggtgg

SEQ ID NO: 26669 - DNA, 15 bp, Homo sapiens
tgggtggatgtggtg

SEQ ID NO: 26670 - DNA, 15 bp, Homo sapiens
ctgggtggatgtggt

SEQ ID NO: 26671 - DNA, 15 bp, Homo sapiens
cctgggtggatgtgg

SEQ ID NO: 26672 - DNA, 15 bp, Homo sapiens
acctgggtggatgtg

SEQ ID NO: 26673 - DNA, 15 bp, Homo sapiens
gacctgggtggatgt

SEQ ID NO: 26674 - DNA, 15 bp, Homo sapiens
tgacctgggtggatg

SEQ ID NO: 26675 - DNA, 15 bp, Homo sapiens
atgacctgggtggat

SEQ ID NO: 26676 - DNA, 15 bp, Homo sapiens
catgacctgggtgga

SEQ ID NO: 26677 - DNA, 15 bp, Homo sapiens
ccatgacctgggtgg

SEQ ID NO: 26678 - DNA, 15 bp, Homo sapiens
accatgacctgggtg

SEQ ID NO: 26679 - DNA, 15 bp, Homo sapiens
caccatgacctgggt

SEQ ID NO: 26680 - DNA, 15 bp, Homo sapiens
tcaccatgacctggg

SEQ ID NO: 26681 - DNA, 15 bp, Homo sapiens
atcaccatgacctgg

SEQ ID NO: 26682 - DNA, 15 bp, Homo sapiens
gatcaccatgacctg

SEQ ID NO: 26683 - DNA, 15 bp, Homo sapiens
tgatcaccatgacct

SEQ ID NO: 26684 - DNA, 15 bp, Homo sapiens
ttgatcaccatgacc

SEQ ID NO: 26685 - DNA, 15 bp, Homo sapiens
tttgatcaccatgac

SEQ ID NO: 26686 - DNA, 15 bp, Homo sapiens
gtttgatcaccatga

SEQ ID NO: 26687 - DNA, 15 bp, Homo sapiens
cgtttgatcaccatg

SEQ ID NO: 26688 - DNA, 15 bp, Homo sapiens
gcgtttgatcaccat

SEQ ID NO: 26689 - DNA, 15 bp, Homo sapiens
ggcgtttgatcacca

SEQ ID NO: 26690 - DNA, 15 bp, Homo sapiens
gggcgtttgatcacc

SEQ ID NO: 26691 - DNA, 15 bp, Homo sapiens
ggggcgtttgatcac

SEQ ID NO: 26692 - DNA, 15 bp, Homo sapiens
cggggcgtttgatca

SEQ ID NO: 26693 - DNA, 15 bp, Homo sapiens
ccggggcgtttgatc

SEQ ID NO: 26694 - DNA, 15 bp, Homo sapiens
gccggggcgtttgat

SEQ ID NO: 26695 - DNA, 15 bp, Homo sapiens
tgccggggcgtttga

SEQ ID NO: 26696 - DNA, 15 bp, Homo sapiens
ctgccggggcgtttg

SEQ ID NO: 26697 - DNA, 15 bp, Homo sapiens
cctgccggggcgttt

SEQ ID NO: 26698 - DNA, 15 bp, Homo sapiens
tcctgccggggcgtt

SEQ ID NO: 26699 - DNA, 15 bp, Homo sapiens
ttcctgccggggcgt

SEQ ID NO: 26700 - DNA, 15 bp, Homo sapiens
cttcctgccggggcg

SEQ ID NO: 26701 - DNA, 15 bp, Homo sapiens
gcttcctgccggggc

SEQ ID NO: 26702 - DNA, 15 bp, Homo sapiens
cgcttcctgccgggg

SEQ ID NO: 26703 - DNA, 15 bp, Homo sapiens
tcgcttcctgccggg

SEQ ID NO: 26704 - DNA, 15 bp, Homo sapiens
ttcgcttcctgccgg

SEQ ID NO: 26705 - DNA, 15 bp, Homo sapiens
tttcgcttcctgccg

SEQ ID NO: 26706 - DNA, 15 bp, Homo sapiens
ttttcgcttcctgcc

SEQ ID NO: 26707 - DNA, 15 bp, Homo sapiens
cttttcgcttcctgc

SEQ ID NO: 26708 - DNA, 15 bp, Homo sapiens
gcttttcgcttcctg

SEQ ID NO: 26709 - DNA, 15 bp, Homo sapiens
agcttttcgcttcct

SEQ ID NO: 26710 - DNA, 15 bp, Homo sapiens
cagcttttcgcttcc

SEQ ID NO: 26711 - DNA, 15 bp, Homo sapiens
tcagcttttcgcttc

SEQ ID NO: 26712 - DNA, 15 bp, Homo sapiens
ctcagcttttcgctt

SEQ ID NO: 26713 - DNA, 15 bp, Homo sapiens
cctcagcttttcgct

SEQ ID NO: 26714 - DNA, 15 bp, Homo sapiens
gcctcagcttttcgc

SEQ ID NO: 26715 - DNA, 15 bp, Homo sapiens
ggcctcagcttttcg

SEQ ID NO: 26716 - DNA, 15 bp, Homo sapiens
cggcctcagcttttc

SEQ ID NO: 26717 - DNA, 15 bp, Homo sapiens
tcggcctcagctttt

SEQ ID NO: 26718 - DNA, 15 bp, Homo sapiens
gtcggcctcagcttt

SEQ ID NO: 26719 - DNA, 15 bp, Homo sapiens
ggtcggcctcagctt

SEQ ID NO: 26720 - DNA, 15 bp, Homo sapiens
gggtcggcctcagct

SEQ ID NO: 26721 - DNA, 15 bp, Homo sapiens
agggtcggcctcagc

SEQ ID NO: 26722 - DNA, 15 bp, Homo sapiens
gagggtcggcctcag

SEQ ID NO: 26723 - DNA, 15 bp, Homo sapiens
tgagggtcggcctca

SEQ ID NO: 26724 - DNA, 15 bp, Homo sapiens
ctgagggtcggcctc

SEQ ID NO: 26725 - DNA, 15 bp, Homo sapiens
cctgagggtcggcct

SEQ ID NO: 26726 - DNA, 15 bp, Homo sapiens
gcctgagggtcggcc

SEQ ID NO: 26727 - DNA, 15 bp, Homo sapiens
ggcctgagggtcggc

SEQ ID NO: 26728 - DNA, 15 bp, Homo sapiens
tggcctgagggtcgg

SEQ ID NO: 26729 - DNA, 15 bp, Homo sapiens
atggcctgagggtcg

SEQ ID NO: 26730 - DNA, 15 bp, Homo sapiens
aatggcctgagggtc

SEQ ID NO: 26731 - DNA, 15 bp, Homo sapiens
gaatggcctgagggt

SEQ ID NO: 26732 - DNA, 15 bp, Homo sapiens
ggaatggcctgaggg

SEQ ID NO: 26733 - DNA, 15 bp, Homo sapiens
gggaatggcctgagg

SEQ ID NO: 26734 - DNA, 15 bp, Homo sapiens
tgggaatggcctgag

SEQ ID NO: 26735 - DNA, 15 bp, Homo sapiens
ttgggaatggcctga

SEQ ID NO: 26736 - DNA, 15 bp, Homo sapiens
cttgggaatggcctg

SEQ ID NO: 26737 - DNA, 15 bp, Homo sapiens
tcttgggaatggcct

SEQ ID NO: 26738 - DNA, 15 bp, Homo sapiens
ttcttgggaatggcc

SEQ ID NO: 26739 - DNA, 15 bp, Homo sapiens
tttcttgggaatggc

SEQ ID NO: 26740 - DNA, 15 bp, Homo sapiens
gtttcttgggaatgg

SEQ ID NO: 26741 - DNA, 15 bp, Homo sapiens
cgtttcttgggaatg

SEQ ID NO: 26742 - DNA, 15 bp, Homo sapiens
ccgtttcttgggaat

SEQ ID NO: 26743 - DNA, 15 bp, Homo sapiens
cccgtttcttgggaa

SEQ ID NO: 26744 - DNA, 15 bp, Homo sapiens
ccccgtttcttggga

SEQ ID NO: 26745 - DNA, 15 bp, Homo sapiens
gccccgtttcttggg

SEQ ID NO: 26746 - DNA, 15 bp, Homo sapiens
ggccccgtttcttgg

SEQ ID NO: 26747 - DNA, 15 bp, Homo sapiens
cggccccgtttcttg

SEQ ID NO: 26748 - DNA, 15 bp, Homo sapiens
tcggccccgtttctt

SEQ ID NO: 26749 - DNA, 15 bp, Homo sapiens
ttcggccccgtttct

SEQ ID NO: 26750 - DNA, 15 bp, Homo sapiens
tttcggccccgtttc

SEQ ID NO: 26751 - DNA, 15 bp, Homo sapiens
ctttcggccccgttt

SEQ ID NO: 26752 - DNA, 15 bp, Homo sapiens
gctttcggccccgtt

SEQ ID NO: 26753 - DNA, 15 bp, Homo sapiens
ggctttcggccccgt

SEQ ID NO: 26754 - DNA, 15 bp, Homo sapiens
cggctttcggccccg

SEQ ID NO: 26755 - DNA, 15 bp, Homo sapiens
ccggctttcggcccc

SEQ ID NO: 26756 - DNA, 15 bp, Homo sapiens
cccggctttcggccc

SEQ ID NO: 26757 - DNA, 15 bp, Homo sapiens
ccccggctttcggcc

SEQ ID NO: 26758 - DNA, 15 bp, Homo sapiens
tccccggctttcggc

SEQ ID NO: 26759 - DNA, 15 bp, Homo sapiens
ctccccggctttcgg

SEQ ID NO: 26760 - DNA, 15 bp, Homo sapiens
actccccggctttcg

SEQ ID NO: 26761 - DNA, 15 bp, Homo sapiens
cactccccggctttc

SEQ ID NO: 26762 - DNA, 15 bp, Homo sapiens
acactccccggcttt

SEQ ID NO: 26763 - DNA, 15 bp, Homo sapiens
cacactccccggctt

SEQ ID NO: 26764 - DNA, 15 bp, Homo sapiens
ccacactccccggct

SEQ ID NO: 26765 - DNA, 15 bp, Homo sapiens
accacactccccggc

SEQ ID NO: 26766 - DNA, 15 bp, Homo sapiens
caccacactccccgg

SEQ ID NO: 26767 - DNA, 15 bp, Homo sapiens
ccaccacactccccg

SEQ ID NO: 26768 - DNA, 15 bp, Homo sapiens
gccaccacactcccc

SEQ ID NO: 26769 - DNA, 15 bp, Homo sapiens
tgccaccacactccc

SEQ ID NO: 26770 - DNA, 15 bp, Homo sapiens
ctgccaccacactcc

SEQ ID NO: 26771 - DNA, 15 bp, Homo sapiens
gctgccaccacactc

SEQ ID NO: 26772 - DNA, 15 bp, Homo sapiens
ggctgccaccacact

SEQ ID NO: 26773 - DNA, 15 bp, Homo sapiens
cggctgccaccacac

SEQ ID NO: 26774 - DNA, 15 bp, Homo sapiens
gcggctgccaccaca

SEQ ID NO: 26775 - DNA, 15 bp, Homo sapiens
agcggctgccaccac

SEQ ID NO: 26776 - DNA, 15 bp, Homo sapiens
cagcggctgccacca

SEQ ID NO: 26777 - DNA, 15 bp, Homo sapiens
gcagcggctgccacc

SEQ ID NO: 26778 - DNA, 15 bp, Homo sapiens
ggcagcggctgccac

SEQ ID NO: 26779 - DNA, 15 bp, Homo sapiens
cggcagcggctgcca

SEQ ID NO: 26780 - DNA, 15 bp, Homo sapiens
gcggcagcggctgcc

SEQ ID NO: 26781 - DNA, 15 bp, Homo sapiens
ggcggcagcggctgc

SEQ ID NO: 26782 - DNA, 15 bp, Homo sapiens
cggcggcagcggctg

SEQ ID NO: 26783 - DNA, 15 bp, Homo sapiens
tcggcggcagcggct

SEQ ID NO: 26784 - DNA, 15 bp, Homo sapiens
ctcggcggcagcggc

SEQ ID NO: 26785 - DNA, 15 bp, Homo sapiens
cctcggcggcagcgg

SEQ ID NO: 26786 - DNA, 15 bp, Homo sapiens
gcctcggcggcagcg

SEQ ID NO: 26787 - DNA, 15 bp, Homo sapiens
ggcctcggcggcagc

SEQ ID NO: 26788 - DNA, 15 bp, Homo sapiens
tggcctcggcggcag

SEQ ID NO: 26789 - DNA, 15 bp, Homo sapiens
ttggcctcggcggca

SEQ ID NO: 26790 - DNA, 15 bp, Homo sapiens
tttggcctcggcggc

SEQ ID NO: 26791 - DNA, 15 bp, Homo sapiens
ttttggcctcggcgg

SEQ ID NO: 26792 - DNA, 15 bp, Homo sapiens
tttttggcctcggcg

SEQ ID NO: 26793 - DNA, 15 bp, Homo sapiens
ctttttggcctcggc

SEQ ID NO: 26794 - DNA, 15 bp, Homo sapiens
tctttttggcctcgg

SEQ ID NO: 26795 - DNA, 15 bp, Homo sapiens
ttctttttggcctcg

SEQ ID NO: 26796 - DNA, 15 bp, Homo sapiens
tttctttttggcctc

SEQ ID NO: 26797 - DNA, 15 bp, Homo sapiens
ctttctttttggcct

SEQ ID NO: 26798 - DNA, 15 bp, Homo sapiens
gctttctttttggcc

SEQ ID NO: 26799 - DNA, 15 bp, Homo sapiens
ggctttctttttggc

SEQ ID NO: 26800 - DNA, 15 bp, Homo sapiens
cggctttctttttgg

SEQ ID NO: 26801 - DNA, 15 bp, Homo sapiens
acggctttctttttg

SEQ ID NO: 26802 - DNA, 15 bp, Homo sapiens
cacggctttcttttt

SEQ ID NO: 26803 - DNA, 15 bp, Homo sapiens
tcacggctttctttt

SEQ ID NO: 26804 - DNA, 15 bp, Homo sapiens
ttcacggctttcttt

SEQ ID NO: 26805 - DNA, 15 bp, Homo sapiens
cttcacggctttctt

SEQ ID NO: 26806 - DNA, 15 bp, Homo sapiens
ccttcacggctttct

SEQ ID NO: 26807 - DNA, 15 bp, Homo sapiens
tccttcacggctttc

SEQ ID NO: 26808 - DNA, 15 bp, Homo sapiens
ctccttcacggcttt

SEQ ID NO: 26809 - DNA, 15 bp, Homo sapiens
actccttcacggctt

SEQ ID NO: 26810 - DNA, 15 bp, Homo sapiens
gactccttcacggct

SEQ ID NO: 26811 - DNA, 15 bp, Homo sapiens
agactccttcacggc

SEQ ID NO: 26812 - DNA, 15 bp, Homo sapiens
aagactccttcacgg

SEQ ID NO: 26813 - DNA, 15 bp, Homo sapiens
gaagactccttcacg

SEQ ID NO: 26814 - DNA, 15 bp, Homo sapiens
agaagactccttcac

SEQ ID NO: 26815 - DNA, 15 bp, Homo sapiens
tagaagactccttca

SEQ ID NO: 26816 - DNA, 15 bp, Homo sapiens
atagaagactccttc

SEQ ID NO: 26817 - DNA, 15 bp, Homo sapiens
gatagaagactcctt

SEQ ID NO: 26818 - DNA, 15 bp, Homo sapiens
ggatagaagactcct

SEQ ID NO: 26819 - DNA, 15 bp, Homo sapiens
cggatagaagactcc

SEQ ID NO: 26820 - DNA, 15 bp, Homo sapiens
tcggatagaagactc

SEQ ID NO: 26821 - DNA, 15 bp, Homo sapiens
atcggatagaagact

SEQ ID NO: 26822 - DNA, 15 bp, Homo sapiens
gatcggatagaagac

SEQ ID NO: 26823 - DNA, 15 bp, Homo sapiens
agatcggatagaaga

SEQ ID NO: 26824 - DNA, 15 bp, Homo sapiens
cagatcggatagaag

SEQ ID NO: 26825 - DNA, 15 bp, Homo sapiens
acagatcggatagaa

SEQ ID NO: 26826 - DNA, 15 bp, Homo sapiens
cacagatcggataga

SEQ ID NO: 26827 - DNA, 15 bp, Homo sapiens
gcacagatcggatag

SEQ ID NO: 26828 - DNA, 15 bp, Homo sapiens
tgcacagatcggata

SEQ ID NO: 26829 - DNA, 15 bp, Homo sapiens
ctgcacagatcggat

SEQ ID NO: 26830 - DNA, 15 bp, Homo sapiens
cctgcacagatcgga

SEQ ID NO: 26831 - DNA, 15 bp, Homo sapiens
tcctgcacagatcgg

SEQ ID NO: 26832 - DNA, 15 bp, Homo sapiens
ctcctgcacagatcg

SEQ ID NO: 26833 - DNA, 15 bp, Homo sapiens
tctcctgcacagatc

SEQ ID NO: 26834 - DNA, 15 bp, Homo sapiens
gtctcctgcacagat

SEQ ID NO: 26835 - DNA, 15 bp, Homo sapiens
ggtctcctgcacaga

SEQ ID NO: 26836 - DNA, 15 bp, Homo sapiens
cggtctcctgcacag

SEQ ID NO: 26837 - DNA, 15 bp, Homo sapiens
acggtctcctgcaca

SEQ ID NO: 26838 - DNA, 15 bp, Homo sapiens
tacggtctcctgcac

SEQ ID NO: 26839 - DNA, 15 bp, Homo sapiens
gtacggtctcctgca

SEQ ID NO: 26840 - DNA, 15 bp, Homo sapiens
agtacggtctcctgc

SEQ ID NO: 26841 - DNA, 15 bp, Homo sapiens
gagtacggtctcctg

SEQ ID NO: 26842 - DNA, 15 bp, Homo sapiens
ggagtacggtctcct

SEQ ID NO: 26843 - DNA, 15 bp, Homo sapiens
gggagtacggtctcc

SEQ ID NO: 26844 - DNA, 15 bp, Homo sapiens
ggggagtacggtctc

SEQ ID NO: 26845 - DNA, 15 bp, Homo sapiens
tggggagtacggtct

SEQ ID NO: 26846 - DNA, 15 bp, Homo sapiens
atggggagtacggtc

SEQ ID NO: 26847 - DNA, 15 bp, Homo sapiens
gatggggagtacggt

SEQ ID NO: 26848 - DNA, 15 bp, Homo sapiens
tgatggggagtacgg

SEQ ID NO: 26849 - DNA, 15 bp, Homo sapiens
ttgatggggagtacg

SEQ ID NO: 26850 - DNA, 15 bp, Homo sapiens
cttgatggggagtac

SEQ ID NO: 26851 - DNA, 15 bp, Homo sapiens
tcttgatggggagta

SEQ ID NO: 26852 - DNA, 15 bp, Homo sapiens
ttcttgatggggagt

SEQ ID NO: 26853 - DNA, 15 bp, Homo sapiens
cttcttgatggggag

SEQ ID NO: 26854 - DNA, 15 bp, Homo sapiens
gcttcttgatgggga

SEQ ID NO: 26855 - DNA, 15 bp, Homo sapiens
cgcttcttgatgggg

SEQ ID NO: 26856 - DNA, 15 bp, Homo sapiens
gcgcttcttgatggg

SEQ ID NO: 26857 - DNA, 15 bp, Homo sapiens
tgcgcttcttgatgg

SEQ ID NO: 26858 - DNA, 15 bp, Homo sapiens
ttgcgcttcttgatg

SEQ ID NO: 26859 - DNA, 15 bp, Homo sapiens
cttgcgcttcttgat

SEQ ID NO: 26860 - DNA, 15 bp, Homo sapiens
tcttgcgcttcttga

SEQ ID NO: 26861 - DNA, 15 bp, Homo sapiens
gtcttgcgcttcttg

SEQ ID NO: 26862 - DNA, 15 bp, Homo sapiens
ggtcttgcgcttctt

SEQ ID NO: 26863 - DNA, 15 bp, Homo sapiens
gggtcttgcgcttct

SEQ ID NO: 26864 - DNA, 15 bp, Homo sapiens
cgggtcttgcgcttc

SEQ ID NO: 26865 - DNA, 15 bp, Homo sapiens
ccgggtcttgcgctt

SEQ ID NO: 26866 - DNA, 15 bp, Homo sapiens
cccgggtcttgcgct

SEQ ID NO: 26867 - DNA, 15 bp, Homo sapiens
tcccgggtcttgcgc

SEQ ID NO: 26868 - DNA, 15 bp, Homo sapiens
ctcccgggtcttgcg

SEQ ID NO: 26869 - DNA, 15 bp, Homo sapiens
tctcccgggtcttgc

SEQ ID NO: 26870 - DNA, 15 bp, Homo sapiens
gtctcccgggtcttg

SEQ ID NO: 26871 - DNA, 15 bp, Homo sapiens
cgtctcccgggtctt

SEQ ID NO: 26872 - DNA, 15 bp, Homo sapiens
ccgtctcccgggtct

SEQ ID NO: 26873 - DNA, 15 bp, Homo sapiens
accgtctcccgggtc

SEQ ID NO: 26874 - DNA, 15 bp, Homo sapiens
gaccgtctcccgggt

SEQ ID NO: 26875 - DNA, 15 bp, Homo sapiens
tgaccgtctcccggg

SEQ ID NO: 26876 - DNA, 15 bp, Homo sapiens
ctgaccgtctcccgg

SEQ ID NO: 26877 - DNA, 15 bp, Homo sapiens
gctgaccgtctcccg

SEQ ID NO: 26878 - DNA, 15 bp, Homo sapiens
tgctgaccgtctccc

SEQ ID NO: 26879 - DNA, 15 bp, Homo sapiens
atgctgaccgtctcc

SEQ ID NO: 26880 - DNA, 15 bp, Homo sapiens
gatgctgaccgtctc

SEQ ID NO: 26881 - DNA, 15 bp, Homo sapiens
cgatgctgaccgtct

SEQ ID NO: 26882 - DNA, 15 bp, Homo sapiens
tcgatgctgaccgtc

SEQ ID NO: 26883 - DNA, 15 bp, Homo sapiens
ctcgatgctgaccgt

SEQ ID NO: 26884 - DNA, 15 bp, Homo sapiens
cctcgatgctgaccg

SEQ ID NO: 26885 - DNA, 15 bp, Homo sapiens
acctcgatgctgacc

SEQ ID NO: 26886 - DNA, 15 bp, Homo sapiens
gacctcgatgctgac

SEQ ID NO: 26887 - DNA, 15 bp, Homo sapiens
tgacctcgatgctga

SEQ ID NO: 26888 - DNA, 15 bp, Homo sapiens
ttgacctcgatgctg

SEQ ID NO: 26889 - DNA, 15 bp, Homo sapiens
cttgacctcgatgct

SEQ ID NO: 26890 - DNA, 15 bp, Homo sapiens
ccttgacctcgatgc

SEQ ID NO: 26891 - DNA, 15 bp, Homo sapiens
tccttgacctcgatg

SEQ ID NO: 26892 - DNA, 15 bp, Homo sapiens
ttccttgacctcgat

SEQ ID NO: 26893 - DNA, 15 bp, Homo sapiens
cttccttgacctcga

SEQ ID NO: 26894 - DNA, 15 bp, Homo sapiens
acttccttgacctcg

SEQ ID NO: 26895 - DNA, 15 bp, Homo sapiens
cacttccttgacctc

SEQ ID NO: 26896 - DNA, 15 bp, Homo sapiens
ccacttccttgacct

SEQ ID NO: 26897 - DNA, 15 bp, Homo sapiens
accacttccttgacc

SEQ ID NO: 26898 - DNA, 15 bp, Homo sapiens
caccacttccttgac

SEQ ID NO: 26899 - DNA, 15 bp, Homo sapiens
tcaccacttccttga

SEQ ID NO: 26900 - DNA, 15 bp, Homo sapiens
ttcaccacttccttg

SEQ ID NO: 26901 - DNA, 15 bp, Homo sapiens
cttcaccacttcctt

SEQ ID NO: 26902 - DNA, 15 bp, Homo sapiens
gcttcaccacttcct

SEQ ID NO: 26903 - DNA, 15 bp, Homo sapiens
ggcttcaccacttcc

SEQ ID NO: 26904 - DNA, 15 bp, Homo sapiens
gggcttcaccacttc

SEQ ID NO: 26905 - DNA, 15 bp, Homo sapiens
ggggcttcaccactt

SEQ ID NO: 26906 - DNA, 15 bp, Homo sapiens
aggggcttcaccact

SEQ ID NO: 26907 - DNA, 15 bp, Homo sapiens
caggggcttcaccac

SEQ ID NO: 26908 - DNA, 15 bp, Homo sapiens
gcaggggcttcacca

SEQ ID NO: 26909 - DNA, 15 bp, Homo sapiens
agcaggggcttcacc

SEQ ID NO: 26910 - DNA, 15 bp, Homo sapiens
cagcaggggcttcac

SEQ ID NO: 26911 - DNA, 15 bp, Homo sapiens
ccagcaggggcttca

SEQ ID NO: 26912 - DNA, 15 bp, Homo sapiens
accagcaggggcttc

SEQ ID NO: 26913 - DNA, 15 bp, Homo sapiens
caccagcaggggctt

SEQ ID NO: 26914 - DNA, 15 bp, Homo sapiens
acaccagcaggggct

SEQ ID NO: 26915 - DNA, 15 bp, Homo sapiens
gacaccagcaggggc

SEQ ID NO: 26916 - DNA, 15 bp, Homo sapiens
ggacaccagcagggg

SEQ ID NO: 26917 - DNA, 15 bp, Homo sapiens
tggacaccagcaggg

SEQ ID NO: 26918 - DNA, 15 bp, Homo sapiens
gtggacaccagcagg

SEQ ID NO: 26919 - DNA, 15 bp, Homo sapiens
ggtggacaccagcag

SEQ ID NO: 26920 - DNA, 15 bp, Homo sapiens
gggtggacaccagca

SEQ ID NO: 26921 - DNA, 15 bp, Homo sapiens
agggtggacaccagc

SEQ ID NO: 26922 - DNA, 15 bp, Homo sapiens
gagggtggacaccag

SEQ ID NO: 26923 - DNA, 15 bp, Homo sapiens
cgagggtggacacca

SEQ ID NO: 26924 - DNA, 15 bp, Homo sapiens
ccgagggtggacacc

SEQ ID NO: 26925 - DNA, 15 bp, Homo sapiens
accgagggtggacac

SEQ ID NO: 26926 - DNA, 15 bp, Homo sapiens
caccgagggtggaca

SEQ ID NO: 26927 - DNA, 15 bp, Homo sapiens
tcaccgagggtggac

SEQ ID NO: 26928 - DNA, 15 bp, Homo sapiens
ctcaccgagggtgga

SEQ ID NO: 26929 - DNA, 15 bp, Homo sapiens
tctcaccgagggtgg

SEQ ID NO: 26930 - DNA, 15 bp, Homo sapiens
ttctcaccgagggtg

SEQ ID NO: 26931 - DNA, 15 bp, Homo sapiens
cttctcaccgagggt

SEQ ID NO: 26932 - DNA, 15 bp, Homo sapiens
tcttctcaccgaggg

SEQ ID NO: 26933 - DNA, 15 bp, Homo sapiens
ctcttctcaccgagg

SEQ ID NO: 26934 - DNA, 15 bp, Homo sapiens
gctcttctcaccgag

SEQ ID NO: 26935 - DNA, 15 bp, Homo sapiens
cgctcttctcaccga

SEQ ID NO: 26936 - DNA, 15 bp, Homo sapiens
ccgctcttctcaccg

SEQ ID NO: 26937 - DNA, 15 bp, Homo sapiens
cccgctcttctcacc

SEQ ID NO: 26938 - DNA, 15 bp, Homo sapiens
tcccgctcttctcac

SEQ ID NO: 26939 - DNA, 15 bp, Homo sapiens
ttcccgctcttctca

SEQ ID NO: 26940 - DNA, 15 bp, Homo sapiens
tttcccgctcttctc

SEQ ID NO: 26941 - DNA, 15 bp, Homo sapiens
ctttcccgctcttct

SEQ ID NO: 26942 - DNA, 15 bp, Homo sapiens
cctttcccgctcttc

SEQ ID NO: 26943 - DNA, 15 bp, Homo sapiens
tcctttcccgctctt

SEQ ID NO: 26944 - DNA, 15 bp, Homo sapiens
gtcctttcccgctct

SEQ ID NO: 26945 - DNA, 15 bp, Homo sapiens
agtcctttcccgctc

SEQ ID NO: 26946 - DNA, 15 bp, Homo sapiens
cagtcctttcccgct

SEQ ID NO: 26947 - DNA, 15 bp, Homo sapiens
tcagtcctttcccgc

SEQ ID NO: 26948 - DNA, 15 bp, Homo sapiens
ttcagtcctttcccg

SEQ ID NO: 26949 - DNA, 15 bp, Homo sapiens
cttcagtcctttccc

SEQ ID NO: 26950 - DNA, 15 bp, Homo sapiens
tcttcagtcctttcc

SEQ ID NO: 26951 - DNA, 15 bp, Homo sapiens
gtcttcagtcctttc

SEQ ID NO: 26952 - DNA, 15 bp, Homo sapiens
ggtcttcagtccttt

SEQ ID NO: 26953 - DNA, 15 bp, Homo sapiens
aggtcttcagtcctt

SEQ ID NO: 26954 - DNA, 15 bp, Homo sapiens
caggtcttcagtcct

SEQ ID NO: 26955 - DNA, 15 bp, Homo sapiens
acaggtcttcagtcc

SEQ ID NO: 26956 - DNA, 15 bp, Homo sapiens
tacaggtcttcagtc

SEQ ID NO: 26957 - DNA, 15 bp, Homo sapiens
ttacaggtcttcagt

SEQ ID NO: 26958 - DNA, 15 bp, Homo sapiens
cttacaggtcttcag

SEQ ID NO: 26959 - DNA, 15 bp, Homo sapiens
tcttacaggtcttca

SEQ ID NO: 26960 - DNA, 15 bp, Homo sapiens
ctcttacaggtcttc

SEQ ID NO: 26961 - DNA, 15 bp, Homo sapiens
gctcttacaggtctt

SEQ ID NO: 26962 - DNA, 15 bp, Homo sapiens
ggctcttacaggtct

SEQ ID NO: 26963 - DNA, 15 bp, Homo sapiens
gggctcttacaggtc

SEQ ID NO: 26964 - DNA, 15 bp, Homo sapiens
agggctcttacaggt

SEQ ID NO: 26965 - DNA, 15 bp, Homo sapiens
cagggctcttacagg

SEQ ID NO: 26966 - DNA, 15 bp, Homo sapiens
ccagggctcttacag

SEQ ID NO: 26967 - DNA, 15 bp, Homo sapiens
cccagggctcttaca

SEQ ID NO: 26968 - DNA, 15 bp, Homo sapiens
gcccagggctcttac

SEQ ID NO: 26969 - DNA, 15 bp, Homo sapiens
cgcccagggctctta

SEQ ID NO: 26970 - DNA, 15 bp, Homo sapiens
ccgcccagggctctt

SEQ ID NO: 26971 - DNA, 15 bp, Homo sapiens
tccgcccagggctct

SEQ ID NO: 26972 - DNA, 15 bp, Homo sapiens
ttccgcccagggctc

SEQ ID NO: 26973 - DNA, 15 bp, Homo sapiens
tttccgcccagggct

SEQ ID NO: 26974 - DNA, 15 bp, Homo sapiens
ttttccgcccagggc

SEQ ID NO: 26975 - DNA, 15 bp, Homo sapiens
cttttccgcccaggg

SEQ ID NO: 26976 - DNA, 15 bp, Homo sapiens
gcttttccgcccagg

SEQ ID NO: 26977 - DNA, 15 bp, Homo sapiens
tgcttttccgcccag

SEQ ID NO: 26978 - DNA, 15 bp, Homo sapiens
ttgcttttccgccca

SEQ ID NO: 26979 - DNA, 15 bp, Homo sapiens
cttgcttttccgccc

SEQ ID NO: 26980 - DNA, 15 bp, Homo sapiens
ccttgcttttccgcc

SEQ ID NO: 26981 - DNA, 15 bp, Homo sapiens
tccttgcttttccgc

SEQ ID NO: 26982 - DNA, 15 bp, Homo sapiens
ctccttgcttttccg

SEQ ID NO: 26983 - DNA, 15 bp, Homo sapiens
tctccttgcttttcc

SEQ ID NO: 26984 - DNA, 15 bp, Homo sapiens
ctctccttgcttttc

SEQ ID NO: 26985 - DNA, 15 bp, Homo sapiens
gctctccttgctttt

SEQ ID NO: 26986 - DNA, 15 bp, Homo sapiens
tgctctccttgcttt

SEQ ID NO: 26987 - DNA, 15 bp, Homo sapiens
ctgctctccttgctt

SEQ ID NO: 26988 - DNA, 15 bp, Homo sapiens
gctgctctccttgct

SEQ ID NO: 26989 - DNA, 15 bp, Homo sapiens
ggctgctctccttgc

SEQ ID NO: 26990 - DNA, 15 bp, Homo sapiens
gggctgctctccttg

SEQ ID NO: 26991 - DNA, 15 bp, Homo sapiens
ggggctgctctcctt

SEQ ID NO: 26992 - DNA, 15 bp, Homo sapiens
tggggctgctctcct

SEQ ID NO: 26993 - DNA, 15 bp, Homo sapiens
ttggggctgctctcc

SEQ ID NO: 26994 - DNA, 15 bp, Homo sapiens
cttggggctgctctc

SEQ ID NO: 26995 - DNA, 15 bp, Homo sapiens
ccttggggctgctct

SEQ ID NO: 26996 - DNA, 15 bp, Homo sapiens
cccttggggctgctc

SEQ ID NO: 26997 - DNA, 15 bp, Homo sapiens
ccccttggggctgct

SEQ ID NO: 26998 - DNA, 15 bp, Homo sapiens
gccccttggggctgc

SEQ ID NO: 26999 - DNA, 15 bp, Homo sapiens
cgccccttggggctg

SEQ ID NO: 27000 - DNA, 15 bp, Homo sapiens
gcgccccttggggct

SEQ ID NO: 27001 - DNA, 15 bp, Homo sapiens
tgcgccccttggggc

SEQ ID NO: 27002 - DNA, 15 bp, Homo sapiens
ctgcgccccttgggg

SEQ ID NO: 27003 - DNA, 15 bp, Homo sapiens
gctgcgccccttggg

SEQ ID NO: 27004 - DNA, 15 bp, Homo sapiens
tgctgcgccccttgg

SEQ ID NO: 27005 - DNA, 15 bp, Homo sapiens
ctgctgcgccccttg

SEQ ID NO: 27006 - DNA, 15 bp, Homo sapiens
gctgctgcgcccctt

SEQ ID NO: 27007 - DNA, 15 bp, Homo sapiens
tgctgctgcgcccct

SEQ ID NO: 27008 - DNA, 15 bp, Homo sapiens
ctgctgctgcgcccc

SEQ ID NO: 27009 - DNA, 15 bp, Homo sapiens
gctgctgctgcgccc

SEQ ID NO: 27010 - DNA, 15 bp, Homo sapiens
cgctgctgctgcgcc

SEQ ID NO: 27011 - DNA, 15 bp, Homo sapiens
gcgctgctgctgcgc

SEQ ID NO: 27012 - DNA, 15 bp, Homo sapiens
ggcgctgctgctgcg

SEQ ID NO: 27013 - DNA, 15 bp, Homo sapiens
aggcgctgctgctgc

SEQ ID NO: 27014 - DNA, 15 bp, Homo sapiens
gaggcgctgctgctg

SEQ ID NO: 27015 - DNA, 15 bp, Homo sapiens
ggaggcgctgctgct

SEQ ID NO: 27016 - DNA, 15 bp, Homo sapiens
aggaggcgctgctgc

SEQ ID NO: 27017 - DNA, 15 bp, Homo sapiens
gaggaggcgctgctg

SEQ ID NO: 27018 - DNA, 15 bp, Homo sapiens
tgaggaggcgctgct

SEQ ID NO: 27019 - DNA, 15 bp, Homo sapiens
gtgaggaggcgctgc

SEQ ID NO: 27020 - DNA, 15 bp, Homo sapiens
ggtgaggaggcgctg

SEQ ID NO: 27021 - DNA, 15 bp, Homo sapiens
gggtgaggaggcgct

SEQ ID NO: 27022 - DNA, 15 bp, Homo sapiens
ggggtgaggaggcgc

SEQ ID NO: 27023 - DNA, 15 bp, Homo sapiens
gggggtgaggaggcg

SEQ ID NO: 27024 - DNA, 15 bp, Homo sapiens
ggggggtgaggaggc

SEQ ID NO: 27025 - DNA, 15 bp, Homo sapiens
tggggggtgaggagg

SEQ ID NO: 27026 - DNA, 15 bp, Homo sapiens
ttggggggtgaggag

SEQ ID NO: 27027 - DNA, 15 bp, Homo sapiens
cttggggggtgagga

SEQ ID NO: 27028 - DNA, 15 bp, Homo sapiens
tcttggggggtgagg

SEQ ID NO: 27029 - DNA, 15 bp, Homo sapiens
ttcttggggggtgag

SEQ ID NO: 27030 - DNA, 15 bp, Homo sapiens
cttcttggggggtga

SEQ ID NO: 27031 - DNA, 15 bp, Homo sapiens
ccttcttggggggtg

SEQ ID NO: 27032 - DNA, 15 bp, Homo sapiens
tccttcttggggggt

SEQ ID NO: 27033 - DNA, 15 bp, Homo sapiens
ctccttcttgggggg

SEQ ID NO: 27034 - DNA, 15 bp, Homo sapiens
gctccttcttggggg

SEQ ID NO: 27035 - DNA, 15 bp, Homo sapiens
tgctccttcttgggg

SEQ ID NO: 27036 - DNA, 15 bp, Homo sapiens
gtgctccttcttggg

SEQ ID NO: 27037 - DNA, 15 bp, Homo sapiens
ggtgctccttcttgg

SEQ ID NO: 27038 - DNA, 15 bp, Homo sapiens
tggtgctccttcttg

SEQ ID NO: 27039 - DNA, 15 bp, Homo sapiens
gtggtgctccttctt

SEQ ID NO: 27040 - DNA, 15 bp, Homo sapiens
ggtggtgctccttct

SEQ ID NO: 27041 - DNA, 15 bp, Homo sapiens
tggtggtgctccttc

SEQ ID NO: 27042 - DNA, 15 bp, Homo sapiens
gtggtggtgctcctt

SEQ ID NO: 27043 - DNA, 15 bp, Homo sapiens
ggtggtggtgctcct

SEQ ID NO: 27044 - DNA, 15 bp, Homo sapiens
tggtggtggtgctcc

SEQ ID NO: 27045 - DNA, 15 bp, Homo sapiens
atggtggtggtgctc

SEQ ID NO: 27046 - DNA, 15 bp, Homo sapiens
gatggtggtggtgct

SEQ ID NO: 27047 - DNA, 15 bp, Homo sapiens
tgatggtggtggtgc

SEQ ID NO: 27048 - DNA, 15 bp, Homo sapiens
gtgatggtggtggtg

SEQ ID NO: 27049 - DNA, 15 bp, Homo sapiens
ggtgatggtggtggt

SEQ ID NO: 27050 - DNA, 15 bp, Homo sapiens
tggtgatggtggtgg

SEQ ID NO: 27051 - DNA, 15 bp, Homo sapiens
gtggtgatggtggtg

SEQ ID NO: 27052 - DNA, 15 bp, Homo sapiens
ggtggtgatggtggt

SEQ ID NO: 27053 - DNA, 15 bp, Homo sapiens
tggtggtgatggtgg

SEQ ID NO: 27054 - DNA, 15 bp, Homo sapiens
gtggtggtgatggtg

SEQ ID NO: 27055 - DNA, 15 bp, Homo sapiens
agtggtggtgatggt

SEQ ID NO: 27056 - DNA, 15 bp, Homo sapiens
gagtggtggtgatgg

SEQ ID NO: 27057 - DNA, 15 bp, Homo sapiens
tgagtggtggtgatg

SEQ ID NO: 27058 - DNA, 15 bp, Homo sapiens
ctgagtggtggtgat

SEQ ID NO: 27059 - DNA, 15 bp, Homo sapiens
tctgagtggtggtga

SEQ ID NO: 27060 - DNA, 15 bp, Homo sapiens
ctctgagtggtggtg

SEQ ID NO: 27061 - DNA, 15 bp, Homo sapiens
actctgagtggtggt

SEQ ID NO: 27062 - DNA, 15 bp, Homo sapiens
gactctgagtggtgg

SEQ ID NO: 27063 - DNA, 15 bp, Homo sapiens
ggactctgagtggtg

SEQ ID NO: 27064 - DNA, 15 bp, Homo sapiens
gggactctgagtggt

SEQ ID NO: 27065 - DNA, 15 bp, Homo sapiens
ggggactctgagtgg

SEQ ID NO: 27066 - DNA, 15 bp, Homo sapiens
tggggactctgagtg

SEQ ID NO: 27067 - DNA, 15 bp, Homo sapiens
ttggggactctgagt

SEQ ID NO: 27068 - DNA, 15 bp, Homo sapiens
tttggggactctgag

SEQ ID NO: 27069 - DNA, 15 bp, Homo sapiens
ctttggggactctga

SEQ ID NO: 27070 - DNA, 15 bp, Homo sapiens
cctttggggactctg

SEQ ID NO: 27071 - DNA, 15 bp, Homo sapiens
gcctttggggactct

SEQ ID NO: 27072 - DNA, 15 bp, Homo sapiens
ggcctttggggactc

SEQ ID NO: 27073 - DNA, 15 bp, Homo sapiens
gggcctttggggact

SEQ ID NO: 27074 - DNA, 15 bp, Homo sapiens
ggggcctttggggac

SEQ ID NO: 27075 - DNA, 15 bp, Homo sapiens
gggggcctttgggga

SEQ ID NO: 27076 - DNA, 15 bp, Homo sapiens
cgggggcctttgggg

SEQ ID NO: 27077 - DNA, 15 bp, Homo sapiens
acgggggcctttggg

SEQ ID NO: 27078 - DNA, 15 bp, Homo sapiens
cacgggggcctttgg

SEQ ID NO: 27079 - DNA, 15 bp, Homo sapiens
gcacgggggcctttg

SEQ ID NO: 27080 - DNA, 15 bp, Homo sapiens
ggcacgggggccttt

SEQ ID NO: 27081 - DNA, 15 bp, Homo sapiens
tggcacgggggcctt

SEQ ID NO: 27082 - DNA, 15 bp, Homo sapiens
gtggcacgggggcct

SEQ ID NO: 27083 - DNA, 15 bp, Homo sapiens
agtggcacgggggcc

SEQ ID NO: 27084 - DNA, 15 bp, Homo sapiens
cagtggcacgggggc

SEQ ID NO: 27085 - DNA, 15 bp, Homo sapiens
gcagtggcacggggg

SEQ ID NO: 27086 - DNA, 15 bp, Homo sapiens
agcagtggcacgggg

SEQ ID NO: 27087 - DNA, 15 bp, Homo sapiens
gagcagtggcacggg

SEQ ID NO: 27088 - DNA, 15 bp, Homo sapiens
ggagcagtggcacgg

SEQ ID NO: 27089 - DNA, 15 bp, Homo sapiens
gggagcagtggcacg

SEQ ID NO: 27090 - DNA, 15 bp, Homo sapiens
tgggagcagtggcac

SEQ ID NO: 27091 - DNA, 15 bp, Homo sapiens
gtgggagcagtggca

SEQ ID NO: 27092 - DNA, 15 bp, Homo sapiens
ggtgggagcagtggc

SEQ ID NO: 27093 - DNA, 15 bp, Homo sapiens
gggtgggagcagtgg

SEQ ID NO: 27094 - DNA, 15 bp, Homo sapiens
ggggtgggagcagtg

SEQ ID NO: 27095 - DNA, 15 bp, Homo sapiens
aggggtgggagcagt

SEQ ID NO: 27096 - DNA, 15 bp, Homo sapiens
caggggtgggagcag

SEQ ID NO: 27097 - DNA, 15 bp, Homo sapiens
gcaggggtgggagca

SEQ ID NO: 27098 - DNA, 15 bp, Homo sapiens
ggcaggggtgggagc

SEQ ID NO: 27099 - DNA, 15 bp, Homo sapiens
gggcaggggtgggag

SEQ ID NO: 27100 - DNA, 15 bp, Homo sapiens
ggggcaggggtggga

SEQ ID NO: 27101 - DNA, 15 bp, Homo sapiens
gggggcaggggtggg

SEQ ID NO: 27102 - DNA, 15 bp, Homo sapiens
tgggggcaggggtgg

SEQ ID NO: 27103 - DNA, 15 bp, Homo sapiens
gtgggggcaggggtg

SEQ ID NO: 27104 - DNA, 15 bp, Homo sapiens
ggtgggggcaggggt

SEQ ID NO: 27105 - DNA, 15 bp, Homo sapiens
aggtgggggcagggg

SEQ ID NO: 27106 - DNA, 15 bp, Homo sapiens
gaggtgggggcaggg

SEQ ID NO: 27107 - DNA, 15 bp, Homo sapiens
ggaggtgggggcagg

SEQ ID NO: 27108 - DNA, 15 bp, Homo sapiens
tggaggtgggggcag

SEQ ID NO: 27109 - DNA, 15 bp, Homo sapiens
gtggaggtgggggca

SEQ ID NO: 27110 - DNA, 15 bp, Homo sapiens
ggtggaggtgggggc

SEQ ID NO: 27111 - DNA, 15 bp, Homo sapiens
aggtggaggtggggg

SEQ ID NO: 27112 - DNA, 15 bp, Homo sapiens
caggtggaggtgggg

SEQ ID NO: 27113 - DNA, 15 bp, Homo sapiens
tcaggtggaggtggg

SEQ ID NO: 27114 - DNA, 15 bp, Homo sapiens
ctcaggtggaggtgg

SEQ ID NO: 27115 - DNA, 15 bp, Homo sapiens
gctcaggtggaggtg

SEQ ID NO: 27116 - DNA, 15 bp, Homo sapiens
ggctcaggtggaggt

SEQ ID NO: 27117 - DNA, 15 bp, Homo sapiens
gggctcaggtggagg

SEQ ID NO: 27118 - DNA, 15 bp, Homo sapiens
cgggctcaggtggag

SEQ ID NO: 27119 - DNA, 15 bp, Homo sapiens
tcgggctcaggtgga

SEQ ID NO: 27120 - DNA, 15 bp, Homo sapiens
ctcgggctcaggtgg

SEQ ID NO: 27121 - DNA, 15 bp, Homo sapiens
tctcgggctcaggtg

SEQ ID NO: 27122 - DNA, 15 bp, Homo sapiens
ctctcgggctcaggt

SEQ ID NO: 27123 - DNA, 15 bp, Homo sapiens
gctctcgggctcagg

SEQ ID NO: 27124 - DNA, 15 bp, Homo sapiens
agctctcgggctcag

SEQ ID NO: 27125 - DNA, 15 bp, Homo sapiens
gagctctcgggctca

SEQ ID NO: 27126 - DNA, 15 bp, Homo sapiens
ggagctctcgggctc

SEQ ID NO: 27127 - DNA, 15 bp, Homo sapiens
cggagctctcgggct

SEQ ID NO: 27128 - DNA, 15 bp, Homo sapiens
tcggagctctcgggc

SEQ ID NO: 27129 - DNA, 15 bp, Homo sapiens
ctcggagctctcggg

SEQ ID NO: 27130 - DNA, 15 bp, Homo sapiens
cctcggagctctcgg

SEQ ID NO: 27131 - DNA, 15 bp, Homo sapiens
tcctcggagctctcg

SEQ ID NO: 27132 - DNA, 15 bp, Homo sapiens
gtcctcggagctctc

SEQ ID NO: 27133 - DNA, 15 bp, Homo sapiens
ggtcctcggagctct

SEQ ID NO: 27134 - DNA, 15 bp, Homo sapiens
gggtcctcggagctc

SEQ ID NO: 27135 - DNA, 15 bp, Homo sapiens
ggggtcctcggagct

SEQ ID NO: 27136 - DNA, 15 bp, Homo sapiens
tggggtcctcggagc

SEQ ID NO: 27137 - DNA, 15 bp, Homo sapiens
gtggggtcctcggag

SEQ ID NO: 27138 - DNA, 15 bp, Homo sapiens
ggtggggtcctcgga

SEQ ID NO: 27139 - DNA, 15 bp, Homo sapiens
tggtggggtcctcgg

SEQ ID NO: 27140 - DNA, 15 bp, Homo sapiens
ctggtggggtcctcg

SEQ ID NO: 27141 - DNA, 15 bp, Homo sapiens
gctggtggggtcctc

SEQ ID NO: 27142 - DNA, 15 bp, Homo sapiens
ggctggtggggtcct

SEQ ID NO: 27143 - DNA, 15 bp, Homo sapiens
gggctggtggggtcc

SEQ ID NO: 27144 - DNA, 15 bp, Homo sapiens
ggggctggtggggtc

SEQ ID NO: 27145 - DNA, 15 bp, Homo sapiens
gggggctggtggggt

SEQ ID NO: 27146 - DNA, 15 bp, Homo sapiens
ggggggctggtgggg

SEQ ID NO: 27147 - DNA, 15 bp, Homo sapiens
aggggggctggtggg

SEQ ID NO: 27148 - DNA, 15 bp, Homo sapiens
caggggggctggtgg

SEQ ID NO: 27149 - DNA, 15 bp, Homo sapiens
tcaggggggctggtg

SEQ ID NO: 27150 - DNA, 15 bp, Homo sapiens
ctcaggggggctggt

SEQ ID NO: 27151 - DNA, 15 bp, Homo sapiens
gctcaggggggctgg

SEQ ID NO: 27152 - DNA, 15 bp, Homo sapiens
ggctcaggggggctg

SEQ ID NO: 27153 - DNA, 15 bp, Homo sapiens
gggctcaggggggct

SEQ ID NO: 27154 - DNA, 15 bp, Homo sapiens
ggggctcaggggggc

SEQ ID NO: 27155 - DNA, 15 bp, Homo sapiens
tggggctcagggggg

SEQ ID NO: 27156 - DNA, 15 bp, Homo sapiens
ctggggctcaggggg

SEQ ID NO: 27157 - DNA, 15 bp, Homo sapiens
cctggggctcagggg

SEQ ID NO: 27158 - DNA, 15 bp, Homo sapiens
tcctggggctcaggg

SEQ ID NO: 27159 - DNA, 15 bp, Homo sapiens
gtcctggggctcagg

SEQ ID NO: 27160 - DNA, 15 bp, Homo sapiens
agtcctggggctcag

SEQ ID NO: 27161 - DNA, 15 bp, Homo sapiens
aagtcctggggctca

SEQ ID NO: 27162 - DNA, 15 bp, Homo sapiens
caagtcctggggctc

SEQ ID NO: 27163 - DNA, 15 bp, Homo sapiens
tcaagtcctggggct

SEQ ID NO: 27164 - DNA, 15 bp, Homo sapiens
ctcaagtcctggggc

SEQ ID NO: 27165 - DNA, 15 bp, Homo sapiens
gctcaagtcctgggg

SEQ ID NO: 27166 - DNA, 15 bp, Homo sapiens
tgctcaagtcctggg

SEQ ID NO: 27167 - DNA, 15 bp, Homo sapiens
ctgctcaagtcctgg

SEQ ID NO: 27168 - DNA, 15 bp, Homo sapiens
gctgctcaagtcctg

SEQ ID NO: 27169 - DNA, 15 bp, Homo sapiens
tgctgctcaagtcct

SEQ ID NO: 27170 - DNA, 15 bp, Homo sapiens
ctgctgctcaagtcc

SEQ ID NO: 27171 - DNA, 15 bp, Homo sapiens
gctgctgctcaagtc

SEQ ID NO: 27172 - DNA, 15 bp, Homo sapiens
cgctgctgctcaagt

SEQ ID NO: 27173 - DNA, 15 bp, Homo sapiens
acgctgctgctcaag

SEQ ID NO: 27174 - DNA, 15 bp, Homo sapiens
gacgctgctgctcaa

SEQ ID NO: 27175 - DNA, 15 bp, Homo sapiens
agacgctgctgctca

SEQ ID NO: 27176 - DNA, 15 bp, Homo sapiens
cagacgctgctgctc

SEQ ID NO: 27177 - DNA, 15 bp, Homo sapiens
gcagacgctgctgct

SEQ ID NO: 27178 - DNA, 15 bp, Homo sapiens
tgcagacgctgctgc

SEQ ID NO: 27179 - DNA, 15 bp, Homo sapiens
ttgcagacgctgctg

SEQ ID NO: 27180 - DNA, 15 bp, Homo sapiens
tttgcagacgctgct

SEQ ID NO: 27181 - DNA, 15 bp, Homo sapiens
ctttgcagacgctgc

SEQ ID NO: 27182 - DNA, 15 bp, Homo sapiens
tctttgcagacgctg

SEQ ID NO: 27183 - DNA, 15 bp, Homo sapiens
ctctttgcagacgct

SEQ ID NO: 27184 - DNA, 15 bp, Homo sapiens
cctctttgcagacgc

SEQ ID NO: 27185 - DNA, 15 bp, Homo sapiens
tcctctttgcagacg

SEQ ID NO: 27186 - DNA, 15 bp, Homo sapiens
ctcctctttgcagac

SEQ ID NO: 27187 - DNA, 15 bp, Homo sapiens
tctcctctttgcaga

SEQ ID NO: 27188 - DNA, 15 bp, Homo sapiens
ttctcctctttgcag

SEQ ID NO: 27189 - DNA, 15 bp, Homo sapiens
cttctcctctttgca

SEQ ID NO: 27190 - DNA, 15 bp, Homo sapiens
tcttctcctctttgc

SEQ ID NO: 27191 - DNA, 15 bp, Homo sapiens
atcttctcctctttg

SEQ ID NO: 27192 - DNA, 15 bp, Homo sapiens
catcttctcctcttt

SEQ ID NO: 27193 - DNA, 15 bp, Homo sapiens
gcatcttctcctctt

SEQ ID NO: 27194 - DNA, 15 bp, Homo sapiens
ggcatcttctcctct

SEQ ID NO: 27195 - DNA, 15 bp, Homo sapiens
gggcatcttctcctc

SEQ ID NO: 27196 - DNA, 15 bp, Homo sapiens
tgggcatcttctcct

SEQ ID NO: 27197 - DNA, 15 bp, Homo sapiens
ctgggcatcttctcc

SEQ ID NO: 27198 - DNA, 15 bp, Homo sapiens
tctgggcatcttctc

SEQ ID NO: 27199 - DNA, 15 bp, Homo sapiens
ctctgggcatcttct

SEQ ID NO: 27200 - DNA, 15 bp, Homo sapiens
cctctgggcatcttc

SEQ ID NO: 27201 - DNA, 15 bp, Homo sapiens
tcctctgggcatctt

SEQ ID NO: 27202 - DNA, 15 bp, Homo sapiens
ctcctctgggcatct

SEQ ID NO: 27203 - DNA, 15 bp, Homo sapiens
cctcctctgggcatc

SEQ ID NO: 27204 - DNA, 15 bp, Homo sapiens
gcctcctctgggcat

SEQ ID NO: 27205 - DNA, 15 bp, Homo sapiens
agcctcctctgggca

SEQ ID NO: 27206 - DNA, 15 bp, Homo sapiens
gagcctcctctgggc

SEQ ID NO: 27207 - DNA, 15 bp, Homo sapiens
tgagcctcctctggg

SEQ ID NO: 27208 - DNA, 15 bp, Homo sapiens
gtgagcctcctctgg

SEQ ID NO: 27209 - DNA, 15 bp, Homo sapiens
agtgagcctcctctg

SEQ ID NO: 27210 - DNA, 15 bp, Homo sapiens
cagtgagcctcctct

SEQ ID NO: 27211 - DNA, 15 bp, Homo sapiens
ccagtgagcctcctc

SEQ ID NO: 27212 - DNA, 15 bp, Homo sapiens
tccagtgagcctcct

SEQ ID NO: 27213 - DNA, 15 bp, Homo sapiens
ctccagtgagcctcc

SEQ ID NO: 27214 - DNA, 15 bp, Homo sapiens
tctccagtgagcctc

SEQ ID NO: 27215 - DNA, 15 bp, Homo sapiens
ctctccagtgagcct

SEQ ID NO: 27216 - DNA, 15 bp, Homo sapiens
gctctccagtgagcc

SEQ ID NO: 27217 - DNA, 15 bp, Homo sapiens
cgctctccagtgagc

SEQ ID NO: 27218 - DNA, 15 bp, Homo sapiens
tcgctctccagtgag

SEQ ID NO: 27219 - DNA, 15 bp, Homo sapiens
gtcgctctccagtga

SEQ ID NO: 27220 - DNA, 15 bp, Homo sapiens
cgtcgctctccagtg

SEQ ID NO: 27221 - DNA, 15 bp, Homo sapiens
ccgtcgctctccagt

SEQ ID NO: 27222 - DNA, 15 bp, Homo sapiens
gccgtcgctctccag

SEQ ID NO: 27223 - DNA, 15 bp, Homo sapiens
agccgtcgctctcca

SEQ ID NO: 27224 - DNA, 15 bp, Homo sapiens
cagccgtcgctctcc

SEQ ID NO: 27225 - DNA, 15 bp, Homo sapiens
gcagccgtcgctctc

SEQ ID NO: 27226 - DNA, 15 bp, Homo sapiens
ggcagccgtcgctct

SEQ ID NO: 27227 - DNA, 15 bp, Homo sapiens
gggcagccgtcgctc

SEQ ID NO: 27228 - DNA, 15 bp, Homo sapiens
ggggcagccgtcgct

SEQ ID NO: 27229 - DNA, 15 bp, Homo sapiens
tggggcagccgtcgc

SEQ ID NO: 27230 - DNA, 15 bp, Homo sapiens
ttggggcagccgtcg

SEQ ID NO: 27231 - DNA, 15 bp, Homo sapiens
cttggggcagccgtc

SEQ ID NO: 27232 - DNA, 15 bp, Homo sapiens
ccttggggcagccgt

SEQ ID NO: 27233 - DNA, 15 bp, Homo sapiens
tccttggggcagccg

SEQ ID NO: 27234 - DNA, 15 bp, Homo sapiens
ctccttggggcagcc

SEQ ID NO: 27235 - DNA, 15 bp, Homo sapiens
gctccttggggcagc

SEQ ID NO: 27236 - DNA, 15 bp, Homo sapiens
ggctccttggggcag

SEQ ID NO: 27237 - DNA, 15 bp, Homo sapiens
tggctccttggggca

SEQ ID NO: 27238 - DNA, 15 bp, Homo sapiens
ctggctccttggggc

SEQ ID NO: 27239 - DNA, 15 bp, Homo sapiens
gctggctccttgggg

SEQ ID NO: 27240 - DNA, 15 bp, Homo sapiens
agctggctccttggg

SEQ ID NO: 27241 - DNA, 15 bp, Homo sapiens
tagctggctccttgg

SEQ ID NO: 27242 - DNA, 15 bp, Homo sapiens
ttagctggctccttg

SEQ ID NO: 27243 - DNA, 15 bp, Homo sapiens
cttagctggctcctt

SEQ ID NO: 27244 - DNA, 15 bp, Homo sapiens
tcttagctggctcct

SEQ ID NO: 27245 - DNA, 15 bp, Homo sapiens
gtcttagctggctcc

SEQ ID NO: 27246 - DNA, 15 bp, Homo sapiens
agtcttagctggctc

SEQ ID NO: 27247 - DNA, 15 bp, Homo sapiens
gagtcttagctggct

SEQ ID NO: 27248 - DNA, 15 bp, Homo sapiens
tgagtcttagctggc

SEQ ID NO: 27249 - DNA, 15 bp, Homo sapiens
ctgagtcttagctgg

SEQ ID NO: 27250 - DNA, 15 bp, Homo sapiens
gctgagtcttagctg

SEQ ID NO: 27251 - DNA, 15 bp, Homo sapiens
ggctgagtcttagct

SEQ ID NO: 27252 - DNA, 15 bp, Homo sapiens
gggctgagtcttagc

SEQ ID NO: 27253 - DNA, 15 bp, Homo sapiens
cgggctgagtcttag

SEQ ID NO: 27254 - DNA, 15 bp, Homo sapiens
gcgggctgagtctta

SEQ ID NO: 27255 - DNA, 15 bp, Homo sapiens
cgcgggctgagtctt

SEQ ID NO: 27256 - DNA, 15 bp, Homo sapiens
ccgcgggctgagtct

SEQ ID NO: 27257 - DNA, 15 bp, Homo sapiens
accgcgggctgagtc

SEQ ID NO: 27258 - DNA, 15 bp, Homo sapiens
aaccgcgggctgagt

SEQ ID NO: 27259 - DNA, 15 bp, Homo sapiens
caaccgcgggctgag

SEQ ID NO: 27260 - DNA, 15 bp, Homo sapiens
gcaaccgcgggctga

SEQ ID NO: 27261 - DNA, 15 bp, Homo sapiens
ggcaaccgcgggctg

SEQ ID NO: 27262 - DNA, 15 bp, Homo sapiens
tggcaaccgcgggct

SEQ ID NO: 27263 - DNA, 15 bp, Homo sapiens
gtggcaaccgcgggc

SEQ ID NO: 27264 - DNA, 15 bp, Homo sapiens
ggtggcaaccgcggg

SEQ ID NO: 27265 - DNA, 15 bp, Homo sapiens
cggtggcaaccgcgg

SEQ ID NO: 27266 - DNA, 15 bp, Homo sapiens
gcggtggcaaccgcg

SEQ ID NO: 27267 - DNA, 15 bp, Homo sapiens
ggcggtggcaaccgc

SEQ ID NO: 27268 - DNA, 15 bp, Homo sapiens
cggcggtggcaaccg

SEQ ID NO: 27269 - DNA, 15 bp, Homo sapiens
gcggcggtggcaacc

SEQ ID NO: 27270 - DNA, 15 bp, Homo sapiens
ggcggcggtggcaac

SEQ ID NO: 27271 - DNA, 15 bp, Homo sapiens
tggcggcggtggcaa

SEQ ID NO: 27272 - DNA, 15 bp, Homo sapiens
gtggcggcggtggca

SEQ ID NO: 27273 - DNA, 15 bp, Homo sapiens
cgtggcggcggtggc

SEQ ID NO: 27274 - DNA, 15 bp, Homo sapiens
ccgtggcggcggtgg

SEQ ID NO: 27275 - DNA, 15 bp, Homo sapiens
gccgtggcggcggtg

SEQ ID NO: 27276 - DNA, 15 bp, Homo sapiens
ggccgtggcggcggt

SEQ ID NO: 27277 - DNA, 15 bp, Homo sapiens
cggccgtggcggcgg

SEQ ID NO: 27278 - DNA, 15 bp, Homo sapiens
gcggccgtggcggcg

SEQ ID NO: 27279 - DNA, 15 bp, Homo sapiens
tgcggccgtggcggc

SEQ ID NO: 27280 - DNA, 15 bp, Homo sapiens
ctgcggccgtggcgg

SEQ ID NO: 27281 - DNA, 15 bp, Homo sapiens
tctgcggccgtggcg

SEQ ID NO: 27282 - DNA, 15 bp, Homo sapiens
ttctgcggccgtggc

SEQ ID NO: 27283 - DNA, 15 bp, Homo sapiens
tttctgcggccgtgg

SEQ ID NO: 27284 - DNA, 15 bp, Homo sapiens
ttttctgcggccgtg

SEQ ID NO: 27285 - DNA, 15 bp, Homo sapiens
cttttctgcggccgt

SEQ ID NO: 27286 - DNA, 15 bp, Homo sapiens
acttttctgcggccg

SEQ ID NO: 27287 - DNA, 15 bp, Homo sapiens
tacttttctgcggcc

SEQ ID NO: 27288 - DNA, 15 bp, Homo sapiens
gtacttttctgcggc

SEQ ID NO: 27289 - DNA, 15 bp, Homo sapiens
tgtacttttctgcgg

SEQ ID NO: 27290 - DNA, 15 bp, Homo sapiens
ttgtacttttctgcg

SEQ ID NO: 27291 - DNA, 15 bp, Homo sapiens
tttgtacttttctgc

SEQ ID NO: 27292 - DNA, 15 bp, Homo sapiens
gtttgtacttttctg

SEQ ID NO: 27293 - DNA, 15 bp, Homo sapiens
tgtttgtacttttct

SEQ ID NO: 27294 - DNA, 15 bp, Homo sapiens
gtgtttgtacttttc

SEQ ID NO: 27295 - DNA, 15 bp, Homo sapiens
ggtgtttgtactttt

SEQ ID NO: 27296 - DNA, 15 bp, Homo sapiens
cggtgtttgtacttt

SEQ ID NO: 27297 - DNA, 15 bp, Homo sapiens
tcggtgtttgtactt

SEQ ID NO: 27298 - DNA, 15 bp, Homo sapiens
ctcggtgtttgtact

SEQ ID NO: 27299 - DNA, 15 bp, Homo sapiens
cctcggtgtttgtac

SEQ ID NO: 27300 - DNA, 15 bp, Homo sapiens
ccctcggtgtttgta

SEQ ID NO: 27301 - DNA, 15 bp, Homo sapiens
cccctcggtgtttgt

SEQ ID NO: 27302 - DNA, 15 bp, Homo sapiens
tcccctcggtgtttg

SEQ ID NO: 27303 - DNA, 15 bp, Homo sapiens
ctcccctcggtgttt

SEQ ID NO: 27304 - DNA, 15 bp, Homo sapiens
cctcccctcggtgtt

SEQ ID NO: 27305 - DNA, 15 bp, Homo sapiens
ccctcccctcggtgt

SEQ ID NO: 27306 - DNA, 15 bp, Homo sapiens
tccctcccctcggtg

SEQ ID NO: 27307 - DNA, 15 bp, Homo sapiens
ctccctcccctcggt

SEQ ID NO: 27308 - DNA, 15 bp, Homo sapiens
tctccctcccctcgg

SEQ ID NO: 27309 - DNA, 15 bp, Homo sapiens
ctctccctcccctcg

SEQ ID NO: 27310 - DNA, 15 bp, Homo sapiens
gctctccctcccctc

SEQ ID NO: 27311 - DNA, 15 bp, Homo sapiens
cgctctccctcccct

SEQ ID NO: 27312 - DNA, 15 bp, Homo sapiens
gcgctctccctcccc

SEQ ID NO: 27313 - DNA, 15 bp, Homo sapiens
tgcgctctccctccc

SEQ ID NO: 27314 - DNA, 15 bp, Homo sapiens
ttgcgctctccctcc

SEQ ID NO: 27315 - DNA, 15 bp, Homo sapiens
tttgcgctctccctc

SEQ ID NO: 27316 - DNA, 15 bp, Homo sapiens
ctttgcgctctccct

SEQ ID NO: 27317 - DNA, 15 bp, Homo sapiens
tctttgcgctctccc

SEQ ID NO: 27318 - DNA, 15 bp, Homo sapiens
gtctttgcgctctcc

SEQ ID NO: 27319 - DNA, 15 bp, Homo sapiens
tgtctttgcgctctc

SEQ ID NO: 27320 - DNA, 15 bp, Homo sapiens
atgtctttgcgctct

SEQ ID NO: 27321 - DNA, 15 bp, Homo sapiens
aatgtctttgcgctc

SEQ ID NO: 27322 - DNA, 15 bp, Homo sapiens
caatgtctttgcgct

SEQ ID NO: 27323 - DNA, 15 bp, Homo sapiens
acaatgtctttgcgc

SEQ ID NO: 27324 - DNA, 15 bp, Homo sapiens
aacaatgtctttgcg

SEQ ID NO: 27325 - DNA, 15 bp, Homo sapiens
aaacaatgtctttgc

SEQ ID NO: 27326 - DNA, 15 bp, Homo sapiens
gaaacaatgtctttg

SEQ ID NO: 27327 - DNA, 15 bp, Homo sapiens
tgaaacaatgtcttt

SEQ ID NO: 27328 - DNA, 15 bp, Homo sapiens
atgaaacaatgtctt

SEQ ID NO: 27329 - DNA, 15 bp, Homo sapiens
gatgaaacaatgtct

SEQ ID NO: 27330 - DNA, 15 bp, Homo sapiens
ggatgaaacaatgtc

SEQ ID NO: 27331 - DNA, 15 bp, Homo sapiens
aggatgaaacaatgt

SEQ ID NO: 27332 - DNA, 15 bp, Homo sapiens
gaggatgaaacaatg

SEQ ID NO: 27333 - DNA, 15 bp, Homo sapiens
ggaggatgaaacaat

SEQ ID NO: 27334 - DNA, 15 bp, Homo sapiens
tggaggatgaaacaa

SEQ ID NO: 27335 - DNA, 15 bp, Homo sapiens
atggaggatgaaaca

SEQ ID NO: 27336 - DNA, 15 bp, Homo sapiens
catggaggatgaaac

SEQ ID NO: 27337 - DNA, 15 bp, Homo sapiens
gcatggaggatgaaa

SEQ ID NO: 27338 - DNA, 15 bp, Homo sapiens
ggcatggaggatgaa

SEQ ID NO: 27339 - DNA, 15 bp, Homo sapiens
tggcatggaggatga

SEQ ID NO: 27340 - DNA, 15 bp, Homo sapiens
ttggcatggaggatg

SEQ ID NO: 27341 - DNA, 15 bp, Homo sapiens
cttggcatggaggat

SEQ ID NO: 27342 - DNA, 15 bp, Homo sapiens
ccttggcatggagga

SEQ ID NO: 27343 - DNA, 15 bp, Homo sapiens
gccttggcatggagg

SEQ ID NO: 27344 - DNA, 15 bp, Homo sapiens
ggccttggcatggag

SEQ ID NO: 27345 - DNA, 15 bp, Homo sapiens
tggccttggcatgga

SEQ ID NO: 27346 - DNA, 15 bp, Homo sapiens
ttggccttggcatgg

SEQ ID NO: 27347 - DNA, 15 bp, Homo sapiens
tttggccttggcatg

SEQ ID NO: 27348 - DNA, 15 bp, Homo sapiens
gtttggccttggcat

SEQ ID NO: 27349 - DNA, 15 bp, Homo sapiens
tgtttggccttggca

SEQ ID NO: 27350 - DNA, 15 bp, Homo sapiens
ctgtttggccttggc

SEQ ID NO: 27351 - DNA, 15 bp, Homo sapiens
tctgtttggccttgg

SEQ ID NO: 27352 - DNA, 15 bp, Homo sapiens
ctctgtttggccttg

SEQ ID NO: 27353 - DNA, 15 bp, Homo sapiens
tctctgtttggcctt

SEQ ID NO: 27354 - DNA, 15 bp, Homo sapiens
ctctctgtttggcct

SEQ ID NO: 27355 - DNA, 15 bp, Homo sapiens
cctctctgtttggcc

SEQ ID NO: 27356 - DNA, 15 bp, Homo sapiens
tcctctctgtttggc

SEQ ID NO: 27357 - DNA, 15 bp, Homo sapiens
ctcctctctgtttgg

SEQ ID NO: 27358 - DNA, 15 bp, Homo sapiens
gctcctctctgtttg

SEQ ID NO: 27359 - DNA, 15 bp, Homo sapiens
ggctcctctctgttt

SEQ ID NO: 27360 - DNA, 15 bp, Homo sapiens
aggctcctctctgtt

SEQ ID NO: 27361 - DNA, 15 bp, Homo sapiens
caggctcctctctgt

SEQ ID NO: 27362 - DNA, 15 bp, Homo sapiens
acaggctcctctctg

SEQ ID NO: 27363 - DNA, 15 bp, Homo sapiens
cacaggctcctctct

SEQ ID NO: 27364 - DNA, 15 bp, Homo sapiens
ccacaggctcctctc

SEQ ID NO: 27365 - DNA, 15 bp, Homo sapiens
tccacaggctcctct

SEQ ID NO: 27366 - DNA, 15 bp, Homo sapiens
gtccacaggctcctc

SEQ ID NO: 27367 - DNA, 15 bp, Homo sapiens
tgtccacaggctcct

SEQ ID NO: 27368 - DNA, 15 bp, Homo sapiens
ctgtccacaggctcc

SEQ ID NO: 27369 - DNA, 15 bp, Homo sapiens
gctgtccacaggctc

SEQ ID NO: 27370 - DNA, 15 bp, Homo sapiens
ggctgtccacaggct

SEQ ID NO: 27371 - DNA, 15 bp, Homo sapiens
cggctgtccacaggc

SEQ ID NO: 27372 - DNA, 15 bp, Homo sapiens
ccggctgtccacagg

SEQ ID NO: 27373 - DNA, 15 bp, Homo sapiens
tccggctgtccacag

SEQ ID NO: 27374 - DNA, 15 bp, Homo sapiens
gtccggctgtccaca

SEQ ID NO: 27375 - DNA, 15 bp, Homo sapiens
cgtccggctgtccac

SEQ ID NO: 27376 - DNA, 15 bp, Homo sapiens
gcgtccggctgtcca

SEQ ID NO: 27377 - DNA, 15 bp, Homo sapiens
ggcgtccggctgtcc

SEQ ID NO: 27378 - DNA, 15 bp, Homo sapiens
gggcgtccggctgtc

SEQ ID NO: 27379 - DNA, 15 bp, Homo sapiens
cgggcgtccggctgt

SEQ ID NO: 27380 - DNA, 15 bp, Homo sapiens
acgggcgtccggctg

SEQ ID NO: 27381 - DNA, 15 bp, Homo sapiens
cacgggcgtccggct

SEQ ID NO: 27382 - DNA, 15 bp, Homo sapiens
tcacgggcgtccggc

SEQ ID NO: 27383 - DNA, 15 bp, Homo sapiens
gtcacgggcgtccgg

SEQ ID NO: 27384 - DNA, 15 bp, Homo sapiens
ggtcacgggcgtccg

SEQ ID NO: 27385 - DNA, 15 bp, Homo sapiens
cggtcacgggcgtcc

SEQ ID NO: 27386 - DNA, 15 bp, Homo sapiens
tcggtcacgggcgtc

SEQ ID NO: 27387 - DNA, 15 bp, Homo sapiens
ctcggtcacgggcgt

SEQ ID NO: 27388 - DNA, 15 bp, Homo sapiens
tctcggtcacgggcg

SEQ ID NO: 27389 - DNA, 15 bp, Homo sapiens
ctctcggtcacgggc

SEQ ID NO: 27390 - DNA, 15 bp, Homo sapiens
tctctcggtcacggg

SEQ ID NO: 27391 - DNA, 15 bp, Homo sapiens
ctctctcggtcacgg

SEQ ID NO: 27392 - DNA, 15 bp, Homo sapiens
actctctcggtcacg

SEQ ID NO: 27393 - DNA, 15 bp, Homo sapiens
aactctctcggtcac

SEQ ID NO: 27394 - DNA, 15 bp, Homo sapiens
taactctctcggtca

SEQ ID NO: 27395 - DNA, 15 bp, Homo sapiens
ctaactctctcggtc

SEQ ID NO: 27396 - DNA, 15 bp, Homo sapiens
gctaactctctcggt

SEQ ID NO: 27397 - DNA, 15 bp, Homo sapiens
agctaactctctcgg

SEQ ID NO: 27398 - DNA, 15 bp, Homo sapiens
cagctaactctctcg

SEQ ID NO: 27399 - DNA, 15 bp, Homo sapiens
tcagctaactctctc

SEQ ID NO: 27400 - DNA, 15 bp, Homo sapiens
gtcagctaactctct

SEQ ID NO: 27401 - DNA, 15 bp, Homo sapiens
agtcagctaactctc

SEQ ID NO: 27402 - DNA, 15 bp, Homo sapiens
aagtcagctaactct

SEQ ID NO: 27403 - DNA, 15 bp, Homo sapiens
aaagtcagctaactc

SEQ ID NO: 27404 - DNA, 15 bp, Homo sapiens
taaagtcagctaact

SEQ ID NO: 27405 - DNA, 15 bp, Homo sapiens
gtaaagtcagctaac

SEQ ID NO: 27406 - DNA, 15 bp, Homo sapiens
tgtaaagtcagctaa

SEQ ID NO: 27407 - DNA, 15 bp, Homo sapiens
gtgtaaagtcagcta

SEQ ID NO: 27408 - DNA, 15 bp, Homo sapiens
cgtgtaaagtcagct

SEQ ID NO: 27409 - DNA, 15 bp, Homo sapiens
ccgtgtaaagtcagc

SEQ ID NO: 27410 - DNA, 15 bp, Homo sapiens
tccgtgtaaagtcag

SEQ ID NO: 27411 - DNA, 15 bp, Homo sapiens
ctccgtgtaaagtca

SEQ ID NO: 27412 - DNA, 15 bp, Homo sapiens
gctccgtgtaaagtc

SEQ ID NO: 27413 - DNA, 15 bp, Homo sapiens
cgctccgtgtaaagt

SEQ ID NO: 27414 - DNA, 15 bp, Homo sapiens
ccgctccgtgtaaag

SEQ ID NO: 27415 - DNA, 15 bp, Homo sapiens
tccgctccgtgtaaa

SEQ ID NO: 27416 - DNA, 15 bp, Homo sapiens
atccgctccgtgtaa

SEQ ID NO: 27417 - DNA, 15 bp, Homo sapiens
aatccgctccgtgta

SEQ ID NO: 27418 - DNA, 15 bp, Homo sapiens
caatccgctccgtgt

SEQ ID NO: 27419 - DNA, 15 bp, Homo sapiens
gcaatccgctccgtg

SEQ ID NO: 27420 - DNA, 15 bp, Homo sapiens
tgcaatccgctccgt

SEQ ID NO: 27421 - DNA, 15 bp, Homo sapiens
ttgcaatccgctccg

SEQ ID NO: 27422 - DNA, 15 bp, Homo sapiens
tttgcaatccgctcc

SEQ ID NO: 27423 - DNA, 15 bp, Homo sapiens
ctttgcaatccgctc

SEQ ID NO: 27424 - DNA, 15 bp, Homo sapiens
gctttgcaatccgct

SEQ ID NO: 27425 - DNA, 15 bp, Homo sapiens
tgctttgcaatccgc

SEQ ID NO: 27426 - DNA, 15 bp, Homo sapiens
ttgctttgcaatccg

SEQ ID NO: 27427 - DNA, 15 bp, Homo sapiens
tttgctttgcaatcc

SEQ ID NO: 27428 - DNA, 15 bp, Homo sapiens
gtttgctttgcaatc

SEQ ID NO: 27429 - DNA, 15 bp, Homo sapiens
ggtttgctttgcaat

SEQ ID NO: 27430 - DNA, 15 bp, Homo sapiens
tggtttgctttgcaa

SEQ ID NO: 27431 - DNA, 15 bp, Homo sapiens
ttggtttgctttgca

SEQ ID NO: 27432 - DNA, 15 bp, Homo sapiens
gttggtttgctttgc

SEQ ID NO: 27433 - DNA, 15 bp, Homo sapiens
tgttggtttgctttg

SEQ ID NO: 27434 - DNA, 15 bp, Homo sapiens
ttgttggtttgcttt

SEQ ID NO: 27435 - DNA, 15 bp, Homo sapiens
cttgttggtttgctt

SEQ ID NO: 27436 - DNA, 15 bp, Homo sapiens
tcttgttggtttgct

SEQ ID NO: 27437 - DNA, 15 bp, Homo sapiens
ttcttgttggtttgc

SEQ ID NO: 27438 - DNA, 15 bp, Homo sapiens
attcttgttggtttg

SEQ ID NO: 27439 - DNA, 15 bp, Homo sapiens
tattcttgttggttt

SEQ ID NO: 27440 - DNA, 15 bp, Homo sapiens
ttattcttgttggtt

SEQ ID NO: 27441 - DNA, 15 bp, Homo sapiens
tttattcttgttggt

SEQ ID NO: 27442 - DNA, 15 bp, Homo sapiens
ctttattcttgttgg

SEQ ID NO: 27443 - DNA, 15 bp, Homo sapiens
cctttattcttgttg

SEQ ID NO: 27444 - DNA, 15 bp, Homo sapiens
gcctttattcttgtt

SEQ ID NO: 27445 - DNA, 15 bp, Homo sapiens
tgcctttattcttgt

SEQ ID NO: 27446 - DNA, 15 bp, Homo sapiens
ctgcctttattcttg

SEQ ID NO: 27447 - DNA, 15 bp, Homo sapiens
gctgcctttattctt

SEQ ID NO: 27448 - DNA, 15 bp, Homo sapiens
agctgcctttattct

SEQ ID NO: 27449 - DNA, 15 bp, Homo sapiens
cagctgcctttattc

SEQ ID NO: 27450 - DNA, 15 bp, Homo sapiens
acagctgcctttatt

SEQ ID NO: 27451 - DNA, 15 bp, Homo sapiens
aacagctgcctttat

SEQ ID NO: 27452 - DNA, 15 bp, Homo sapiens
caacagctgccttta

SEQ ID NO: 27453 - DNA, 15 bp, Homo sapiens
acaacagctgccttt

SEQ ID NO: 27454 - DNA, 15 bp, Homo sapiens
gacaacagctgcctt

SEQ ID NO: 27455 - DNA, 15 bp, Homo sapiens
agacaacagctgcct

SEQ ID NO: 27456 - DNA, 15 bp, Homo sapiens
gagacaacagctgcc

SEQ ID NO: 27457 - DNA, 15 bp, Homo sapiens
agagacaacagctgc

SEQ ID NO: 27458 - DNA, 15 bp, Homo sapiens
aagagacaacagctg

SEQ ID NO: 27459 - DNA, 15 bp, Homo sapiens
gaagagacaacagct

SEQ ID NO: 27460 - DNA, 15 bp, Homo sapiens
agaagagacaacagc

SEQ ID NO: 27461 - DNA, 15 bp, Homo sapiens
gagaagagacaacag

SEQ ID NO: 27462 - DNA, 15 bp, Homo sapiens
ggagaagagacaaca

SEQ ID NO: 27463 - DNA, 15 bp, Homo sapiens
aggagaagagacaac

SEQ ID NO: 27464 - DNA, 15 bp, Homo sapiens
aaggagaagagacaa

SEQ ID NO: 27465 - DNA, 15 bp, Homo sapiens
taaggagaagagaca

SEQ ID NO: 27466 - DNA, 15 bp, Homo sapiens
ataaggagaagagac

SEQ ID NO: 27467 - DNA, 15 bp, Homo sapiens
cataaggagaagaga

SEQ ID NO: 27468 - DNA, 15 bp, Homo sapiens
ccataaggagaagag

SEQ ID NO: 27469 - DNA, 15 bp, Homo sapiens
cccataaggagaaga

SEQ ID NO: 27470 - DNA, 15 bp, Homo sapiens
acccataaggagaag

SEQ ID NO: 27471 - DNA, 15 bp, Homo sapiens
tacccataaggagaa

SEQ ID NO: 27472 - DNA, 15 bp, Homo sapiens
ctacccataaggaga

SEQ ID NO: 27473 - DNA, 15 bp, Homo sapiens
cctacccataaggag

SEQ ID NO: 27474 - DNA, 15 bp, Homo sapiens
ccctacccataagga

SEQ ID NO: 27475 - DNA, 15 bp, Homo sapiens
gccctacccataagg

SEQ ID NO: 27476 - DNA, 15 bp, Homo sapiens
agccctacccataag

SEQ ID NO: 27477 - DNA, 15 bp, Homo sapiens
gagccctacccataa

SEQ ID NO: 27478 - DNA, 15 bp, Homo sapiens
agagccctacccata

SEQ ID NO: 27479 - DNA, 15 bp, Homo sapiens
cagagccctacccat

SEQ ID NO: 27480 - DNA, 15 bp, Homo sapiens
tcagagccctaccca

SEQ ID NO: 27481 - DNA, 15 bp, Homo sapiens
gtcagagccctaccc

SEQ ID NO: 27482 - DNA, 15 bp, Homo sapiens
tgtcagagccctacc

SEQ ID NO: 27483 - DNA, 15 bp, Homo sapiens
ttgtcagagccctac

SEQ ID NO: 27484 - DNA, 15 bp, Homo sapiens
tttgtcagagcccta

SEQ ID NO: 27485 - DNA, 15 bp, Homo sapiens
ctttgtcagagccct

SEQ ID NO: 27486 - DNA, 15 bp, Homo sapiens
gctttgtcagagccc

SEQ ID NO: 27487 - DNA, 15 bp, Homo sapiens
agctttgtcagagcc

SEQ ID NO: 27488 - DNA, 15 bp, Homo sapiens
aagctttgtcagagc

SEQ ID NO: 27489 - DNA, 15 bp, Homo sapiens
gaagctttgtcagag

SEQ ID NO: 27490 - DNA, 15 bp, Homo sapiens
ggaagctttgtcaga

SEQ ID NO: 27491 - DNA, 15 bp, Homo sapiens
gggaagctttgtcag

SEQ ID NO: 27492 - DNA, 15 bp, Homo sapiens
cgggaagctttgtca

SEQ ID NO: 27493 - DNA, 15 bp, Homo sapiens
tcgggaagctttgtc

SEQ ID NO: 27494 - DNA, 15 bp, Homo sapiens
atcgggaagctttgt

SEQ ID NO: 27495 - DNA, 15 bp, Homo sapiens
aatcgggaagctttg

SEQ ID NO: 27496 - DNA, 15 bp, Homo sapiens
taatcgggaagcttt

SEQ ID NO: 27497 - DNA, 15 bp, Homo sapiens
ttaatcgggaagctt

SEQ ID NO: 27498 - DNA, 15 bp, Homo sapiens
gttaatcgggaagct

SEQ ID NO: 27499 - DNA, 15 bp, Homo sapiens
agttaatcgggaagc

SEQ ID NO: 27500 - DNA, 15 bp, Homo sapiens
cagttaatcgggaag

SEQ ID NO: 27501 - DNA, 15 bp, Homo sapiens
tcagttaatcgggaa

SEQ ID NO: 27502 - DNA, 15 bp, Homo sapiens
ttcagttaatcggga

SEQ ID NO: 27503 - DNA, 15 bp, Homo sapiens
tttcagttaatcggg

SEQ ID NO: 27504 - DNA, 15 bp, Homo sapiens
atttcagttaatcgg

SEQ ID NO: 27505 - DNA, 15 bp, Homo sapiens
tatttcagttaatcg

SEQ ID NO: 27506 - DNA, 15 bp, Homo sapiens
ttatttcagttaatc

SEQ ID NO: 27507 - DNA, 15 bp, Homo sapiens
tttatttcagttaat

SEQ ID NO: 27508 - DNA, 15 bp, Homo sapiens
ttttatttcagttaa

SEQ ID NO: 27509 - DNA, 15 bp, Homo sapiens
tttttatttcagtta

SEQ ID NO: 27510 - DNA, 15 bp, Homo sapiens
ttttttatttcagtt

SEQ ID NO: 27511 - DNA, 15 bp, Homo sapiens
attttttatttcagt

SEQ ID NO: 27512 - DNA, 15 bp, Homo sapiens
tattttttatttcag

SEQ ID NO: 27513 - DNA, 15 bp, Homo sapiens
atattttttatttca

SEQ ID NO: 27514 - DNA, 15 bp, Homo sapiens
aatattttttatttc

SEQ ID NO: 27515 - DNA, 15 bp, Homo sapiens
aaatattttttattt

SEQ ID NO: 27516 - DNA, 15 bp, Homo sapiens
aaaatattttttatt

SEQ ID NO: 27517 - DNA, 15 bp, Homo sapiens
aaaaatattttttat

SEQ ID NO: 27518 - DNA, 15 bp, Homo sapiens
aaaaaatatttttta

SEQ ID NO: 27519 - DNA, 15 bp, Homo sapiens
aaaaaaatatttttt

SEQ ID NO: 27520 - DNA, 15 bp, Homo sapiens
aaaaaaaatattttt

SEQ ID NO: 27521 - DNA, 15 bp, Homo sapiens
aaaaaaaaatatttt

SEQ ID NO: 27522 - DNA, 15 bp, Homo sapiens
gaaaaaaaaatattt

SEQ ID NO: 27523 - DNA, 15 bp, Homo sapiens
agaaaaaaaaatatt

SEQ ID NO: 27524 - DNA, 15 bp, Homo sapiens
aagaaaaaaaaatat

SEQ ID NO: 27525 - DNA, 15 bp, Homo sapiens
aaagaaaaaaaaata

SEQ ID NO: 27526 - DNA, 15 bp, Homo sapiens
gaaagaaaaaaaaat

SEQ ID NO: 27527 - DNA, 15 bp, Homo sapiens
tgaaagaaaaaaaaa

SEQ ID NO: 27528 - DNA, 15 bp, Homo sapiens
ctgaaagaaaaaaaa

SEQ ID NO: 27529 - DNA, 15 bp, Homo sapiens
actgaaagaaaaaaa

SEQ ID NO: 27530 - DNA, 15 bp, Homo sapiens
tactgaaagaaaaaa

SEQ ID NO: 27531 - DNA, 15 bp, Homo sapiens
ttactgaaagaaaaa

SEQ ID NO: 27532 - DNA, 15 bp, Homo sapiens
tttactgaaagaaaa

SEQ ID NO: 27533 - DNA, 15 bp, Homo sapiens
gtttactgaaagaaa

SEQ ID NO: 27534 - DNA, 15 bp, Homo sapiens
agtttactgaaagaa

SEQ ID NO: 27535 - DNA, 15 bp, Homo sapiens
aagtttactgaaaga

SEQ ID NO: 27536 - DNA, 15 bp, Homo sapiens
taagtttactgaaag

SEQ ID NO: 27537 - DNA, 15 bp, Homo sapiens
ctaagtttactgaaa

SEQ ID NO: 27538 - DNA, 15 bp, Homo sapiens
tctaagtttactgaa

SEQ ID NO: 27539 - DNA, 15 bp, Homo sapiens
ctctaagtttactga

SEQ ID NO: 27540 - DNA, 15 bp, Homo sapiens
actctaagtttactg

SEQ ID NO: 27541 - DNA, 15 bp, Homo sapiens
aactctaagtttact

SEQ ID NO: 27542 - DNA, 15 bp, Homo sapiens
aaactctaagtttac

SEQ ID NO: 27543 - DNA, 15 bp, Homo sapiens
gaaactctaagttta

SEQ ID NO: 27544 - DNA, 15 bp, Homo sapiens
cgaaactctaagttt

SEQ ID NO: 27545 - DNA, 15 bp, Homo sapiens
acgaaactctaagtt

SEQ ID NO: 27546 - DNA, 15 bp, Homo sapiens
cacgaaactctaagt

SEQ ID NO: 27547 - DNA, 15 bp, Homo sapiens
ccacgaaactctaag

SEQ ID NO: 27548 - DNA, 15 bp, Homo sapiens
gccacgaaactctaa

SEQ ID NO: 27549 - DNA, 15 bp, Homo sapiens
agccacgaaactcta

SEQ ID NO: 27550 - DNA, 15 bp, Homo sapiens
aagccacgaaactct

SEQ ID NO: 27551 - DNA, 15 bp, Homo sapiens
gaagccacgaaactc

SEQ ID NO: 27552 - DNA, 15 bp, Homo sapiens
tgaagccacgaaact

SEQ ID NO: 27553 - DNA, 15 bp, Homo sapiens
ctgaagccacgaaac

SEQ ID NO: 27554 - DNA, 15 bp, Homo sapiens
cctgaagccacgaaa

SEQ ID NO: 27555 - DNA, 15 bp, Homo sapiens
ccctgaagccacgaa

SEQ ID NO: 27556 - DNA, 15 bp, Homo sapiens
accctgaagccacga

SEQ ID NO: 27557 - DNA, 15 bp, Homo sapiens
caccctgaagccacg

SEQ ID NO: 27558 - DNA, 15 bp, Homo sapiens
ccaccctgaagccac

SEQ ID NO: 27559 - DNA, 15 bp, Homo sapiens
cccaccctgaagcca

SEQ ID NO: 27560 - DNA, 15 bp, Homo sapiens
tcccaccctgaagcc

SEQ ID NO: 27561 - DNA, 15 bp, Homo sapiens
ctcccaccctgaagc

SEQ ID NO: 27562 - DNA, 15 bp, Homo sapiens
actcccaccctgaag

SEQ ID NO: 27563 - DNA, 15 bp, Homo sapiens
tactcccaccctgaa

SEQ ID NO: 27564 - DNA, 15 bp, Homo sapiens
ctactcccaccctga

SEQ ID NO: 27565 - DNA, 15 bp, Homo sapiens
actactcccaccctg

SEQ ID NO: 27566 - DNA, 15 bp, Homo sapiens
aactactcccaccct

SEQ ID NO: 27567 - DNA, 15 bp, Homo sapiens
caactactcccaccc

SEQ ID NO: 27568 - DNA, 15 bp, Homo sapiens
ccaactactcccacc

SEQ ID NO: 27569 - DNA, 15 bp, Homo sapiens
tccaactactcccac

SEQ ID NO: 27570 - DNA, 15 bp, Homo sapiens
ctccaactactccca

SEQ ID NO: 27571 - DNA, 15 bp, Homo sapiens
gctccaactactccc

SEQ ID NO: 27572 - DNA, 15 bp, Homo sapiens
tgctccaactactcc

SEQ ID NO: 27573 - DNA, 15 bp, Homo sapiens
atgctccaactactc

SEQ ID NO: 27574 - DNA, 15 bp, Homo sapiens
aatgctccaactact

SEQ ID NO: 27575 - DNA, 15 bp, Homo sapiens
caatgctccaactac

SEQ ID NO: 27576 - DNA, 15 bp, Homo sapiens
ccaatgctccaacta

SEQ ID NO: 27577 - DNA, 15 bp, Homo sapiens
cccaatgctccaact

SEQ ID NO: 27578 - DNA, 15 bp, Homo sapiens
ccccaatgctccaac

SEQ ID NO: 27579 - DNA, 15 bp, Homo sapiens
tccccaatgctccaa

SEQ ID NO: 27580 - DNA, 15 bp, Homo sapiens
atccccaatgctcca

SEQ ID NO: 27581 - DNA, 15 bp, Homo sapiens
catccccaatgctcc

SEQ ID NO: 27582 - DNA, 15 bp, Homo sapiens
acatccccaatgctc

SEQ ID NO: 27583 - DNA, 15 bp, Homo sapiens
aacatccccaatgct

SEQ ID NO: 27584 - DNA, 15 bp, Homo sapiens
aaacatccccaatgc

SEQ ID NO: 27585 - DNA, 15 bp, Homo sapiens
aaaacatccccaatg

SEQ ID NO: 27586 - DNA, 15 bp, Homo sapiens
aaaaacatccccaat

SEQ ID NO: 27587 - DNA, 15 bp, Homo sapiens
gaaaaacatccccaa

SEQ ID NO: 27588 - DNA, 15 bp, Homo sapiens
agaaaaacatcccca

SEQ ID NO: 27589 - DNA, 15 bp, Homo sapiens
aagaaaaacatcccc

SEQ ID NO: 27590 - DNA, 15 bp, Homo sapiens
taagaaaaacatccc

SEQ ID NO: 27591 - DNA, 15 bp, Homo sapiens
gtaagaaaaacatcc

SEQ ID NO: 27592 - DNA, 15 bp, Homo sapiens
ggtaagaaaaacatc

SEQ ID NO: 27593 - DNA, 15 bp, Homo sapiens
cggtaagaaaaacat

SEQ ID NO: 27594 - DNA, 15 bp, Homo sapiens
tcggtaagaaaaaca

SEQ ID NO: 27595 - DNA, 15 bp, Homo sapiens
gtcggtaagaaaaac

SEQ ID NO: 27596 - DNA, 15 bp, Homo sapiens
tgtcggtaagaaaaa

SEQ ID NO: 27597 - DNA, 15 bp, Homo sapiens
ttgtcggtaagaaaa

SEQ ID NO: 27598 - DNA, 15 bp, Homo sapiens
cttgtcggtaagaaa

SEQ ID NO: 27599 - DNA, 15 bp, Homo sapiens
gcttgtcggtaagaa

SEQ ID NO: 27600 - DNA, 15 bp, Homo sapiens
tgcttgtcggtaaga

SEQ ID NO: 27601 - DNA, 15 bp, Homo sapiens
gtgcttgtcggtaag

SEQ ID NO: 27602 - DNA, 15 bp, Homo sapiens
tgtgcttgtcggtaa

SEQ ID NO: 27603 - DNA, 15 bp, Homo sapiens
ctgtgcttgtcggta

SEQ ID NO: 27604 - DNA, 15 bp, Homo sapiens
actgtgcttgtcggt

SEQ ID NO: 27605 - DNA, 15 bp, Homo sapiens
gactgtgcttgtcgg

SEQ ID NO: 27606 - DNA, 15 bp, Homo sapiens
tgactgtgcttgtcg

SEQ ID NO: 27607 - DNA, 15 bp, Homo sapiens
ctgactgtgcttgtc

SEQ ID NO: 27608 - DNA, 15 bp, Homo sapiens
cctgactgtgcttgt

SEQ ID NO: 27609 - DNA, 15 bp, Homo sapiens
acctgactgtgcttg

SEQ ID NO: 27610 - DNA, 15 bp, Homo sapiens
aacctgactgtgctt

SEQ ID NO: 27611 - DNA, 15 bp, Homo sapiens
caacctgactgtgct

SEQ ID NO: 27612 - DNA, 15 bp, Homo sapiens
tcaacctgactgtgc

SEQ ID NO: 27613 - DNA, 15 bp, Homo sapiens
ttcaacctgactgtg

SEQ ID NO: 27614 - DNA, 15 bp, Homo sapiens
cttcaacctgactgt

SEQ ID NO: 27615 - DNA, 15 bp, Homo sapiens
tcttcaacctgactg

SEQ ID NO: 27616 - DNA, 15 bp, Homo sapiens
gtcttcaacctgact

SEQ ID NO: 27617 - DNA, 15 bp, Homo sapiens
ggtcttcaacctgac

SEQ ID NO: 27618 - DNA, 15 bp, Homo sapiens
aggtcttcaacctga

SEQ ID NO: 27619 - DNA, 15 bp, Homo sapiens
taggtcttcaacctg

SEQ ID NO: 27620 - DNA, 15 bp, Homo sapiens
ttaggtcttcaacct

SEQ ID NO: 27621 - DNA, 15 bp, Homo sapiens
gttaggtcttcaacc

SEQ ID NO: 27622 - DNA, 15 bp, Homo sapiens
ggttaggtcttcaac

SEQ ID NO: 27623 - DNA, 15 bp, Homo sapiens
tggttaggtcttcaa

SEQ ID NO: 27624 - DNA, 15 bp, Homo sapiens
ctggttaggtcttca

SEQ ID NO: 27625 - DNA, 15 bp, Homo sapiens
cctggttaggtcttc

SEQ ID NO: 27626 - DNA, 15 bp, Homo sapiens
ccctggttaggtctt

SEQ ID NO: 27627 - DNA, 15 bp, Homo sapiens
gccctggttaggtct

SEQ ID NO: 27628 - DNA, 15 bp, Homo sapiens
ggccctggttaggtc

SEQ ID NO: 27629 - DNA, 15 bp, Homo sapiens
tggccctggttaggt

SEQ ID NO: 27630 - DNA, 15 bp, Homo sapiens
ctggccctggttagg

SEQ ID NO: 27631 - DNA, 15 bp, Homo sapiens
tctggccctggttag

SEQ ID NO: 27632 - DNA, 15 bp, Homo sapiens
ttctggccctggtta

SEQ ID NO: 27633 - DNA, 15 bp, Homo sapiens
cttctggccctggtt

SEQ ID NO: 27634 - DNA, 15 bp, Homo sapiens
acttctggccctggt

SEQ ID NO: 27635 - DNA, 15 bp, Homo sapiens
tacttctggccctgg

SEQ ID NO: 27636 - DNA, 15 bp, Homo sapiens
ctacttctggccctg

SEQ ID NO: 27637 - DNA, 15 bp, Homo sapiens
gctacttctggccct

SEQ ID NO: 27638 - DNA, 15 bp, Homo sapiens
agctacttctggccc

SEQ ID NO: 27639 - DNA, 15 bp, Homo sapiens
aagctacttctggcc

SEQ ID NO: 27640 - DNA, 15 bp, Homo sapiens
aaagctacttctggc

SEQ ID NO: 27641 - DNA, 15 bp, Homo sapiens
caaagctacttctgg

SEQ ID NO: 27642 - DNA, 15 bp, Homo sapiens
gcaaagctacttctg

SEQ ID NO: 27643 - DNA, 15 bp, Homo sapiens
tgcaaagctacttct

SEQ ID NO: 27644 - DNA, 15 bp, Homo sapiens
gtgcaaagctacttc

SEQ ID NO: 27645 - DNA, 15 bp, Homo sapiens
agtgcaaagctactt

SEQ ID NO: 27646 - DNA, 15 bp, Homo sapiens
aagtgcaaagctact

SEQ ID NO: 27647 - DNA, 15 bp, Homo sapiens
aaagtgcaaagctac

SEQ ID NO: 27648 - DNA, 15 bp, Homo sapiens
aaaagtgcaaagcta

SEQ ID NO: 27649 - DNA, 15 bp, Homo sapiens
gaaaagtgcaaagct

SEQ ID NO: 27650 - DNA, 15 bp, Homo sapiens
agaaaagtgcaaagc

SEQ ID NO: 27651 - DNA, 15 bp, Homo sapiens
tagaaaagtgcaaag

SEQ ID NO: 27652 - DNA, 15 bp, Homo sapiens
ttagaaaagtgcaaa

SEQ ID NO: 27653 - DNA, 15 bp, Homo sapiens
tttagaaaagtgcaa

SEQ ID NO: 27654 - DNA, 15 bp, Homo sapiens
gtttagaaaagtgca

SEQ ID NO: 27655 - DNA, 15 bp, Homo sapiens
agtttagaaaagtgc

SEQ ID NO: 27656 - DNA, 15 bp, Homo sapiens
tagtttagaaaagtg

SEQ ID NO: 27657 - DNA, 15 bp, Homo sapiens
ctagtttagaaaagt

SEQ ID NO: 27658 - DNA, 15 bp, Homo sapiens
cctagtttagaaaag

SEQ ID NO: 27659 - DNA, 15 bp, Homo sapiens
gcctagtttagaaaa

SEQ ID NO: 27660 - DNA, 15 bp, Homo sapiens
agcctagtttagaaa

SEQ ID NO: 27661 - DNA, 15 bp, Homo sapiens
gagcctagtttagaa

SEQ ID NO: 27662 - DNA, 15 bp, Homo sapiens
ggagcctagtttaga

SEQ ID NO: 27663 - DNA, 15 bp, Homo sapiens
aggagcctagtttag

SEQ ID NO: 27664 - DNA, 15 bp, Homo sapiens
aaggagcctagttta

SEQ ID NO: 27665 - DNA, 15 bp, Homo sapiens
gaaggagcctagttt

SEQ ID NO: 27666 - DNA, 15 bp, Homo sapiens
tgaaggagcctagtt

SEQ ID NO: 27667 - DNA, 15 bp, Homo sapiens
ttgaaggagcctagt

SEQ ID NO: 27668 - DNA, 15 bp, Homo sapiens
gttgaaggagcctag

SEQ ID NO: 27669 - DNA, 15 bp, Homo sapiens
tgttgaaggagccta

SEQ ID NO: 27670 - DNA, 15 bp, Homo sapiens
ttgttgaaggagcct

SEQ ID NO: 27671 - DNA, 15 bp, Homo sapiens
cttgttgaaggagcc

SEQ ID NO: 27672 - DNA, 15 bp, Homo sapiens
ccttgttgaaggagc

SEQ ID NO: 27673 - DNA, 15 bp, Homo sapiens
gccttgttgaaggag

SEQ ID NO: 27674 - DNA, 15 bp, Homo sapiens
agccttgttgaagga

SEQ ID NO: 27675 - DNA, 15 bp, Homo sapiens
aagccttgttgaagg

SEQ ID NO: 27676 - DNA, 15 bp, Homo sapiens
caagccttgttgaag

SEQ ID NO: 27677 - DNA, 15 bp, Homo sapiens
gcaagccttgttgaa

SEQ ID NO: 27678 - DNA, 15 bp, Homo sapiens
agcaagccttgttga

SEQ ID NO: 27679 - DNA, 15 bp, Homo sapiens
cagcaagccttgttg

SEQ ID NO: 27680 - DNA, 15 bp, Homo sapiens
gcagcaagccttgtt

SEQ ID NO: 27681 - DNA, 15 bp, Homo sapiens
tgcagcaagccttgt

SEQ ID NO: 27682 - DNA, 15 bp, Homo sapiens
ctgcagcaagccttg

SEQ ID NO: 27683 - DNA, 15 bp, Homo sapiens
tctgcagcaagcctt

SEQ ID NO: 27684 - DNA, 15 bp, Homo sapiens
atctgcagcaagcct

SEQ ID NO: 27685 - DNA, 15 bp, Homo sapiens
tatctgcagcaagcc

SEQ ID NO: 27686 - DNA, 15 bp, Homo sapiens
gtatctgcagcaagc

SEQ ID NO: 27687 - DNA, 15 bp, Homo sapiens
agtatctgcagcaag

SEQ ID NO: 27688 - DNA, 15 bp, Homo sapiens
tagtatctgcagcaa

SEQ ID NO: 27689 - DNA, 15 bp, Homo sapiens
gtagtatctgcagca

SEQ ID NO: 27690 - DNA, 15 bp, Homo sapiens
agtagtatctgcagc

SEQ ID NO: 27691 - DNA, 15 bp, Homo sapiens
cagtagtatctgcag

SEQ ID NO: 27692 - DNA, 15 bp, Homo sapiens
tcagtagtatctgca

SEQ ID NO: 27693 - DNA, 15 bp, Homo sapiens
gtcagtagtatctgc

SEQ ID NO: 27694 - DNA, 15 bp, Homo sapiens
ggtcagtagtatctg

SEQ ID NO: 27695 - DNA, 15 bp, Homo sapiens
tggtcagtagtatct

SEQ ID NO: 27696 - DNA, 15 bp, Homo sapiens
ctggtcagtagtatc

SEQ ID NO: 27697 - DNA, 15 bp, Homo sapiens
tctggtcagtagtat

SEQ ID NO: 27698 - DNA, 15 bp, Homo sapiens
gtctggtcagtagta

SEQ ID NO: 27699 - DNA, 15 bp, Homo sapiens
tgtctggtcagtagt

SEQ ID NO: 27700 - DNA, 15 bp, Homo sapiens
ttgtctggtcagtag

SEQ ID NO: 27701 - DNA, 15 bp, Homo sapiens
cttgtctggtcagta

SEQ ID NO: 27702 - DNA, 15 bp, Homo sapiens
gcttgtctggtcagt

SEQ ID NO: 27703 - DNA, 15 bp, Homo sapiens
agcttgtctggtcag

SEQ ID NO: 27704 - DNA, 15 bp, Homo sapiens
cagcttgtctggtca

SEQ ID NO: 27705 - DNA, 15 bp, Homo sapiens
acagcttgtctggtc

SEQ ID NO: 27706 - DNA, 15 bp, Homo sapiens
aacagcttgtctggt

SEQ ID NO: 27707 - DNA, 15 bp, Homo sapiens
caacagcttgtctgg

SEQ ID NO: 27708 - DNA, 15 bp, Homo sapiens
tcaacagcttgtctg

SEQ ID NO: 27709 - DNA, 15 bp, Homo sapiens
gtcaacagcttgtct

SEQ ID NO: 27710 - DNA, 15 bp, Homo sapiens
ggtcaacagcttgtc

SEQ ID NO: 27711 - DNA, 15 bp, Homo sapiens
tggtcaacagcttgt

SEQ ID NO: 27712 - DNA, 15 bp, Homo sapiens
ctggtcaacagcttg

SEQ ID NO: 27713 - DNA, 15 bp, Homo sapiens
cctggtcaacagctt

SEQ ID NO: 27714 - DNA, 15 bp, Homo sapiens
gcctggtcaacagct

SEQ ID NO: 27715 - DNA, 15 bp, Homo sapiens
tgcctggtcaacagc

SEQ ID NO: 27716 - DNA, 15 bp, Homo sapiens
gtgcctggtcaacag

SEQ ID NO: 27717 - DNA, 15 bp, Homo sapiens
ggtgcctggtcaaca

SEQ ID NO: 27718 - DNA, 15 bp, Homo sapiens
aggtgcctggtcaac

SEQ ID NO: 27719 - DNA, 15 bp, Homo sapiens
gaggtgcctggtcaa

SEQ ID NO: 27720 - DNA, 15 bp, Homo sapiens
ggaggtgcctggtca

SEQ ID NO: 27721 - DNA, 15 bp, Homo sapiens
gggaggtgcctggtc

SEQ ID NO: 27722 - DNA, 15 bp, Homo sapiens
ggggaggtgcctggt

SEQ ID NO: 27723 - DNA, 15 bp, Homo sapiens
aggggaggtgcctgg

SEQ ID NO: 27724 - DNA, 15 bp, Homo sapiens
gaggggaggtgcctg

SEQ ID NO: 27725 - DNA, 15 bp, Homo sapiens
ggaggggaggtgcct

SEQ ID NO: 27726 - DNA, 15 bp, Homo sapiens
gggaggggaggtgcc

SEQ ID NO: 27727 - DNA, 15 bp, Homo sapiens
cgggaggggaggtgc

SEQ ID NO: 27728 - DNA, 15 bp, Homo sapiens
gcgggaggggaggtg

SEQ ID NO: 27729 - DNA, 15 bp, Homo sapiens
ggcgggaggggaggt

SEQ ID NO: 27730 - DNA, 15 bp, Homo sapiens
gggcgggaggggagg

SEQ ID NO: 27731 - DNA, 15 bp, Homo sapiens
tgggcgggaggggag

SEQ ID NO: 27732 - DNA, 15 bp, Homo sapiens
ttgggcgggagggga

SEQ ID NO: 27733 - DNA, 15 bp, Homo sapiens
tttgggcgggagggg

SEQ ID NO: 27734 - DNA, 15 bp, Homo sapiens
gtttgggcgggaggg

SEQ ID NO: 27735 - DNA, 15 bp, Homo sapiens
ggtttgggcgggagg

SEQ ID NO: 27736 - DNA, 15 bp, Homo sapiens
aggtttgggcgggag

SEQ ID NO: 27737 - DNA, 15 bp, Homo sapiens
aaggtttgggcggga

SEQ ID NO: 27738 - DNA, 15 bp, Homo sapiens
aaaggtttgggcggg

SEQ ID NO: 27739 - DNA, 15 bp, Homo sapiens
gaaaggtttgggcgg

SEQ ID NO: 27740 - DNA, 15 bp, Homo sapiens
ggaaaggtttgggcg

SEQ ID NO: 27741 - DNA, 15 bp, Homo sapiens
gggaaaggtttgggc

SEQ ID NO: 27742 - DNA, 15 bp, Homo sapiens
ggggaaaggtttggg

SEQ ID NO: 27743 - DNA, 15 bp, Homo sapiens
gggggaaaggtttgg

SEQ ID NO: 27744 - DNA, 15 bp, Homo sapiens
tgggggaaaggtttg

SEQ ID NO: 27745 - DNA, 15 bp, Homo sapiens
atgggggaaaggttt

SEQ ID NO: 27746 - DNA, 15 bp, Homo sapiens
catgggggaaaggtt

SEQ ID NO: 27747 - DNA, 15 bp, Homo sapiens
acatgggggaaaggt

SEQ ID NO: 27748 - DNA, 15 bp, Homo sapiens
cacatgggggaaagg

SEQ ID NO: 27749 - DNA, 15 bp, Homo sapiens
ccacatgggggaaag

SEQ ID NO: 27750 - DNA, 15 bp, Homo sapiens
accacatgggggaaa

SEQ ID NO: 27751 - DNA, 15 bp, Homo sapiens
gaccacatgggggaa

SEQ ID NO: 27752 - DNA, 15 bp, Homo sapiens
cgaccacatggggga

SEQ ID NO: 27753 - DNA, 15 bp, Homo sapiens
acgaccacatggggg

SEQ ID NO: 27754 - DNA, 15 bp, Homo sapiens
aacgaccacatgggg

SEQ ID NO: 27755 - DNA, 15 bp, Homo sapiens
taacgaccacatggg

SEQ ID NO: 27756 - DNA, 15 bp, Homo sapiens
ctaacgaccacatgg

SEQ ID NO: 27757 - DNA, 15 bp, Homo sapiens
tctaacgaccacatg

SEQ ID NO: 27758 - DNA, 15 bp, Homo sapiens
ctctaacgaccacat

SEQ ID NO: 27759 - DNA, 15 bp, Homo sapiens
tctctaacgaccaca

SEQ ID NO: 27760 - DNA, 15 bp, Homo sapiens
gtctctaacgaccac

SEQ ID NO: 27761 - DNA, 15 bp, Homo sapiens
tgtctctaacgacca

SEQ ID NO: 27762 - DNA, 15 bp, Homo sapiens
ctgtctctaacgacc

SEQ ID NO: 27763 - DNA, 15 bp, Homo sapiens
tctgtctctaacgac

SEQ ID NO: 27764 - DNA, 15 bp, Homo sapiens
ctctgtctctaacga

SEQ ID NO: 27765 - DNA, 15 bp, Homo sapiens
gctctgtctctaacg

SEQ ID NO: 27766 - DNA, 15 bp, Homo sapiens
cgctctgtctctaac

SEQ ID NO: 27767 - DNA, 15 bp, Homo sapiens
tcgctctgtctctaa

SEQ ID NO: 27768 - DNA, 15 bp, Homo sapiens
gtcgctctgtctcta

SEQ ID NO: 27769 - DNA, 15 bp, Homo sapiens
tgtcgctctgtctct

SEQ ID NO: 27770 - DNA, 15 bp, Homo sapiens
ctgtcgctctgtctc

SEQ ID NO: 27771 - DNA, 15 bp, Homo sapiens
tctgtcgctctgtct

SEQ ID NO: 27772 - DNA, 15 bp, Homo sapiens
ctctgtcgctctgtc

SEQ ID NO: 27773 - DNA, 15 bp, Homo sapiens
gctctgtcgctctgt

SEQ ID NO: 27774 - DNA, 15 bp, Homo sapiens
tgctctgtcgctctg

SEQ ID NO: 27775 - DNA, 15 bp, Homo sapiens
ctgctctgtcgctct

SEQ ID NO: 27776 - DNA, 15 bp, Homo sapiens
actgctctgtcgctc

SEQ ID NO: 27777 - DNA, 15 bp, Homo sapiens
aactgctctgtcgct

SEQ ID NO: 27778 - DNA, 15 bp, Homo sapiens
caactgctctgtcgc

SEQ ID NO: 27779 - DNA, 15 bp, Homo sapiens
tcaactgctctgtcg

SEQ ID NO: 27780 - DNA, 15 bp, Homo sapiens
ctcaactgctctgtc

SEQ ID NO: 27781 - DNA, 15 bp, Homo sapiens
tctcaactgctctgt

SEQ ID NO: 27782 - DNA, 15 bp, Homo sapiens
ctctcaactgctctg

SEQ ID NO: 27783 - DNA, 15 bp, Homo sapiens
cctctcaactgctct

SEQ ID NO: 27784 - DNA, 15 bp, Homo sapiens
tcctctcaactgctc

SEQ ID NO: 27785 - DNA, 15 bp, Homo sapiens
gtcctctcaactgct

SEQ ID NO: 27786 - DNA, 15 bp, Homo sapiens
tgtcctctcaactgc

SEQ ID NO: 27787 - DNA, 15 bp, Homo sapiens
gtgtcctctcaactg

SEQ ID NO: 27788 - DNA, 15 bp, Homo sapiens
agtgtcctctcaact

SEQ ID NO: 27789 - DNA, 15 bp, Homo sapiens
gagtgtcctctcaac

SEQ ID NO: 27790 - DNA, 15 bp, Homo sapiens
ggagtgtcctctcaa

SEQ ID NO: 27791 - DNA, 15 bp, Homo sapiens
gggagtgtcctctca

SEQ ID NO: 27792 - DNA, 15 bp, Homo sapiens
cgggagtgtcctctc

SEQ ID NO: 27793 - DNA, 15 bp, Homo sapiens
acgggagtgtcctct

SEQ ID NO: 27794 - DNA, 15 bp, Homo sapiens
aacgggagtgtcctc

SEQ ID NO: 27795 - DNA, 15 bp, Homo sapiens
aaacgggagtgtcct

SEQ ID NO: 27796 - DNA, 15 bp, Homo sapiens
aaaacgggagtgtcc

SEQ ID NO: 27797 - DNA, 15 bp, Homo sapiens
gaaaacgggagtgtc

SEQ ID NO: 27798 - DNA, 15 bp, Homo sapiens
cgaaaacgggagtgt

SEQ ID NO: 27799 - DNA, 15 bp, Homo sapiens
ccgaaaacgggagtg

SEQ ID NO: 27800 - DNA, 15 bp, Homo sapiens
accgaaaacgggagt

SEQ ID NO: 27801 - DNA, 15 bp, Homo sapiens
caccgaaaacgggag

SEQ ID NO: 27802 - DNA, 15 bp, Homo sapiens
gcaccgaaaacggga

SEQ ID NO: 27803 - DNA, 15 bp, Homo sapiens
ggcaccgaaaacggg

SEQ ID NO: 27804 - DNA, 15 bp, Homo sapiens
tggcaccgaaaacgg

SEQ ID NO: 27805 - DNA, 15 bp, Homo sapiens
atggcaccgaaaacg

SEQ ID NO: 27806 - DNA, 15 bp, Homo sapiens
gatggcaccgaaaac

SEQ ID NO: 27807 - DNA, 15 bp, Homo sapiens
tgatggcaccgaaaa

SEQ ID NO: 27808 - DNA, 15 bp, Homo sapiens
ctgatggcaccgaaa

SEQ ID NO: 27809 - DNA, 15 bp, Homo sapiens
actgatggcaccgaa

SEQ ID NO: 27810 - DNA, 15 bp, Homo sapiens
cactgatggcaccga

SEQ ID NO: 27811 - DNA, 15 bp, Homo sapiens
gcactgatggcaccg

SEQ ID NO: 27812 - DNA, 15 bp, Homo sapiens
ggcactgatggcacc

SEQ ID NO: 27813 - DNA, 15 bp, Homo sapiens
gggcactgatggcac

SEQ ID NO: 27814 - DNA, 15 bp, Homo sapiens
ggggcactgatggca

SEQ ID NO: 27815 - DNA, 15 bp, Homo sapiens
cggggcactgatggc

SEQ ID NO: 27816 - DNA, 15 bp, Homo sapiens
acggggcactgatgg

SEQ ID NO: 27817 - DNA, 15 bp, Homo sapiens
gacggggcactgatg

SEQ ID NO: 27818 - DNA, 15 bp, Homo sapiens
agacggggcactgat

SEQ ID NO: 27819 - DNA, 15 bp, Homo sapiens
tagacggggcactga

SEQ ID NO: 27820 - DNA, 15 bp, Homo sapiens
gtagacggggcactg

SEQ ID NO: 27821 - DNA, 15 bp, Homo sapiens
tgtagacggggcact

SEQ ID NO: 27822 - DNA, 15 bp, Homo sapiens
ctgtagacggggcac

SEQ ID NO: 27823 - DNA, 15 bp, Homo sapiens
gctgtagacggggca

SEQ ID NO: 27824 - DNA, 15 bp, Homo sapiens
agctgtagacggggc

SEQ ID NO: 27825 - DNA, 15 bp, Homo sapiens
gagctgtagacgggg

SEQ ID NO: 27826 - DNA, 15 bp, Homo sapiens
ggagctgtagacggg

SEQ ID NO: 27827 - DNA, 15 bp, Homo sapiens
gggagctgtagacgg

SEQ ID NO: 27828 - DNA, 15 bp, Homo sapiens
ggggagctgtagacg

SEQ ID NO: 27829 - DNA, 15 bp, Homo sapiens
gggggagctgtagac

SEQ ID NO: 27830 - DNA, 15 bp, Homo sapiens
tgggggagctgtaga

SEQ ID NO: 27831 - DNA, 15 bp, Homo sapiens
ctgggggagctgtag

SEQ ID NO: 27832 - DNA, 15 bp, Homo sapiens
gctgggggagctgta

SEQ ID NO: 27833 - DNA, 15 bp, Homo sapiens
agctgggggagctgt

SEQ ID NO: 27834 - DNA, 15 bp, Homo sapiens
gagctgggggagctg

SEQ ID NO: 27835 - DNA, 15 bp, Homo sapiens
ggagctgggggagct

SEQ ID NO: 27836 - DNA, 15 bp, Homo sapiens
gggagctgggggagc

SEQ ID NO: 27837 - DNA, 15 bp, Homo sapiens
ggggagctgggggag

SEQ ID NO: 27838 - DNA, 15 bp, Homo sapiens
gggggagctggggga

SEQ ID NO: 27839 - DNA, 15 bp, Homo sapiens
ggggggagctggggg

SEQ ID NO: 27840 - DNA, 15 bp, Homo sapiens
tggggggagctgggg

SEQ ID NO: 27841 - DNA, 15 bp, Homo sapiens
gtggggggagctggg

SEQ ID NO: 27842 - DNA, 15 bp, Homo sapiens
ggtggggggagctgg

SEQ ID NO: 27843 - DNA, 15 bp, Homo sapiens
aggtggggggagctg

SEQ ID NO: 27844 - DNA, 15 bp, Homo sapiens
gaggtggggggagct

SEQ ID NO: 27845 - DNA, 15 bp, Homo sapiens
ggaggtggggggagc

SEQ ID NO: 27846 - DNA, 15 bp, Homo sapiens
gggaggtggggggag

SEQ ID NO: 27847 - DNA, 15 bp, Homo sapiens
ggggaggtgggggga

SEQ ID NO: 27848 - DNA, 15 bp, Homo sapiens
gggggaggtgggggg

SEQ ID NO: 27849 - DNA, 15 bp, Homo sapiens
tgggggaggtggggg

SEQ ID NO: 27850 - DNA, 15 bp, Homo sapiens
gtgggggaggtgggg

SEQ ID NO: 27851 - DNA, 15 bp, Homo sapiens
agtgggggaggtggg

SEQ ID NO: 27852 - DNA, 15 bp, Homo sapiens
gagtgggggaggtgg

SEQ ID NO: 27853 - DNA, 15 bp, Homo sapiens
ggagtgggggaggtg

SEQ ID NO: 27854 - DNA, 15 bp, Homo sapiens
gggagtgggggaggt

SEQ ID NO: 27855 - DNA, 15 bp, Homo sapiens
tgggagtgggggagg

SEQ ID NO: 27856 - DNA, 15 bp, Homo sapiens
ttgggagtgggggag

SEQ ID NO: 27857 - DNA, 15 bp, Homo sapiens
gttgggagtggggga

SEQ ID NO: 27858 - DNA, 15 bp, Homo sapiens
ggttgggagtggggg

SEQ ID NO: 27859 - DNA, 15 bp, Homo sapiens
tggttgggagtgggg

SEQ ID NO: 27860 - DNA, 15 bp, Homo sapiens
gtggttgggagtggg

SEQ ID NO: 27861 - DNA, 15 bp, Homo sapiens
cgtggttgggagtgg

SEQ ID NO: 27862 - DNA, 15 bp, Homo sapiens
acgtggttgggagtg

SEQ ID NO: 27863 - DNA, 15 bp, Homo sapiens
aacgtggttgggagt

SEQ ID NO: 27864 - DNA, 15 bp, Homo sapiens
caacgtggttgggag

SEQ ID NO: 27865 - DNA, 15 bp, Homo sapiens
ccaacgtggttggga

SEQ ID NO: 27866 - DNA, 15 bp, Homo sapiens
cccaacgtggttggg

SEQ ID NO: 27867 - DNA, 15 bp, Homo sapiens
tcccaacgtggttgg

SEQ ID NO: 27868 - DNA, 15 bp, Homo sapiens
gtcccaacgtggttg

SEQ ID NO: 27869 - DNA, 15 bp, Homo sapiens
tgtcccaacgtggtt

SEQ ID NO: 27870 - DNA, 15 bp, Homo sapiens
ctgtcccaacgtggt

SEQ ID NO: 27871 - DNA, 15 bp, Homo sapiens
cctgtcccaacgtgg

SEQ ID NO: 27872 - DNA, 15 bp, Homo sapiens
ccctgtcccaacgtg

SEQ ID NO: 27873 - DNA, 15 bp, Homo sapiens
tccctgtcccaacgt

SEQ ID NO: 27874 - DNA, 15 bp, Homo sapiens
ctccctgtcccaacg

SEQ ID NO: 27875 - DNA, 15 bp, Homo sapiens
cctccctgtcccaac

SEQ ID NO: 27876 - DNA, 15 bp, Homo sapiens
acctccctgtcccaa

SEQ ID NO: 27877 - DNA, 15 bp, Homo sapiens
cacctccctgtccca

SEQ ID NO: 27878 - DNA, 15 bp, Homo sapiens
acacctccctgtccc

SEQ ID NO: 27879 - DNA, 15 bp, Homo sapiens
cacacctccctgtcc

SEQ ID NO: 27880 - DNA, 15 bp, Homo sapiens
tcacacctccctgtc

SEQ ID NO: 27881 - DNA, 15 bp, Homo sapiens
ctcacacctccctgt

SEQ ID NO: 27882 - DNA, 15 bp, Homo sapiens
cctcacacctccctg

SEQ ID NO: 27883 - DNA, 15 bp, Homo sapiens
gcctcacacctccct

SEQ ID NO: 27884 - DNA, 15 bp, Homo sapiens
tgcctcacacctccc

SEQ ID NO: 27885 - DNA, 15 bp, Homo sapiens
ctgcctcacacctcc

SEQ ID NO: 27886 - DNA, 15 bp, Homo sapiens
cctgcctcacacctc

SEQ ID NO: 27887 - DNA, 15 bp, Homo sapiens
tcctgcctcacacct

SEQ ID NO: 27888 - DNA, 15 bp, Homo sapiens
ctcctgcctcacacc

SEQ ID NO: 27889 - DNA, 15 bp, Homo sapiens
tctcctgcctcacac

SEQ ID NO: 27890 - DNA, 15 bp, Homo sapiens
ctctcctgcctcaca

SEQ ID NO: 27891 - DNA, 15 bp, Homo sapiens
tctctcctgcctcac

SEQ ID NO: 27892 - DNA, 15 bp, Homo sapiens
gtctctcctgcctca

SEQ ID NO: 27893 - DNA, 15 bp, Homo sapiens
tgtctctcctgcctc

SEQ ID NO: 27894 - DNA, 15 bp, Homo sapiens
ctgtctctcctgcct

SEQ ID NO: 27895 - DNA, 15 bp, Homo sapiens
actgtctctcctgcc

SEQ ID NO: 27896 - DNA, 15 bp, Homo sapiens
aactgtctctcctgc

SEQ ID NO: 27897 - DNA, 15 bp, Homo sapiens
caactgtctctcctg

SEQ ID NO: 27898 - DNA, 15 bp, Homo sapiens
ccaactgtctctcct

SEQ ID NO: 27899 - DNA, 15 bp, Homo sapiens
tccaactgtctctcc

SEQ ID NO: 27900 - DNA, 15 bp, Homo sapiens
atccaactgtctctc

SEQ ID NO: 27901 - DNA, 15 bp, Homo sapiens
aatccaactgtctct

SEQ ID NO: 27902 - DNA, 15 bp, Homo sapiens
gaatccaactgtctc

SEQ ID NO: 27903 - DNA, 15 bp, Homo sapiens
agaatccaactgtct

SEQ ID NO: 27904 - DNA, 15 bp, Homo sapiens
aagaatccaactgtc

SEQ ID NO: 27905 - DNA, 15 bp, Homo sapiens
aaagaatccaactgt

SEQ ID NO: 27906 - DNA, 15 bp, Homo sapiens
taaagaatccaactg

SEQ ID NO: 27907 - DNA, 15 bp, Homo sapiens
ctaaagaatccaact

SEQ ID NO: 27908 - DNA, 15 bp, Homo sapiens
tctaaagaatccaac

SEQ ID NO: 27909 - DNA, 15 bp, Homo sapiens
ctctaaagaatccaa

SEQ ID NO: 27910 - DNA, 15 bp, Homo sapiens
tctctaaagaatcca

SEQ ID NO: 27911 - DNA, 15 bp, Homo sapiens
ttctctaaagaatcc

SEQ ID NO: 27912 - DNA, 15 bp, Homo sapiens
cttctctaaagaatc

SEQ ID NO: 27913 - DNA, 15 bp, Homo sapiens
tcttctctaaagaat

SEQ ID NO: 27914 - DNA, 15 bp, Homo sapiens
atcttctctaaagaa

SEQ ID NO: 27915 - DNA, 15 bp, Homo sapiens
catcttctctaaaga

SEQ ID NO: 27916 - DNA, 15 bp, Homo sapiens
ccatcttctctaaag

SEQ ID NO: 27917 - DNA, 15 bp, Homo sapiens
tccatcttctctaaa

SEQ ID NO: 27918 - DNA, 15 bp, Homo sapiens
atccatcttctctaa

SEQ ID NO: 27919 - DNA, 15 bp, Homo sapiens
tatccatcttctcta

SEQ ID NO: 27920 - DNA, 15 bp, Homo sapiens
atatccatcttctct

SEQ ID NO: 27921 - DNA, 15 bp, Homo sapiens
catatccatcttctc

SEQ ID NO: 27922 - DNA, 15 bp, Homo sapiens
tcatatccatcttct

SEQ ID NO: 27923 - DNA, 15 bp, Homo sapiens
gtcatatccatcttc

SEQ ID NO: 27924 - DNA, 15 bp, Homo sapiens
ggtcatatccatctt

SEQ ID NO: 27925 - DNA, 15 bp, Homo sapiens
tggtcatatccatct

SEQ ID NO: 27926 - DNA, 15 bp, Homo sapiens
ctggtcatatccatc

SEQ ID NO: 27927 - DNA, 15 bp, Homo sapiens
actggtcatatccat

SEQ ID NO: 27928 - DNA, 15 bp, Homo sapiens
cactggtcatatcca

SEQ ID NO: 27929 - DNA, 15 bp, Homo sapiens
ccactggtcatatcc

SEQ ID NO: 27930 - DNA, 15 bp, Homo sapiens
gccactggtcatatc

SEQ ID NO: 27931 - DNA, 15 bp, Homo sapiens
agccactggtcatat

SEQ ID NO: 27932 - DNA, 15 bp, Homo sapiens
tagccactggtcata

SEQ ID NO: 27933 - DNA, 15 bp, Homo sapiens
atagccactggtcat

SEQ ID NO: 27934 - DNA, 15 bp, Homo sapiens
catagccactggtca

SEQ ID NO: 27935 - DNA, 15 bp, Homo sapiens
ccatagccactggtc

SEQ ID NO: 27936 - DNA, 15 bp, Homo sapiens
gccatagccactggt

SEQ ID NO: 27937 - DNA, 15 bp, Homo sapiens
ggccatagccactgg

SEQ ID NO: 27938 - DNA, 15 bp, Homo sapiens
aggccatagccactg

SEQ ID NO: 27939 - DNA, 15 bp, Homo sapiens
caggccatagccact

SEQ ID NO: 27940 - DNA, 15 bp, Homo sapiens
acaggccatagccac

SEQ ID NO: 27941 - DNA, 15 bp, Homo sapiens
cacaggccatagcca

SEQ ID NO: 27942 - DNA, 15 bp, Homo sapiens
gcacaggccatagcc

SEQ ID NO: 27943 - DNA, 15 bp, Homo sapiens
cgcacaggccatagc

SEQ ID NO: 27944 - DNA, 15 bp, Homo sapiens
tcgcacaggccatag

SEQ ID NO: 27945 - DNA, 15 bp, Homo sapiens
atcgcacaggccata

SEQ ID NO: 27946 - DNA, 15 bp, Homo sapiens
gatcgcacaggccat

SEQ ID NO: 27947 - DNA, 15 bp, Homo sapiens
ggatcgcacaggcca

SEQ ID NO: 27948 - DNA, 15 bp, Homo sapiens
gggatcgcacaggcc

SEQ ID NO: 27949 - DNA, 15 bp, Homo sapiens
tgggatcgcacaggc

SEQ ID NO: 27950 - DNA, 15 bp, Homo sapiens
gtgggatcgcacagg

SEQ ID NO: 27951 - DNA, 15 bp, Homo sapiens
ggtgggatcgcacag

SEQ ID NO: 27952 - DNA, 15 bp, Homo sapiens
gggtgggatcgcaca

SEQ ID NO: 27953 - DNA, 15 bp, Homo sapiens
cgggtgggatcgcac

SEQ ID NO: 27954 - DNA, 15 bp, Homo sapiens
acgggtgggatcgca

SEQ ID NO: 27955 - DNA, 15 bp, Homo sapiens
cacgggtgggatcgc

SEQ ID NO: 27956 - DNA, 15 bp, Homo sapiens
ccacgggtgggatcg

SEQ ID NO: 27957 - DNA, 15 bp, Homo sapiens
accacgggtgggatc

SEQ ID NO: 27958 - DNA, 15 bp, Homo sapiens
caccacgggtgggat

SEQ ID NO: 27959 - DNA, 15 bp, Homo sapiens
ccaccacgggtggga

SEQ ID NO: 27960 - DNA, 15 bp, Homo sapiens
gccaccacgggtggg

SEQ ID NO: 27961 - DNA, 15 bp, Homo sapiens
agccaccacgggtgg

SEQ ID NO: 27962 - DNA, 15 bp, Homo sapiens
gagccaccacgggtg

SEQ ID NO: 27963 - DNA, 15 bp, Homo sapiens
tgagccaccacgggt

SEQ ID NO: 27964 - DNA, 15 bp, Homo sapiens
ttgagccaccacggg

SEQ ID NO: 27965 - DNA, 15 bp, Homo sapiens
cttgagccaccacgg

SEQ ID NO: 27966 - DNA, 15 bp, Homo sapiens
acttgagccaccacg

SEQ ID NO: 27967 - DNA, 15 bp, Homo sapiens
gacttgagccaccac

SEQ ID NO: 27968 - DNA, 15 bp, Homo sapiens
agacttgagccacca

SEQ ID NO: 27969 - DNA, 15 bp, Homo sapiens
cagacttgagccacc

SEQ ID NO: 27970 - DNA, 15 bp, Homo sapiens
ccagacttgagccac

SEQ ID NO: 27971 - DNA, 15 bp, Homo sapiens
gccagacttgagcca

SEQ ID NO: 27972 - DNA, 15 bp, Homo sapiens
ggccagacttgagcc

SEQ ID NO: 27973 - DNA, 15 bp, Homo sapiens
gggccagacttgagc

SEQ ID NO: 27974 - DNA, 15 bp, Homo sapiens
ggggccagacttgag

SEQ ID NO: 27975 - DNA, 15 bp, Homo sapiens
tggggccagacttga

SEQ ID NO: 27976 - DNA, 15 bp, Homo sapiens
gtggggccagacttg

SEQ ID NO: 27977 - DNA, 15 bp, Homo sapiens
tgtggggccagactt

SEQ ID NO: 27978 - DNA, 15 bp, Homo sapiens
gtgtggggccagact

SEQ ID NO: 27979 - DNA, 15 bp, Homo sapiens
ggtgtggggccagac

SEQ ID NO: 27980 - DNA, 15 bp, Homo sapiens
tggtgtggggccaga

SEQ ID NO: 27981 - DNA, 15 bp, Homo sapiens
ctggtgtggggccag

SEQ ID NO: 27982 - DNA, 15 bp, Homo sapiens
gctggtgtggggcca

SEQ ID NO: 27983 - DNA, 15 bp, Homo sapiens
ggctggtgtggggcc

SEQ ID NO: 27984 - DNA, 15 bp, Homo sapiens
gggctggtgtggggc

SEQ ID NO: 27985 - DNA, 15 bp, Homo sapiens
ggggctggtgtgggg

SEQ ID NO: 27986 - DNA, 15 bp, Homo sapiens
tggggctggtgtggg

SEQ ID NO: 27987 - DNA, 15 bp, Homo sapiens
ttggggctggtgtgg

SEQ ID NO: 27988 - DNA, 15 bp, Homo sapiens
attggggctggtgtg

SEQ ID NO: 27989 - DNA, 15 bp, Homo sapiens
gattggggctggtgt

SEQ ID NO: 27990 - DNA, 15 bp, Homo sapiens
ggattggggctggtg

SEQ ID NO: 27991 - DNA, 15 bp, Homo sapiens
tggattggggctggt

SEQ ID NO: 27992 - DNA, 15 bp, Homo sapiens
ttggattggggctgg

SEQ ID NO: 27993 - DNA, 15 bp, Homo sapiens
tttggattggggctg

SEQ ID NO: 27994 - DNA, 15 bp, Homo sapiens
ttttggattggggct

SEQ ID NO: 27995 - DNA, 15 bp, Homo sapiens
gttttggattggggc

SEQ ID NO: 27996 - DNA, 15 bp, Homo sapiens
agttttggattgggg

SEQ ID NO: 27997 - DNA, 15 bp, Homo sapiens
cagttttggattggg

SEQ ID NO: 27998 - DNA, 15 bp, Homo sapiens
ccagttttggattgg

SEQ ID NO: 27999 - DNA, 15 bp, Homo sapiens
gccagttttggattg

SEQ ID NO: 28000 - DNA, 15 bp, Homo sapiens
tgccagttttggatt

SEQ ID NO: 28001 - DNA, 15 bp, Homo sapiens
ttgccagttttggat

SEQ ID NO: 28002 - DNA, 15 bp, Homo sapiens
cttgccagttttgga

SEQ ID NO: 28003 - DNA, 15 bp, Homo sapiens
ccttgccagttttgg

SEQ ID NO: 28004 - DNA, 15 bp, Homo sapiens
tccttgccagttttg

SEQ ID NO: 28005 - DNA, 15 bp, Homo sapiens
gtccttgccagtttt

SEQ ID NO: 28006 - DNA, 15 bp, Homo sapiens
cgtccttgccagttt

SEQ ID NO: 28007 - DNA, 15 bp, Homo sapiens
gcgtccttgccagtt

SEQ ID NO: 28008 - DNA, 15 bp, Homo sapiens
agcgtccttgccagt

SEQ ID NO: 28009 - DNA, 15 bp, Homo sapiens
aagcgtccttgccag

SEQ ID NO: 28010 - DNA, 15 bp, Homo sapiens
gaagcgtccttgcca

SEQ ID NO: 28011 - DNA, 15 bp, Homo sapiens
tgaagcgtccttgcc

SEQ ID NO: 28012 - DNA, 15 bp, Homo sapiens
gtgaagcgtccttgc

SEQ ID NO: 28013 - DNA, 15 bp, Homo sapiens
tgtgaagcgtccttg

SEQ ID NO: 28014 - DNA, 15 bp, Homo sapiens
ctgtgaagcgtcctt

SEQ ID NO: 28015 - DNA, 15 bp, Homo sapiens
cctgtgaagcgtcct

SEQ ID NO: 28016 - DNA, 15 bp, Homo sapiens
tcctgtgaagcgtcc

SEQ ID NO: 28017 - DNA, 15 bp, Homo sapiens
gtcctgtgaagcgtc

SEQ ID NO: 28018 - DNA, 15 bp, Homo sapiens
tgtcctgtgaagcgt

SEQ ID NO: 28019 - DNA, 15 bp, Homo sapiens
ctgtcctgtgaagcg

SEQ ID NO: 28020 - DNA, 15 bp, Homo sapiens
cctgtcctgtgaagc

SEQ ID NO: 28021 - DNA, 15 bp, Homo sapiens
tcctgtcctgtgaag

SEQ ID NO: 28022 - DNA, 15 bp, Homo sapiens
ttcctgtcctgtgaa

SEQ ID NO: 28023 - DNA, 15 bp, Homo sapiens
tttcctgtcctgtga

SEQ ID NO: 28024 - DNA, 15 bp, Homo sapiens
ctttcctgtcctgtg

SEQ ID NO: 28025 - DNA, 15 bp, Homo sapiens
actttcctgtcctgt

SEQ ID NO: 28026 - DNA, 15 bp, Homo sapiens
cactttcctgtcctg

SEQ ID NO: 28027 - DNA, 15 bp, Homo sapiens
ccactttcctgtcct

SEQ ID NO: 28028 - DNA, 15 bp, Homo sapiens
gccactttcctgtcc

SEQ ID NO: 28029 - DNA, 15 bp, Homo sapiens
tgccactttcctgtc

SEQ ID NO: 28030 - DNA, 15 bp, Homo sapiens
gtgccactttcctgt

SEQ ID NO: 28031 - DNA, 15 bp, Homo sapiens
ggtgccactttcctg

SEQ ID NO: 28032 - DNA, 15 bp, Homo sapiens
aggtgccactttcct

SEQ ID NO: 28033 - DNA, 15 bp, Homo sapiens
caggtgccactttcc

SEQ ID NO: 28034 - DNA, 15 bp, Homo sapiens
acaggtgccactttc

SEQ ID NO: 28035 - DNA, 15 bp, Homo sapiens
gacaggtgccacttt

SEQ ID NO: 28036 - DNA, 15 bp, Homo sapiens
agacaggtgccactt

SEQ ID NO: 28037 - DNA, 15 bp, Homo sapiens
cagacaggtgccact

SEQ ID NO: 28038 - DNA, 15 bp, Homo sapiens
gcagacaggtgccac

SEQ ID NO: 28039 - DNA, 15 bp, Homo sapiens
agcagacaggtgcca

SEQ ID NO: 28040 - DNA, 15 bp, Homo sapiens
gagcagacaggtgcc

SEQ ID NO: 28041 - DNA, 15 bp, Homo sapiens
ggagcagacaggtgc

SEQ ID NO: 28042 - DNA, 15 bp, Homo sapiens
tggagcagacaggtg

SEQ ID NO: 28043 - DNA, 15 bp, Homo sapiens
ctggagcagacaggt

SEQ ID NO: 28044 - DNA, 15 bp, Homo sapiens
gctggagcagacagg

SEQ ID NO: 28045 - DNA, 15 bp, Homo sapiens
agctggagcagacag

SEQ ID NO: 28046 - DNA, 15 bp, Homo sapiens
gagctggagcagaca

SEQ ID NO: 28047 - DNA, 15 bp, Homo sapiens
agagctggagcagac

SEQ ID NO: 28048 - DNA, 15 bp, Homo sapiens
cagagctggagcaga

SEQ ID NO: 28049 - DNA, 15 bp, Homo sapiens
ccagagctggagcag

SEQ ID NO: 28050 - DNA, 15 bp, Homo sapiens
gccagagctggagca

SEQ ID NO: 28051 - DNA, 15 bp, Homo sapiens
tgccagagctggagc

SEQ ID NO: 28052 - DNA, 15 bp, Homo sapiens
atgccagagctggag

SEQ ID NO: 28053 - DNA, 15 bp, Homo sapiens
catgccagagctgga

SEQ ID NO: 28054 - DNA, 15 bp, Homo sapiens
ccatgccagagctgg

SEQ ID NO: 28055 - DNA, 15 bp, Homo sapiens
gccatgccagagctg

SEQ ID NO: 28056 - DNA, 15 bp, Homo sapiens
agccatgccagagct

SEQ ID NO: 28057 - DNA, 15 bp, Homo sapiens
tagccatgccagagc

SEQ ID NO: 28058 - DNA, 15 bp, Homo sapiens
ctagccatgccagag

SEQ ID NO: 28059 - DNA, 15 bp, Homo sapiens
cctagccatgccaga

SEQ ID NO: 28060 - DNA, 15 bp, Homo sapiens
tcctagccatgccag

SEQ ID NO: 28061 - DNA, 15 bp, Homo sapiens
ctcctagccatgcca

SEQ ID NO: 28062 - DNA, 15 bp, Homo sapiens
cctcctagccatgcc

SEQ ID NO: 28063 - DNA, 15 bp, Homo sapiens
ccctcctagccatgc

SEQ ID NO: 28064 - DNA, 15 bp, Homo sapiens
cccctcctagccatg

SEQ ID NO: 28065 - DNA, 15 bp, Homo sapiens
ccccctcctagccat

SEQ ID NO: 28066 - DNA, 15 bp, Homo sapiens
cccccctcctagcca

SEQ ID NO: 28067 - DNA, 15 bp, Homo sapiens
tcccccctcctagcc

SEQ ID NO: 28068 - DNA, 15 bp, Homo sapiens
ctcccccctcctagc

SEQ ID NO: 28069 - DNA, 15 bp, Homo sapiens
actcccccctcctag

SEQ ID NO: 28070 - DNA, 15 bp, Homo sapiens
gactcccccctccta

SEQ ID NO: 28071 - DNA, 15 bp, Homo sapiens
ggactcccccctcct

SEQ ID NO: 28072 - DNA, 15 bp, Homo sapiens
gggactcccccctcc

SEQ ID NO: 28073 - DNA, 15 bp, Homo sapiens
agggactcccccctc

SEQ ID NO: 28074 - DNA, 15 bp, Homo sapiens
aagggactcccccct

SEQ ID NO: 28075 - DNA, 15 bp, Homo sapiens
caagggactcccccc

SEQ ID NO: 28076 - DNA, 15 bp, Homo sapiens
tcaagggactccccc

SEQ ID NO: 28077 - DNA, 15 bp, Homo sapiens
ttcaagggactcccc

SEQ ID NO: 28078 - DNA, 15 bp, Homo sapiens
gttcaagggactccc

SEQ ID NO: 28079 - DNA, 15 bp, Homo sapiens
agttcaagggactcc

SEQ ID NO: 28080 - DNA, 15 bp, Homo sapiens
tagttcaagggactc

SEQ ID NO: 28081 - DNA, 15 bp, Homo sapiens
gtagttcaagggact

SEQ ID NO: 28082 - DNA, 15 bp, Homo sapiens
agtagttcaagggac

SEQ ID NO: 28083 - DNA, 15 bp, Homo sapiens
cagtagttcaaggga

SEQ ID NO: 28084 - DNA, 15 bp, Homo sapiens
ccagtagttcaaggg

SEQ ID NO: 28085 - DNA, 15 bp, Homo sapiens
cccagtagttcaagg

SEQ ID NO: 28086 - DNA, 15 bp, Homo sapiens
acccagtagttcaag

SEQ ID NO: 28087 - DNA, 15 bp, Homo sapiens
cacccagtagttcaa

SEQ ID NO: 28088 - DNA, 15 bp, Homo sapiens
acacccagtagttca

SEQ ID NO: 28089 - DNA, 15 bp, Homo sapiens
tacacccagtagttc

SEQ ID NO: 28090 - DNA, 15 bp, Homo sapiens
ctacacccagtagtt

SEQ ID NO: 28091 - DNA, 15 bp, Homo sapiens
tctacacccagtagt

SEQ ID NO: 28092 - DNA, 15 bp, Homo sapiens
gtctacacccagtag

SEQ ID NO: 28093 - DNA, 15 bp, Homo sapiens
agtctacacccagta

SEQ ID NO: 28094 - DNA, 15 bp, Homo sapiens
cagtctacacccagt

SEQ ID NO: 28095 - DNA, 15 bp, Homo sapiens
ccagtctacacccag

SEQ ID NO: 28096 - DNA, 15 bp, Homo sapiens
gccagtctacaccca

SEQ ID NO: 28097 - DNA, 15 bp, Homo sapiens
ggccagtctacaccc

SEQ ID NO: 28098 - DNA, 15 bp, Homo sapiens
aggccagtctacacc

SEQ ID NO: 28099 - DNA, 15 bp, Homo sapiens
caggccagtctacac

SEQ ID NO: 28100 - DNA, 15 bp, Homo sapiens
tcaggccagtctaca

SEQ ID NO: 28101 - DNA, 15 bp, Homo sapiens
ttcaggccagtctac

SEQ ID NO: 28102 - DNA, 15 bp, Homo sapiens
gttcaggccagtcta

SEQ ID NO: 28103 - DNA, 15 bp, Homo sapiens
ggttcaggccagtct

SEQ ID NO: 28104 - DNA, 15 bp, Homo sapiens
tggttcaggccagtc

SEQ ID NO: 28105 - DNA, 15 bp, Homo sapiens
gtggttcaggccagt

SEQ ID NO: 28106 - DNA, 15 bp, Homo sapiens
tgtggttcaggccag

SEQ ID NO: 28107 - DNA, 15 bp, Homo sapiens
ctgtggttcaggcca

SEQ ID NO: 28108 - DNA, 15 bp, Homo sapiens
cctgtggttcaggcc

SEQ ID NO: 28109 - DNA, 15 bp, Homo sapiens
tcctgtggttcaggc

SEQ ID NO: 28110 - DNA, 15 bp, Homo sapiens
ctcctgtggttcagg

SEQ ID NO: 28111 - DNA, 15 bp, Homo sapiens
tctcctgtggttcag

SEQ ID NO: 28112 - DNA, 15 bp, Homo sapiens
ctctcctgtggttca

SEQ ID NO: 28113 - DNA, 15 bp, Homo sapiens
cctctcctgtggttc

SEQ ID NO: 28114 - DNA, 15 bp, Homo sapiens
tcctctcctgtggtt

SEQ ID NO: 28115 - DNA, 15 bp, Homo sapiens
atcctctcctgtggt

SEQ ID NO: 28116 - DNA, 15 bp, Homo sapiens
catcctctcctgtgg

SEQ ID NO: 28117 - DNA, 15 bp, Homo sapiens
ccatcctctcctgtg

SEQ ID NO: 28118 - DNA, 15 bp, Homo sapiens
gccatcctctcctgt

SEQ ID NO: 28119 - DNA, 15 bp, Homo sapiens
ggccatcctctcctg

SEQ ID NO: 28120 - DNA, 15 bp, Homo sapiens
gggccatcctctcct

SEQ ID NO: 28121 - DNA, 15 bp, Homo sapiens
tgggccatcctctcc

SEQ ID NO: 28122 - DNA, 15 bp, Homo sapiens
ctgggccatcctctc

SEQ ID NO: 28123 - DNA, 15 bp, Homo sapiens
cctgggccatcctct

SEQ ID NO: 28124 - DNA, 15 bp, Homo sapiens
ccctgggccatcctc

SEQ ID NO: 28125 - DNA, 15 bp, Homo sapiens
accctgggccatcct

SEQ ID NO: 28126 - DNA, 15 bp, Homo sapiens
caccctgggccatcc

SEQ ID NO: 28127 - DNA, 15 bp, Homo sapiens
tcaccctgggccatc

SEQ ID NO: 28128 - DNA, 15 bp, Homo sapiens
ctcaccctgggccat

SEQ ID NO: 28129 - DNA, 15 bp, Homo sapiens
cctcaccctgggcca

SEQ ID NO: 28130 - DNA, 15 bp, Homo sapiens
acctcaccctgggcc

SEQ ID NO: 28131 - DNA, 15 bp, Homo sapiens
cacctcaccctgggc

SEQ ID NO: 28132 - DNA, 15 bp, Homo sapiens
ccacctcaccctggg

SEQ ID NO: 28133 - DNA, 15 bp, Homo sapiens
gccacctcaccctgg

SEQ ID NO: 28134 - DNA, 15 bp, Homo sapiens
tgccacctcaccctg

SEQ ID NO: 28135 - DNA, 15 bp, Homo sapiens
atgccacctcaccct

SEQ ID NO: 28136 - DNA, 15 bp, Homo sapiens
catgccacctcaccc

SEQ ID NO: 28137 - DNA, 15 bp, Homo sapiens
ccatgccacctcacc

SEQ ID NO: 28138 - DNA, 15 bp, Homo sapiens
accatgccacctcac

SEQ ID NO: 28139 - DNA, 15 bp, Homo sapiens
gaccatgccacctca

SEQ ID NO: 28140 - DNA, 15 bp, Homo sapiens
ggaccatgccacctc

SEQ ID NO: 28141 - DNA, 15 bp, Homo sapiens
tggaccatgccacct

SEQ ID NO: 28142 - DNA, 15 bp, Homo sapiens
atggaccatgccacc

SEQ ID NO: 28143 - DNA, 15 bp, Homo sapiens
aatggaccatgccac

SEQ ID NO: 28144 - DNA, 15 bp, Homo sapiens
gaatggaccatgcca

SEQ ID NO: 28145 - DNA, 15 bp, Homo sapiens
agaatggaccatgcc

SEQ ID NO: 28146 - DNA, 15 bp, Homo sapiens
gagaatggaccatgc

SEQ ID NO: 28147 - DNA, 15 bp, Homo sapiens
tgagaatggaccatg

SEQ ID NO: 28148 - DNA, 15 bp, Homo sapiens
ttgagaatggaccat

SEQ ID NO: 28149 - DNA, 15 bp, Homo sapiens
cttgagaatggacca

SEQ ID NO: 28150 - DNA, 15 bp, Homo sapiens
ccttgagaatggacc

SEQ ID NO: 28151 - DNA, 15 bp, Homo sapiens
cccttgagaatggac

SEQ ID NO: 28152 - DNA, 15 bp, Homo sapiens
tcccttgagaatgga

SEQ ID NO: 28153 - DNA, 15 bp, Homo sapiens
gtcccttgagaatgg

SEQ ID NO: 28154 - DNA, 15 bp, Homo sapiens
cgtcccttgagaatg

SEQ ID NO: 28155 - DNA, 15 bp, Homo sapiens
acgtcccttgagaat

SEQ ID NO: 28156 - DNA, 15 bp, Homo sapiens
gacgtcccttgagaa

SEQ ID NO: 28157 - DNA, 15 bp, Homo sapiens
ggacgtcccttgaga

SEQ ID NO: 28158 - DNA, 15 bp, Homo sapiens
aggacgtcccttgag

SEQ ID NO: 28159 - DNA, 15 bp, Homo sapiens
gaggacgtcccttga

SEQ ID NO: 28160 - DNA, 15 bp, Homo sapiens
ggaggacgtcccttg

SEQ ID NO: 28161 - DNA, 15 bp, Homo sapiens
tggaggacgtccctt

SEQ ID NO: 28162 - DNA, 15 bp, Homo sapiens
ttggaggacgtccct

SEQ ID NO: 28163 - DNA, 15 bp, Homo sapiens
gttggaggacgtccc

SEQ ID NO: 28164 - DNA, 15 bp, Homo sapiens
cgttggaggacgtcc

SEQ ID NO: 28165 - DNA, 15 bp, Homo sapiens
ccgttggaggacgtc

SEQ ID NO: 28166 - DNA, 15 bp, Homo sapiens
cccgttggaggacgt

SEQ ID NO: 28167 - DNA, 15 bp, Homo sapiens
acccgttggaggacg

SEQ ID NO: 28168 - DNA, 15 bp, Homo sapiens
cacccgttggaggac

SEQ ID NO: 28169 - DNA, 15 bp, Homo sapiens
ccacccgttggagga

SEQ ID NO: 28170 - DNA, 15 bp, Homo sapiens
gccacccgttggagg

SEQ ID NO: 28171 - DNA, 15 bp, Homo sapiens
cgccacccgttggag

SEQ ID NO: 28172 - DNA, 15 bp, Homo sapiens
gcgccacccgttgga

SEQ ID NO: 28173 - DNA, 15 bp, Homo sapiens
agcgccacccgttgg

SEQ ID NO: 28174 - DNA, 15 bp, Homo sapiens
tagcgccacccgttg

SEQ ID NO: 28175 - DNA, 15 bp, Homo sapiens
ctagcgccacccgtt

SEQ ID NO: 28176 - DNA, 15 bp, Homo sapiens
tctagcgccacccgt

SEQ ID NO: 28177 - DNA, 15 bp, Homo sapiens
ctctagcgccacccg

SEQ ID NO: 28178 - DNA, 15 bp, Homo sapiens
cctctagcgccaccc

SEQ ID NO: 28179 - DNA, 15 bp, Homo sapiens
gcctctagcgccacc

SEQ ID NO: 28180 - DNA, 15 bp, Homo sapiens
ggcctctagcgccac

SEQ ID NO: 28181 - DNA, 15 bp, Homo sapiens
tggcctctagcgcca

SEQ ID NO: 28182 - DNA, 15 bp, Homo sapiens
atggcctctagcgcc

SEQ ID NO: 28183 - DNA, 15 bp, Homo sapiens
catggcctctagcgc

SEQ ID NO: 28184 - DNA, 15 bp, Homo sapiens
ccatggcctctagcg

SEQ ID NO: 28185 - DNA, 15 bp, Homo sapiens
tccatggcctctagc

SEQ ID NO: 28186 - DNA, 15 bp, Homo sapiens
ctccatggcctctag

SEQ ID NO: 28187 - DNA, 15 bp, Homo sapiens
cctccatggcctcta

SEQ ID NO: 28188 - DNA, 15 bp, Homo sapiens
gcctccatggcctct

SEQ ID NO: 28189 - DNA, 15 bp, Homo sapiens
tgcctccatggcctc

SEQ ID NO: 28190 - DNA, 15 bp, Homo sapiens
ctgcctccatggcct

SEQ ID NO: 28191 - DNA, 15 bp, Homo sapiens
actgcctccatggcc

SEQ ID NO: 28192 - DNA, 15 bp, Homo sapiens
tactgcctccatggc

SEQ ID NO: 28193 - DNA, 15 bp, Homo sapiens
ctactgcctccatgg

SEQ ID NO: 28194 - DNA, 15 bp, Homo sapiens
cctactgcctccatg

SEQ ID NO: 28195 - DNA, 15 bp, Homo sapiens
tcctactgcctccat

SEQ ID NO: 28196 - DNA, 15 bp, Homo sapiens
gtcctactgcctcca

SEQ ID NO: 28197 - DNA, 15 bp, Homo sapiens
tgtcctactgcctcc

SEQ ID NO: 28198 - DNA, 15 bp, Homo sapiens
ttgtcctactgcctc

SEQ ID NO: 28199 - DNA, 15 bp, Homo sapiens
cttgtcctactgcct

SEQ ID NO: 28200 - DNA, 15 bp, Homo sapiens
ccttgtcctactgcc

SEQ ID NO: 28201 - DNA, 15 bp, Homo sapiens
accttgtcctactgc

SEQ ID NO: 28202 - DNA, 15 bp, Homo sapiens
caccttgtcctactg

SEQ ID NO: 28203 - DNA, 15 bp, Homo sapiens
gcaccttgtcctact

SEQ ID NO: 28204 - DNA, 15 bp, Homo sapiens
tgcaccttgtcctac

SEQ ID NO: 28205 - DNA, 15 bp, Homo sapiens
ctgcaccttgtccta

SEQ ID NO: 28206 - DNA, 15 bp, Homo sapiens
cctgcaccttgtcct

SEQ ID NO: 28207 - DNA, 15 bp, Homo sapiens
gcctgcaccttgtcc

SEQ ID NO: 28208 - DNA, 15 bp, Homo sapiens
tgcctgcaccttgtc

SEQ ID NO: 28209 - DNA, 15 bp, Homo sapiens
ctgcctgcaccttgt

SEQ ID NO: 28210 - DNA, 15 bp, Homo sapiens
cctgcctgcaccttg

SEQ ID NO: 28211 - DNA, 15 bp, Homo sapiens
gcctgcctgcacctt

SEQ ID NO: 28212 - DNA, 15 bp, Homo sapiens
agcctgcctgcacct

SEQ ID NO: 28213 - DNA, 15 bp, Homo sapiens
cagcctgcctgcacc

SEQ ID NO: 28214 - DNA, 15 bp, Homo sapiens
ccagcctgcctgcac

SEQ ID NO: 28215 - DNA, 15 bp, Homo sapiens
gccagcctgcctgca

SEQ ID NO: 28216 - DNA, 15 bp, Homo sapiens
ggccagcctgcctgc

SEQ ID NO: 28217 - DNA, 15 bp, Homo sapiens
aggccagcctgcctg

SEQ ID NO: 28218 - DNA, 15 bp, Homo sapiens
caggccagcctgcct

SEQ ID NO: 28219 - DNA, 15 bp, Homo sapiens
ccaggccagcctgcc

SEQ ID NO: 28220 - DNA, 15 bp, Homo sapiens
cccaggccagcctgc

SEQ ID NO: 28221 - DNA, 15 bp, Homo sapiens
ccccaggccagcctg

SEQ ID NO: 28222 - DNA, 15 bp, Homo sapiens
accccaggccagcct

SEQ ID NO: 28223 - DNA, 15 bp, Homo sapiens
gaccccaggccagcc

SEQ ID NO: 28224 - DNA, 15 bp, Homo sapiens
tgaccccaggccagc

SEQ ID NO: 28225 - DNA, 15 bp, Homo sapiens
ctgaccccaggccag

SEQ ID NO: 28226 - DNA, 15 bp, Homo sapiens
cctgaccccaggcca

SEQ ID NO: 28227 - DNA, 15 bp, Homo sapiens
gcctgaccccaggcc

SEQ ID NO: 28228 - DNA, 15 bp, Homo sapiens
ggcctgaccccaggc

SEQ ID NO: 28229 - DNA, 15 bp, Homo sapiens
cggcctgaccccagg

SEQ ID NO: 28230 - DNA, 15 bp, Homo sapiens
ccggcctgaccccag

SEQ ID NO: 28231 - DNA, 15 bp, Homo sapiens
cccggcctgacccca

SEQ ID NO: 28232 - DNA, 15 bp, Homo sapiens
gcccggcctgacccc

SEQ ID NO: 28233 - DNA, 15 bp, Homo sapiens
tgcccggcctgaccc

SEQ ID NO: 28234 - DNA, 15 bp, Homo sapiens
ctgcccggcctgacc

SEQ ID NO: 28235 - DNA, 15 bp, Homo sapiens
tctgcccggcctgac

SEQ ID NO: 28236 - DNA, 15 bp, Homo sapiens
ctctgcccggcctga

SEQ ID NO: 28237 - DNA, 15 bp, Homo sapiens
gctctgcccggcctg

SEQ ID NO: 28238 - DNA, 15 bp, Homo sapiens
tgctctgcccggcct

SEQ ID NO: 28239 - DNA, 15 bp, Homo sapiens
gtgctctgcccggcc

SEQ ID NO: 28240 - DNA, 15 bp, Homo sapiens
tgtgctctgcccggc

SEQ ID NO: 28241 - DNA, 15 bp, Homo sapiens
ctgtgctctgcccgg

SEQ ID NO: 28242 - DNA, 15 bp, Homo sapiens
gctgtgctctgcccg

SEQ ID NO: 28243 - DNA, 15 bp, Homo sapiens
cgctgtgctctgccc

SEQ ID NO: 28244 - DNA, 15 bp, Homo sapiens
ccgctgtgctctgcc

SEQ ID NO: 28245 - DNA, 15 bp, Homo sapiens
cccgctgtgctctgc

SEQ ID NO: 28246 - DNA, 15 bp, Homo sapiens
ccccgctgtgctctg

SEQ ID NO: 28247 - DNA, 15 bp, Homo sapiens
accccgctgtgctct

SEQ ID NO: 28248 - DNA, 15 bp, Homo sapiens
caccccgctgtgctc

SEQ ID NO: 28249 - DNA, 15 bp, Homo sapiens
tcaccccgctgtgct

SEQ ID NO: 28250 - DNA, 15 bp, Homo sapiens
ctcaccccgctgtgc

SEQ ID NO: 28251 - DNA, 15 bp, Homo sapiens
tctcaccccgctgtg

SEQ ID NO: 28252 - DNA, 15 bp, Homo sapiens
ctctcaccccgctgt

SEQ ID NO: 28253 - DNA, 15 bp, Homo sapiens
cctctcaccccgctg

SEQ ID NO: 28254 - DNA, 15 bp, Homo sapiens
ccctctcaccccgct

SEQ ID NO: 28255 - DNA, 15 bp, Homo sapiens
tccctctcaccccgc

SEQ ID NO: 28256 - DNA, 15 bp, Homo sapiens
atccctctcaccccg

SEQ ID NO: 28257 - DNA, 15 bp, Homo sapiens
aatccctctcacccc

SEQ ID NO: 28258 - DNA, 15 bp, Homo sapiens
gaatccctctcaccc

SEQ ID NO: 28259 - DNA, 15 bp, Homo sapiens
ggaatccctctcacc

SEQ ID NO: 28260 - DNA, 15 bp, Homo sapiens
aggaatccctctcac

SEQ ID NO: 28261 - DNA, 15 bp, Homo sapiens
taggaatccctctca

SEQ ID NO: 28262 - DNA, 15 bp, Homo sapiens
ttaggaatccctctc

SEQ ID NO: 28263 - DNA, 15 bp, Homo sapiens
attaggaatccctct

SEQ ID NO: 28264 - DNA, 15 bp, Homo sapiens
gattaggaatccctc

SEQ ID NO: 28265 - DNA, 15 bp, Homo sapiens
tgattaggaatccct

SEQ ID NO: 28266 - DNA, 15 bp, Homo sapiens
gtgattaggaatccc

SEQ ID NO: 28267 - DNA, 15 bp, Homo sapiens
agtgattaggaatcc

SEQ ID NO: 28268 - DNA, 15 bp, Homo sapiens
gagtgattaggaatc

SEQ ID NO: 28269 - DNA, 15 bp, Homo sapiens
tgagtgattaggaat

SEQ ID NO: 28270 - DNA, 15 bp, Homo sapiens
ctgagtgattaggaa

SEQ ID NO: 28271 - DNA, 15 bp, Homo sapiens
tctgagtgattagga

SEQ ID NO: 28272 - DNA, 15 bp, Homo sapiens
ctctgagtgattagg

SEQ ID NO: 28273 - DNA, 15 bp, Homo sapiens
gctctgagtgattag

SEQ ID NO: 28274 - DNA, 15 bp, Homo sapiens
tgctctgagtgatta

SEQ ID NO: 28275 - DNA, 15 bp, Homo sapiens
ctgctctgagtgatt

SEQ ID NO: 28276 - DNA, 15 bp, Homo sapiens
actgctctgagtgat

SEQ ID NO: 28277 - DNA, 15 bp, Homo sapiens
gactgctctgagtga

SEQ ID NO: 28278 - DNA, 15 bp, Homo sapiens
agactgctctgagtg

SEQ ID NO: 28279 - DNA, 15 bp, Homo sapiens
cagactgctctgagt

SEQ ID NO: 28280 - DNA, 15 bp, Homo sapiens
acagactgctctgag

SEQ ID NO: 28281 - DNA, 15 bp, Homo sapiens
cacagactgctctga

SEQ ID NO: 28282 - DNA, 15 bp, Homo sapiens
tcacagactgctctg

SEQ ID NO: 28283 - DNA, 15 bp, Homo sapiens
gtcacagactgctct

SEQ ID NO: 28284 - DNA, 15 bp, Homo sapiens
agtcacagactgctc

SEQ ID NO: 28285 - DNA, 15 bp, Homo sapiens
aagtcacagactgct

SEQ ID NO: 28286 - DNA, 15 bp, Homo sapiens
taagtcacagactgc

SEQ ID NO: 28287 - DNA, 15 bp, Homo sapiens
ctaagtcacagactg

SEQ ID NO: 28288 - DNA, 15 bp, Homo sapiens
actaagtcacagact

SEQ ID NO: 28289 - DNA, 15 bp, Homo sapiens
cactaagtcacagac

SEQ ID NO: 28290 - DNA, 15 bp, Homo sapiens
ccactaagtcacaga

SEQ ID NO: 28291 - DNA, 15 bp, Homo sapiens
tccactaagtcacag

SEQ ID NO: 28292 - DNA, 15 bp, Homo sapiens
gtccactaagtcaca

SEQ ID NO: 28293 - DNA, 15 bp, Homo sapiens
tgtccactaagtcac

SEQ ID NO: 28294 - DNA, 15 bp, Homo sapiens
ctgtccactaagtca

SEQ ID NO: 28295 - DNA, 15 bp, Homo sapiens
cctgtccactaagtc

SEQ ID NO: 28296 - DNA, 15 bp, Homo sapiens
ccctgtccactaagt

SEQ ID NO: 28297 - DNA, 15 bp, Homo sapiens
cccctgtccactaag

SEQ ID NO: 28298 - DNA, 15 bp, Homo sapiens
tcccctgtccactaa

SEQ ID NO: 28299 - DNA, 15 bp, Homo sapiens
ctcccctgtccacta

SEQ ID NO: 28300 - DNA, 15 bp, Homo sapiens
cctcccctgtccact

SEQ ID NO: 28301 - DNA, 15 bp, Homo sapiens
ccctcccctgtccac

SEQ ID NO: 28302 - DNA, 15 bp, Homo sapiens
cccctcccctgtcca

SEQ ID NO: 28303 - DNA, 15 bp, Homo sapiens
ccccctcccctgtcc

SEQ ID NO: 28304 - DNA, 15 bp, Homo sapiens
gccccctcccctgtc

SEQ ID NO: 28305 - DNA, 15 bp, Homo sapiens
tgccccctcccctgt

SEQ ID NO: 28306 - DNA, 15 bp, Homo sapiens
ttgccccctcccctg

SEQ ID NO: 28307 - DNA, 15 bp, Homo sapiens
tttgccccctcccct

SEQ ID NO: 28308 - DNA, 15 bp, Homo sapiens
ctttgccccctcccc

SEQ ID NO: 28309 - DNA, 15 bp, Homo sapiens
cctttgccccctccc

SEQ ID NO: 28310 - DNA, 15 bp, Homo sapiens
ccctttgccccctcc

SEQ ID NO: 28311 - DNA, 15 bp, Homo sapiens
cccctttgccccctc

SEQ ID NO: 28312 - DNA, 15 bp, Homo sapiens
ccccctttgccccct

SEQ ID NO: 28313 - DNA, 15 bp, Homo sapiens
tccccctttgccccc

SEQ ID NO: 28314 - DNA, 15 bp, Homo sapiens
ctccccctttgcccc

SEQ ID NO: 28315 - DNA, 15 bp, Homo sapiens
cctccccctttgccc

SEQ ID NO: 28316 - DNA, 15 bp, Homo sapiens
tcctccccctttgcc

SEQ ID NO: 28317 - DNA, 15 bp, Homo sapiens
ctcctccccctttgc

SEQ ID NO: 28318 - DNA, 15 bp, Homo sapiens
tctcctccccctttg

SEQ ID NO: 28319 - DNA, 15 bp, Homo sapiens
ttctcctcccccttt

SEQ ID NO: 28320 - DNA, 15 bp, Homo sapiens
cttctcctccccctt

SEQ ID NO: 28321 - DNA, 15 bp, Homo sapiens
tcttctcctccccct

SEQ ID NO: 28322 - DNA, 15 bp, Homo sapiens
ttcttctcctccccc

SEQ ID NO: 28323 - DNA, 15 bp, Homo sapiens
tttcttctcctcccc

SEQ ID NO: 28324 - DNA, 15 bp, Homo sapiens
ttttcttctcctccc

SEQ ID NO: 28325 - DNA, 15 bp, Homo sapiens
attttcttctcctcc

SEQ ID NO: 28326 - DNA, 15 bp, Homo sapiens
cattttcttctcctc

SEQ ID NO: 28327 - DNA, 15 bp, Homo sapiens
acattttcttctcct

SEQ ID NO: 28328 - DNA, 15 bp, Homo sapiens
aacattttcttctcc

SEQ ID NO: 28329 - DNA, 15 bp, Homo sapiens
gaacattttcttctc

SEQ ID NO: 28330 - DNA, 15 bp, Homo sapiens
agaacattttcttct

SEQ ID NO: 28331 - DNA, 15 bp, Homo sapiens
aagaacattttcttc

SEQ ID NO: 28332 - DNA, 15 bp, Homo sapiens
gaagaacattttctt

SEQ ID NO: 28333 - DNA, 15 bp, Homo sapiens
ggaagaacattttct

SEQ ID NO: 28334 - DNA, 15 bp, Homo sapiens
tggaagaacattttc

SEQ ID NO: 28335 - DNA, 15 bp, Homo sapiens
ctggaagaacatttt

SEQ ID NO: 28336 - DNA, 15 bp, Homo sapiens
actggaagaacattt

SEQ ID NO: 28337 - DNA, 15 bp, Homo sapiens
aactggaagaacatt

SEQ ID NO: 28338 - DNA, 15 bp, Homo sapiens
taactggaagaacat

SEQ ID NO: 28339 - DNA, 15 bp, Homo sapiens
gtaactggaagaaca

SEQ ID NO: 28340 - DNA, 15 bp, Homo sapiens
agtaactggaagaac

SEQ ID NO: 28341 - DNA, 15 bp, Homo sapiens
aagtaactggaagaa

SEQ ID NO: 28342 - DNA, 15 bp, Homo sapiens
aaagtaactggaaga

SEQ ID NO: 28343 - DNA, 15 bp, Homo sapiens
gaaagtaactggaag

SEQ ID NO: 28344 - DNA, 15 bp, Homo sapiens
ggaaagtaactggaa

SEQ ID NO: 28345 - DNA, 15 bp, Homo sapiens
tggaaagtaactgga

SEQ ID NO: 28346 - DNA, 15 bp, Homo sapiens
ttggaaagtaactgg

SEQ ID NO: 28347 - DNA, 15 bp, Homo sapiens
attggaaagtaactg

SEQ ID NO: 28348 - DNA, 15 bp, Homo sapiens
aattggaaagtaact

SEQ ID NO: 28349 - DNA, 15 bp, Homo sapiens
gaattggaaagtaac

SEQ ID NO: 28350 - DNA, 15 bp, Homo sapiens
agaattggaaagtaa

SEQ ID NO: 28351 - DNA, 15 bp, Homo sapiens
gagaattggaaagta

SEQ ID NO: 28352 - DNA, 15 bp, Homo sapiens
ggagaattggaaagt

SEQ ID NO: 28353 - DNA, 15 bp, Homo sapiens
aggagaattggaaag

SEQ ID NO: 28354 - DNA, 15 bp, Homo sapiens
aaggagaattggaaa

SEQ ID NO: 28355 - DNA, 15 bp, Homo sapiens
aaaggagaattggaa

SEQ ID NO: 28356 - DNA, 15 bp, Homo sapiens
taaaggagaattgga

SEQ ID NO: 28357 - DNA, 15 bp, Homo sapiens
ctaaaggagaattgg

SEQ ID NO: 28358 - DNA, 15 bp, Homo sapiens
cctaaaggagaattg

SEQ ID NO: 28359 - DNA, 15 bp, Homo sapiens
ccctaaaggagaatt

SEQ ID NO: 28360 - DNA, 15 bp, Homo sapiens
tccctaaaggagaat

SEQ ID NO: 28361 - DNA, 15 bp, Homo sapiens
gtccctaaaggagaa

SEQ ID NO: 28362 - DNA, 15 bp, Homo sapiens
tgtccctaaaggaga

SEQ ID NO: 28363 - DNA, 15 bp, Homo sapiens
ctgtccctaaaggag

SEQ ID NO: 28364 - DNA, 15 bp, Homo sapiens
gctgtccctaaagga

SEQ ID NO: 28365 - DNA, 15 bp, Homo sapiens
agctgtccctaaagg

SEQ ID NO: 28366 - DNA, 15 bp, Homo sapiens
aagctgtccctaaag

SEQ ID NO: 28367 - DNA, 15 bp, Homo sapiens
taagctgtccctaaa

SEQ ID NO: 28368 - DNA, 15 bp, Homo sapiens
ctaagctgtccctaa

SEQ ID NO: 28369 - DNA, 15 bp, Homo sapiens
tctaagctgtcccta

SEQ ID NO: 28370 - DNA, 15 bp, Homo sapiens
ttctaagctgtccct

SEQ ID NO: 28371 - DNA, 15 bp, Homo sapiens
attctaagctgtccc

SEQ ID NO: 28372 - DNA, 15 bp, Homo sapiens
aattctaagctgtcc

SEQ ID NO: 28373 - DNA, 15 bp, Homo sapiens
taattctaagctgtc

SEQ ID NO: 28374 - DNA, 15 bp, Homo sapiens
ataattctaagctgt

SEQ ID NO: 28375 - DNA, 15 bp, Homo sapiens
aataattctaagctg

SEQ ID NO: 28376 - DNA, 15 bp, Homo sapiens
aaataattctaagct

SEQ ID NO: 28377 - DNA, 15 bp, Homo sapiens
caaataattctaagc

SEQ ID NO: 28378 - DNA, 15 bp, Homo sapiens
gcaaataattctaag

SEQ ID NO: 28379 - DNA, 15 bp, Homo sapiens
tgcaaataattctaa

SEQ ID NO: 28380 - DNA, 15 bp, Homo sapiens
gtgcaaataattcta

SEQ ID NO: 28381 - DNA, 15 bp, Homo sapiens
agtgcaaataattct

SEQ ID NO: 28382 - DNA, 15 bp, Homo sapiens
tagtgcaaataattc

SEQ ID NO: 28383 - DNA, 15 bp, Homo sapiens
atagtgcaaataatt

SEQ ID NO: 28384 - DNA, 15 bp, Homo sapiens
aatagtgcaaataat

SEQ ID NO: 28385 - DNA, 15 bp, Homo sapiens
caatagtgcaaataa

SEQ ID NO: 28386 - DNA, 15 bp, Homo sapiens
tcaatagtgcaaata

SEQ ID NO: 28387 - DNA, 15 bp, Homo sapiens
ctcaatagtgcaaat

SEQ ID NO: 28388 - DNA, 15 bp, Homo sapiens
actcaatagtgcaaa

SEQ ID NO: 28389 - DNA, 15 bp, Homo sapiens
gactcaatagtgcaa

SEQ ID NO: 28390 - DNA, 15 bp, Homo sapiens
agactcaatagtgca

SEQ ID NO: 28391 - DNA, 15 bp, Homo sapiens
aagactcaatagtgc

SEQ ID NO: 28392 - DNA, 15 bp, Homo sapiens
gaagactcaatagtg

SEQ ID NO: 28393 - DNA, 15 bp, Homo sapiens
tgaagactcaatagt

SEQ ID NO: 28394 - DNA, 15 bp, Homo sapiens
atgaagactcaatag

SEQ ID NO: 28395 - DNA, 15 bp, Homo sapiens
catgaagactcaata

SEQ ID NO: 28396 - DNA, 15 bp, Homo sapiens
acatgaagactcaat

SEQ ID NO: 28397 - DNA, 15 bp, Homo sapiens
aacatgaagactcaa

SEQ ID NO: 28398 - DNA, 15 bp, Homo sapiens
gaacatgaagactca

SEQ ID NO: 28399 - DNA, 15 bp, Homo sapiens
ggaacatgaagactc

SEQ ID NO: 28400 - DNA, 15 bp, Homo sapiens
gggaacatgaagact

SEQ ID NO: 28401 - DNA, 15 bp, Homo sapiens
tgggaacatgaagac

SEQ ID NO: 28402 - DNA, 15 bp, Homo sapiens
gtgggaacatgaaga

SEQ ID NO: 28403 - DNA, 15 bp, Homo sapiens
agtgggaacatgaag

SEQ ID NO: 28404 - DNA, 15 bp, Homo sapiens
aagtgggaacatgaa

SEQ ID NO: 28405 - DNA, 15 bp, Homo sapiens
gaagtgggaacatga

SEQ ID NO: 28406 - DNA, 15 bp, Homo sapiens
tgaagtgggaacatg

SEQ ID NO: 28407 - DNA, 15 bp, Homo sapiens
ttgaagtgggaacat

SEQ ID NO: 28408 - DNA, 15 bp, Homo sapiens
tttgaagtgggaaca

SEQ ID NO: 28409 - DNA, 15 bp, Homo sapiens
ttttgaagtgggaac

SEQ ID NO: 28410 - DNA, 15 bp, Homo sapiens
gttttgaagtgggaa

SEQ ID NO: 28411 - DNA, 15 bp, Homo sapiens
tgttttgaagtggga

SEQ ID NO: 28412 - DNA, 15 bp, Homo sapiens
ttgttttgaagtggg

SEQ ID NO: 28413 - DNA, 15 bp, Homo sapiens
tttgttttgaagtgg

SEQ ID NO: 28414 - DNA, 15 bp, Homo sapiens
gtttgttttgaagtg

SEQ ID NO: 28415 - DNA, 15 bp, Homo sapiens
tgtttgttttgaagt

SEQ ID NO: 28416 - DNA, 15 bp, Homo sapiens
ctgtttgttttgaag

SEQ ID NO: 28417 - DNA, 15 bp, Homo sapiens
tctgtttgttttgaa

SEQ ID NO: 28418 - DNA, 15 bp, Homo sapiens
atctgtttgttttga

SEQ ID NO: 28419 - DNA, 15 bp, Homo sapiens
catctgtttgttttg

SEQ ID NO: 28420 - DNA, 15 bp, Homo sapiens
gcatctgtttgtttt

SEQ ID NO: 28421 - DNA, 15 bp, Homo sapiens
agcatctgtttgttt

SEQ ID NO: 28422 - DNA, 15 bp, Homo sapiens
gagcatctgtttgtt

SEQ ID NO: 28423 - DNA, 15 bp, Homo sapiens
agagcatctgtttgt

SEQ ID NO: 28424 - DNA, 15 bp, Homo sapiens
cagagcatctgtttg

SEQ ID NO: 28425 - DNA, 15 bp, Homo sapiens
tcagagcatctgttt

SEQ ID NO: 28426 - DNA, 15 bp, Homo sapiens
ctcagagcatctgtt

SEQ ID NO: 28427 - DNA, 15 bp, Homo sapiens
tctcagagcatctgt

SEQ ID NO: 28428 - DNA, 15 bp, Homo sapiens
ctctcagagcatctg

SEQ ID NO: 28429 - DNA, 15 bp, Homo sapiens
gctctcagagcatct

SEQ ID NO: 28430 - DNA, 15 bp, Homo sapiens
tgctctcagagcatc

SEQ ID NO: 28431 - DNA, 15 bp, Homo sapiens
ttgctctcagagcat

SEQ ID NO: 28432 - DNA, 15 bp, Homo sapiens
tttgctctcagagca

SEQ ID NO: 28433 - DNA, 15 bp, Homo sapiens
gtttgctctcagagc

SEQ ID NO: 28434 - DNA, 15 bp, Homo sapiens
agtttgctctcagag

SEQ ID NO: 28435 - DNA, 15 bp, Homo sapiens
cagtttgctctcaga

SEQ ID NO: 28436 - DNA, 15 bp, Homo sapiens
ccagtttgctctcag

SEQ ID NO: 28437 - DNA, 15 bp, Homo sapiens
gccagtttgctctca

SEQ ID NO: 28438 - DNA, 15 bp, Homo sapiens
agccagtttgctctc

SEQ ID NO: 28439 - DNA, 15 bp, Homo sapiens
aagccagtttgctct

SEQ ID NO: 28440 - DNA, 15 bp, Homo sapiens
caagccagtttgctc

SEQ ID NO: 28441 - DNA, 15 bp, Homo sapiens
tcaagccagtttgct

SEQ ID NO: 28442 - DNA, 15 bp, Homo sapiens
ttcaagccagtttgc

SEQ ID NO: 28443 - DNA, 15 bp, Homo sapiens
attcaagccagtttg

SEQ ID NO: 28444 - DNA, 15 bp, Homo sapiens
aattcaagccagttt

SEQ ID NO: 28445 - DNA, 15 bp, Homo sapiens
caattcaagccagtt

SEQ ID NO: 28446 - DNA, 15 bp, Homo sapiens
ccaattcaagccagt

SEQ ID NO: 28447 - DNA, 15 bp, Homo sapiens
accaattcaagccag

SEQ ID NO: 28448 - DNA, 15 bp, Homo sapiens
caccaattcaagcca

SEQ ID NO: 28449 - DNA, 15 bp, Homo sapiens
tcaccaattcaagcc

SEQ ID NO: 28450 - DNA, 15 bp, Homo sapiens
gtcaccaattcaagc

SEQ ID NO: 28451 - DNA, 15 bp, Homo sapiens
tgtcaccaattcaag

SEQ ID NO: 28452 - DNA, 15 bp, Homo sapiens
atgtcaccaattcaa

SEQ ID NO: 28453 - DNA, 15 bp, Homo sapiens
aatgtcaccaattca

SEQ ID NO: 28454 - DNA, 15 bp, Homo sapiens
aaatgtcaccaattc

SEQ ID NO: 28455 - DNA, 15 bp, Homo sapiens
taaatgtcaccaatt

SEQ ID NO: 28456 - DNA, 15 bp, Homo sapiens
ctaaatgtcaccaat

SEQ ID NO: 28457 - DNA, 15 bp, Homo sapiens
actaaatgtcaccaa

SEQ ID NO: 28458 - DNA, 15 bp, Homo sapiens
gactaaatgtcacca

SEQ ID NO: 28459 - DNA, 15 bp, Homo sapiens
ggactaaatgtcacc

SEQ ID NO: 28460 - DNA, 15 bp, Homo sapiens
gggactaaatgtcac

SEQ ID NO: 28461 - DNA, 15 bp, Homo sapiens
agggactaaatgtca

SEQ ID NO: 28462 - DNA, 15 bp, Homo sapiens
gagggactaaatgtc

SEQ ID NO: 28463 - DNA, 15 bp, Homo sapiens
tgagggactaaatgt

SEQ ID NO: 28464 - DNA, 15 bp, Homo sapiens
ttgagggactaaatg

SEQ ID NO: 28465 - DNA, 15 bp, Homo sapiens
cttgagggactaaat

SEQ ID NO: 28466 - DNA, 15 bp, Homo sapiens
gcttgagggactaaa

SEQ ID NO: 28467 - DNA, 15 bp, Homo sapiens
ggcttgagggactaa

SEQ ID NO: 28468 - DNA, 15 bp, Homo sapiens
tggcttgagggacta

SEQ ID NO: 28469 - DNA, 15 bp, Homo sapiens
gtggcttgagggact

SEQ ID NO: 28470 - DNA, 15 bp, Homo sapiens
ggtggcttgagggac

SEQ ID NO: 28471 - DNA, 15 bp, Homo sapiens
tggtggcttgaggga

SEQ ID NO: 28472 - DNA, 15 bp, Homo sapiens
ctggtggcttgaggg

SEQ ID NO: 28473 - DNA, 15 bp, Homo sapiens
tctggtggcttgagg

SEQ ID NO: 28474 - DNA, 15 bp, Homo sapiens
atctggtggcttgag

SEQ ID NO: 28475 - DNA, 15 bp, Homo sapiens
catctggtggcttga

SEQ ID NO: 28476 - DNA, 15 bp, Homo sapiens
acatctggtggcttg

SEQ ID NO: 28477 - DNA, 15 bp, Homo sapiens
cacatctggtggctt

SEQ ID NO: 28478 - DNA, 15 bp, Homo sapiens
tcacatctggtggct

SEQ ID NO: 28479 - DNA, 15 bp, Homo sapiens
gtcacatctggtggc

SEQ ID NO: 28480 - DNA, 15 bp, Homo sapiens
tgtcacatctggtgg

SEQ ID NO: 28481 - DNA, 15 bp, Homo sapiens
ctgtcacatctggtg

SEQ ID NO: 28482 - DNA, 15 bp, Homo sapiens
actgtcacatctggt

SEQ ID NO: 28483 - DNA, 15 bp, Homo sapiens
cactgtcacatctgg

SEQ ID NO: 28484 - DNA, 15 bp, Homo sapiens
acactgtcacatctg

SEQ ID NO: 28485 - DNA, 15 bp, Homo sapiens
aacactgtcacatct

SEQ ID NO: 28486 - DNA, 15 bp, Homo sapiens
caacactgtcacatc

SEQ ID NO: 28487 - DNA, 15 bp, Homo sapiens
tcaacactgtcacat

SEQ ID NO: 28488 - DNA, 15 bp, Homo sapiens
ctcaacactgtcaca

SEQ ID NO: 28489 - DNA, 15 bp, Homo sapiens
tctcaacactgtcac

SEQ ID NO: 28490 - DNA, 15 bp, Homo sapiens
ttctcaacactgtca

SEQ ID NO: 28491 - DNA, 15 bp, Homo sapiens
gttctcaacactgtc

SEQ ID NO: 28492 - DNA, 15 bp, Homo sapiens
agttctcaacactgt

SEQ ID NO: 28493 - DNA, 15 bp, Homo sapiens
tagttctcaacactg

SEQ ID NO: 28494 - DNA, 15 bp, Homo sapiens
gtagttctcaacact

SEQ ID NO: 28495 - DNA, 15 bp, Homo sapiens
ggtagttctcaacac

SEQ ID NO: 28496 - DNA, 15 bp, Homo sapiens
aggtagttctcaaca

SEQ ID NO: 28497 - DNA, 15 bp, Homo sapiens
caggtagttctcaac

SEQ ID NO: 28498 - DNA, 15 bp, Homo sapiens
ccaggtagttctcaa

SEQ ID NO: 28499 - DNA, 15 bp, Homo sapiens
tccaggtagttctca

SEQ ID NO: 28500 - DNA, 15 bp, Homo sapiens
atccaggtagttctc

SEQ ID NO: 28501 - DNA, 15 bp, Homo sapiens
aatccaggtagttct

SEQ ID NO: 28502 - DNA, 15 bp, Homo sapiens
aaatccaggtagttc

SEQ ID NO: 28503 - DNA, 15 bp, Homo sapiens
caaatccaggtagtt

SEQ ID NO: 28504 - DNA, 15 bp, Homo sapiens
acaaatccaggtagt

SEQ ID NO: 28505 - DNA, 15 bp, Homo sapiens
tacaaatccaggtag

SEQ ID NO: 28506 - DNA, 15 bp, Homo sapiens
atacaaatccaggta

SEQ ID NO: 28507 - DNA, 15 bp, Homo sapiens
tatacaaatccaggt

SEQ ID NO: 28508 - DNA, 15 bp, Homo sapiens
atatacaaatccagg

SEQ ID NO: 28509 - DNA, 15 bp, Homo sapiens
tatatacaaatccag

SEQ ID NO: 28510 - DNA, 15 bp, Homo sapiens
atatatacaaatcca

SEQ ID NO: 28511 - DNA, 15 bp, Homo sapiens
tatatatacaaatcc

SEQ ID NO: 28512 - DNA, 15 bp, Homo sapiens
gtatatatacaaatc

SEQ ID NO: 28513 - DNA, 15 bp, Homo sapiens
ggtatatatacaaat

SEQ ID NO: 28514 - DNA, 15 bp, Homo sapiens
aggtatatatacaaa

SEQ ID NO: 28515 - DNA, 15 bp, Homo sapiens
caggtatatatacaa

SEQ ID NO: 28516 - DNA, 15 bp, Homo sapiens
gcaggtatatataca

SEQ ID NO: 28517 - DNA, 15 bp, Homo sapiens
cgcaggtatatatac

SEQ ID NO: 28518 - DNA, 15 bp, Homo sapiens
gcgcaggtatatata

SEQ ID NO: 28519 - DNA, 15 bp, Homo sapiens
agcgcaggtatatat

SEQ ID NO: 28520 - DNA, 15 bp, Homo sapiens
aagcgcaggtatata

SEQ ID NO: 28521 - DNA, 15 bp, Homo sapiens
caagcgcaggtatat

SEQ ID NO: 28522 - DNA, 15 bp, Homo sapiens
acaagcgcaggtata

SEQ ID NO: 28523 - DNA, 15 bp, Homo sapiens
aacaagcgcaggtat

SEQ ID NO: 28524 - DNA, 15 bp, Homo sapiens
aaacaagcgcaggta

SEQ ID NO: 28525 - DNA, 15 bp, Homo sapiens
aaaacaagcgcaggt

SEQ ID NO: 28526 - DNA, 15 bp, Homo sapiens
taaaacaagcgcagg

SEQ ID NO: 28527 - DNA, 15 bp, Homo sapiens
ttaaaacaagcgcag

SEQ ID NO: 28528 - DNA, 15 bp, Homo sapiens
tttaaaacaagcgca

SEQ ID NO: 28529 - DNA, 15 bp, Homo sapiens
ctttaaaacaagcgc

SEQ ID NO: 28530 - DNA, 15 bp, Homo sapiens
actttaaaacaagcg

SEQ ID NO: 28531 - DNA, 15 bp, Homo sapiens
cactttaaaacaagc

SEQ ID NO: 28532 - DNA, 15 bp, Homo sapiens
ccactttaaaacaag

SEQ ID NO: 28533 - DNA, 15 bp, Homo sapiens
cccactttaaaacaa

SEQ ID NO: 28534 - DNA, 15 bp, Homo sapiens
gcccactttaaaaca

SEQ ID NO: 28535 - DNA, 15 bp, Homo sapiens
agcccactttaaaac

SEQ ID NO: 28536 - DNA, 15 bp, Homo sapiens
gagcccactttaaaa

SEQ ID NO: 28537 - DNA, 15 bp, Homo sapiens
tgagcccactttaaa

SEQ ID NO: 28538 - DNA, 15 bp, Homo sapiens
ctgagcccactttaa

SEQ ID NO: 28539 - DNA, 15 bp, Homo sapiens
gctgagcccacttta

SEQ ID NO: 28540 - DNA, 15 bp, Homo sapiens
tgctgagcccacttt

SEQ ID NO: 28541 - DNA, 15 bp, Homo sapiens
gtgctgagcccactt

SEQ ID NO: 28542 - DNA, 15 bp, Homo sapiens
tgtgctgagcccact

SEQ ID NO: 28543 - DNA, 15 bp, Homo sapiens
atgtgctgagcccac

SEQ ID NO: 28544 - DNA, 15 bp, Homo sapiens
tatgtgctgagccca

SEQ ID NO: 28545 - DNA, 15 bp, Homo sapiens
ctatgtgctgagccc

SEQ ID NO: 28546 - DNA, 15 bp, Homo sapiens
cctatgtgctgagcc

SEQ ID NO: 28547 - DNA, 15 bp, Homo sapiens
ccctatgtgctgagc

SEQ ID NO: 28548 - DNA, 15 bp, Homo sapiens
accctatgtgctgag

SEQ ID NO: 28549 - DNA, 15 bp, Homo sapiens
aaccctatgtgctga

SEQ ID NO: 28550 - DNA, 15 bp, Homo sapiens
gaaccctatgtgctg

SEQ ID NO: 28551 - DNA, 15 bp, Homo sapiens
ggaaccctatgtgct

SEQ ID NO: 28552 - DNA, 15 bp, Homo sapiens
gggaaccctatgtgc

SEQ ID NO: 28553 - DNA, 15 bp, Homo sapiens
tgggaaccctatgtg

SEQ ID NO: 28554 - DNA, 15 bp, Homo sapiens
gtgggaaccctatgt

SEQ ID NO: 28555 - DNA, 15 bp, Homo sapiens
cgtgggaaccctatg

SEQ ID NO: 28556 - DNA, 15 bp, Homo sapiens
tcgtgggaaccctat

SEQ ID NO: 28557 - DNA, 15 bp, Homo sapiens
ttcgtgggaacccta

SEQ ID NO: 28558 - DNA, 15 bp, Homo sapiens
cttcgtgggaaccct

SEQ ID NO: 28559 - DNA, 15 bp, Homo sapiens
gcttcgtgggaaccc

SEQ ID NO: 28560 - DNA, 15 bp, Homo sapiens
agcttcgtgggaacc

SEQ ID NO: 28561 - DNA, 15 bp, Homo sapiens
gagcttcgtgggaac

SEQ ID NO: 28562 - DNA, 15 bp, Homo sapiens
ggagcttcgtgggaa

SEQ ID NO: 28563 - DNA, 15 bp, Homo sapiens
cggagcttcgtggga

SEQ ID NO: 28564 - DNA, 15 bp, Homo sapiens
tcggagcttcgtggg

SEQ ID NO: 28565 - DNA, 15 bp, Homo sapiens
ttcggagcttcgtgg

SEQ ID NO: 28566 - DNA, 15 bp, Homo sapiens
tttcggagcttcgtg

SEQ ID NO: 28567 - DNA, 15 bp, Homo sapiens
gtttcggagcttcgt

SEQ ID NO: 28568 - DNA, 15 bp, Homo sapiens
agtttcggagcttcg

SEQ ID NO: 28569 - DNA, 15 bp, Homo sapiens
gagtttcggagcttc

SEQ ID NO: 28570 - DNA, 15 bp, Homo sapiens
agagtttcggagctt

SEQ ID NO: 28571 - DNA, 15 bp, Homo sapiens
tagagtttcggagct

SEQ ID NO: 28572 - DNA, 15 bp, Homo sapiens
ttagagtttcggagc

SEQ ID NO: 28573 - DNA, 15 bp, Homo sapiens
cttagagtttcggag

SEQ ID NO: 28574 - DNA, 15 bp, Homo sapiens
acttagagtttcgga

SEQ ID NO: 28575 - DNA, 15 bp, Homo sapiens
cacttagagtttcgg

SEQ ID NO: 28576 - DNA, 15 bp, Homo sapiens
acacttagagtttcg

SEQ ID NO: 28577 - DNA, 15 bp, Homo sapiens
aacacttagagtttc

SEQ ID NO: 28578 - DNA, 15 bp, Homo sapiens
aaacacttagagttt

SEQ ID NO: 28579 - DNA, 15 bp, Homo sapiens
caaacacttagagtt

SEQ ID NO: 28580 - DNA, 15 bp, Homo sapiens
gcaaacacttagagt

SEQ ID NO: 28581 - DNA, 15 bp, Homo sapiens
agcaaacacttagag

SEQ ID NO: 28582 - DNA, 15 bp, Homo sapiens
cagcaaacacttaga

SEQ ID NO: 28583 - DNA, 15 bp, Homo sapiens
gcagcaaacacttag

SEQ ID NO: 28584 - DNA, 15 bp, Homo sapiens
tgcagcaaacactta

SEQ ID NO: 28585 - DNA, 15 bp, Homo sapiens
ttgcagcaaacactt

SEQ ID NO: 28586 - DNA, 15 bp, Homo sapiens
attgcagcaaacact

SEQ ID NO: 28587 - DNA, 15 bp, Homo sapiens
aattgcagcaaacac

SEQ ID NO: 28588 - DNA, 15 bp, Homo sapiens
aaattgcagcaaaca

SEQ ID NO: 28589 - DNA, 15 bp, Homo sapiens
aaaattgcagcaaac

SEQ ID NO: 28590 - DNA, 15 bp, Homo sapiens
taaaattgcagcaaa

SEQ ID NO: 28591 - DNA, 15 bp, Homo sapiens
ataaaattgcagcaa

SEQ ID NO: 28592 - DNA, 15 bp, Homo sapiens
tataaaattgcagca

SEQ ID NO: 28593 - DNA, 15 bp, Homo sapiens
ttataaaattgcagc

SEQ ID NO: 28594 - DNA, 15 bp, Homo sapiens
cttataaaattgcag

SEQ ID NO: 28595 - DNA, 15 bp, Homo sapiens
ccttataaaattgca

SEQ ID NO: 28596 - DNA, 15 bp, Homo sapiens
tccttataaaattgc

SEQ ID NO: 28597 - DNA, 15 bp, Homo sapiens
gtccttataaaattg

SEQ ID NO: 28598 - DNA, 15 bp, Homo sapiens
agtccttataaaatt

SEQ ID NO: 28599 - DNA, 15 bp, Homo sapiens
aagtccttataaaat

SEQ ID NO: 28600 - DNA, 15 bp, Homo sapiens
gaagtccttataaaa

SEQ ID NO: 28601 - DNA, 15 bp, Homo sapiens
ggaagtccttataaa

SEQ ID NO: 28602 - DNA, 15 bp, Homo sapiens
aggaagtccttataa

SEQ ID NO: 28603 - DNA, 15 bp, Homo sapiens
caggaagtccttata

SEQ ID NO: 28604 - DNA, 15 bp, Homo sapiens
atcaggaagtcctta

SEQ ID NO: 28605 - DNA, 15 bp, Homo sapiens
aatcaggaagtcctt

SEQ ID NO: 28606 - DNA, 15 bp, Homo sapiens
caatcaggaagtcct

SEQ ID NO: 28607 - DNA, 15 bp, Homo sapiens
ccaatcaggaagtcc

SEQ ID NO: 28608 - DNA, 15 bp, Homo sapiens
accaatcaggaagtc

SEQ ID NO: 28609 - DNA, 15 bp, Homo sapiens
aaccaatcaggaagt

SEQ ID NO: 28610 - DNA, 15 bp, Homo sapiens
aaaccaatcaggaag

SEQ ID NO: 28611 - DNA, 15 bp, Homo sapiens
gaaaccaatcaggaa

SEQ ID NO: 28612 - DNA, 15 bp, Homo sapiens
agaaaccaatcagga

SEQ ID NO: 28613 - DNA, 15 bp, Homo sapiens
gagaaaccaatcagg

SEQ ID NO: 28614 - DNA, 15 bp, Homo sapiens
agagaaaccaatcag

SEQ ID NO: 28615 - DNA, 15 bp, Homo sapiens
aagagaaaccaatca

SEQ ID NO: 28616 - DNA, 15 bp, Homo sapiens
gaagagaaaccaatc

SEQ ID NO: 28617 - DNA, 15 bp, Homo sapiens
agaagagaaaccaat

SEQ ID NO: 28618 - DNA, 15 bp, Homo sapiens
gagaagagaaaccaa

SEQ ID NO: 28619 - DNA, 15 bp, Homo sapiens
ggagaagagaaacca

SEQ ID NO: 28620 - DNA, 15 bp, Homo sapiens
gggagaagagaaacc

SEQ ID NO: 28621 - DNA, 15 bp, Homo sapiens
ggggagaagagaaac

SEQ ID NO: 28622 - DNA, 15 bp, Homo sapiens
aggggagaagagaaa

SEQ ID NO: 28623 - DNA, 15 bp, Homo sapiens
aaggggagaagagaa

SEQ ID NO: 28624 - DNA, 15 bp, Homo sapiens
gaaggggagaagaga

SEQ ID NO: 28625 - DNA, 15 bp, Homo sapiens
ggaaggggagaagag

SEQ ID NO: 28626 - DNA, 15 bp, Homo sapiens
tggaaggggagaaga

SEQ ID NO: 28627 - DNA, 15 bp, Homo sapiens
atggaaggggagaag

SEQ ID NO: 28628 - DNA, 15 bp, Homo sapiens
aatggaaggggagaa

SEQ ID NO: 28629 - DNA, 15 bp, Homo sapiens
aaatggaaggggaga

SEQ ID NO: 28630 - DNA, 15 bp, Homo sapiens
gaaatggaaggggag

SEQ ID NO: 28631 - DNA, 15 bp, Homo sapiens
agaaatggaagggga

SEQ ID NO: 28632 - DNA, 15 bp, Homo sapiens
cagaaatggaagggg

SEQ ID NO: 28633 - DNA, 15 bp, Homo sapiens
gcagaaatggaaggg

SEQ ID NO: 28634 - DNA, 15 bp, Homo sapiens
ggcagaaatggaagg

SEQ ID NO: 28635 - DNA, 15 bp, Homo sapiens
aggcagaaatggaag

SEQ ID NO: 28636 - DNA, 15 bp, Homo sapiens
aaggcagaaatggaa

SEQ ID NO: 28637 - DNA, 15 bp, Homo sapiens
aaaggcagaaatgga

SEQ ID NO: 28638 - DNA, 15 bp, Homo sapiens
aaaaggcagaaatgg

SEQ ID NO: 28639 - DNA, 15 bp, Homo sapiens
caaaaggcagaaatg

SEQ ID NO: 28640 - DNA, 15 bp, Homo sapiens
acaaaaggcagaaat

SEQ ID NO: 28641 - DNA, 15 bp, Homo sapiens
aacaaaaggcagaaa

SEQ ID NO: 28642 - DNA, 15 bp, Homo sapiens
gaacaaaaggcagaa

SEQ ID NO: 28643 - DNA, 15 bp, Homo sapiens
tgaacaaaaggcaga

SEQ ID NO: 28644 - DNA, 15 bp, Homo sapiens
atgaacaaaaggcag

SEQ ID NO: 28645 - DNA, 15 bp, Homo sapiens
aatgaacaaaaggca

SEQ ID NO: 28646 - DNA, 15 bp, Homo sapiens
aaatgaacaaaaggc

SEQ ID NO: 28647 - DNA, 15 bp, Homo sapiens
gaaatgaacaaaagg

SEQ ID NO: 28648 - DNA, 15 bp, Homo sapiens
tgaaatgaacaaaag

SEQ ID NO: 28649 - DNA, 15 bp, Homo sapiens
atgaaatgaacaaaa

SEQ ID NO: 28650 - DNA, 15 bp, Homo sapiens
gatgaaatgaacaaa

SEQ ID NO: 28651 - DNA, 15 bp, Homo sapiens
ggatgaaatgaacaa

SEQ ID NO: 28652 - DNA, 15 bp, Homo sapiens
aggatgaaatgaaca

SEQ ID NO: 28653 - DNA, 15 bp, Homo sapiens
aaggatgaaatgaac

SEQ ID NO: 28654 - DNA, 15 bp, Homo sapiens
aaaggatgaaatgaa

SEQ ID NO: 28655 - DNA, 15 bp, Homo sapiens
gaaaggatgaaatga

SEQ ID NO: 28656 - DNA, 15 bp, Homo sapiens
tgaaaggatgaaatg

SEQ ID NO: 28657 - DNA, 15 bp, Homo sapiens
gtgaaaggatgaaat

SEQ ID NO: 28658 - DNA, 15 bp, Homo sapiens
agtgaaaggatgaaa

SEQ ID NO: 28659 - DNA, 15 bp, Homo sapiens
aagtgaaaggatgaa

SEQ ID NO: 28660 - DNA, 15 bp, Homo sapiens
gaagtgaaaggatga

SEQ ID NO: 28661 - DNA, 15 bp, Homo sapiens
agaagtgaaaggatg

SEQ ID NO: 28662 - DNA, 15 bp, Homo sapiens
aagaagtgaaaggat

SEQ ID NO: 28663 - DNA, 15 bp, Homo sapiens
aaagaagtgaaagga

SEQ ID NO: 28664 - DNA, 15 bp, Homo sapiens
gaaagaagtgaaagg

SEQ ID NO: 28665 - DNA, 15 bp, Homo sapiens
ggaaagaagtgaaag

SEQ ID NO: 28666 - DNA, 15 bp, Homo sapiens
gggaaagaagtgaaa

SEQ ID NO: 28667 - DNA, 15 bp, Homo sapiens
agggaaagaagtgaa

SEQ ID NO: 28668 - DNA, 15 bp, Homo sapiens
aagggaaagaagtga

SEQ ID NO: 28669 - DNA, 15 bp, Homo sapiens
gaagggaaagaagtg

SEQ ID NO: 28670 - DNA, 15 bp, Homo sapiens
ggaagggaaagaagt

SEQ ID NO: 28671 - DNA, 15 bp, Homo sapiens
aggaagggaaagaag

SEQ ID NO: 28672 - DNA, 15 bp, Homo sapiens
gaggaagggaaagaa

SEQ ID NO: 28673 - DNA, 15 bp, Homo sapiens
ggaggaagggaaaga

SEQ ID NO: 28674 - DNA, 15 bp, Homo sapiens
tggaggaagggaaag

SEQ ID NO: 28675 - DNA, 15 bp, Homo sapiens
atggaggaagggaaa

SEQ ID NO: 28676 - DNA, 15 bp, Homo sapiens
gatggaggaagggaa

SEQ ID NO: 28677 - DNA, 15 bp, Homo sapiens
ggatggaggaaggga

SEQ ID NO: 28678 - DNA, 15 bp, Homo sapiens
aggatggaggaaggg

SEQ ID NO: 28679 - DNA, 15 bp, Homo sapiens
gaggatggaggaagg

SEQ ID NO: 28680 - DNA, 15 bp, Homo sapiens
ggaggatggaggaag

SEQ ID NO: 28681 - DNA, 15 bp, Homo sapiens
aggaggatggaggaa

SEQ ID NO: 28682 - DNA, 15 bp, Homo sapiens
gaggaggatggagga

SEQ ID NO: 28683 - DNA, 15 bp, Homo sapiens
ggaggaggatggagg

SEQ ID NO: 28684 - DNA, 15 bp, Homo sapiens
aggaggaggatggag

SEQ ID NO: 28685 - DNA, 15 bp, Homo sapiens
aaggaggaggatgga

SEQ ID NO: 28686 - DNA, 15 bp, Homo sapiens
gaaggaggaggatgg

SEQ ID NO: 28687 - DNA, 15 bp, Homo sapiens
ggaaggaggaggatg

SEQ ID NO: 28688 - DNA, 15 bp, Homo sapiens
aggaaggaggaggat

SEQ ID NO: 28689 - DNA, 15 bp, Homo sapiens
taggaaggaggagga

SEQ ID NO: 28690 - DNA, 15 bp, Homo sapiens
ctaggaaggaggagg

SEQ ID NO: 28691 - DNA, 15 bp, Homo sapiens
actaggaaggaggag

SEQ ID NO: 28692 - DNA, 15 bp, Homo sapiens
aactaggaaggagga

SEQ ID NO: 28693 - DNA, 15 bp, Homo sapiens
gaactaggaaggagg

SEQ ID NO: 28694 - DNA, 15 bp, Homo sapiens
tgaactaggaaggag

SEQ ID NO: 28695 - DNA, 15 bp, Homo sapiens
atgaactaggaagga

SEQ ID NO: 28696 - DNA, 15 bp, Homo sapiens
gatgaactaggaagg

SEQ ID NO: 28697 - DNA, 15 bp, Homo sapiens
ggatgaactaggaag

SEQ ID NO: 28698 - DNA, 15 bp, Homo sapiens
gggatgaactaggaa

SEQ ID NO: 28699 - DNA, 15 bp, Homo sapiens
agggatgaactagga

SEQ ID NO: 28700 - DNA, 15 bp, Homo sapiens
aagggatgaactagg

SEQ ID NO: 28701 - DNA, 15 bp, Homo sapiens
gaagggatgaactag

SEQ ID NO: 28702 - DNA, 15 bp, Homo sapiens
agaagggatgaacta

SEQ ID NO: 28703 - DNA, 15 bp, Homo sapiens
gagaagggatgaact

SEQ ID NO: 28704 - DNA, 15 bp, Homo sapiens
agagaagggatgaac

SEQ ID NO: 28705 - DNA, 15 bp, Homo sapiens
aagagaagggatgaa

SEQ ID NO: 28706 - DNA, 15 bp, Homo sapiens
gaagagaagggatga

SEQ ID NO: 28707 - DNA, 15 bp, Homo sapiens
ggaagagaagggatg

SEQ ID NO: 28708 - DNA, 15 bp, Homo sapiens
tggaagagaagggat

SEQ ID NO: 28709 - DNA, 15 bp, Homo sapiens
ctggaagagaaggga

SEQ ID NO: 28710 - DNA, 15 bp, Homo sapiens
cctggaagagaaggg

SEQ ID NO: 28711 - DNA, 15 bp, Homo sapiens
gcctggaagagaagg

SEQ ID NO: 28712 - DNA, 15 bp, Homo sapiens
tgcctggaagagaag

SEQ ID NO: 28713 - DNA, 15 bp, Homo sapiens
ctgcctggaagagaa

SEQ ID NO: 28714 - DNA, 15 bp, Homo sapiens
gctgcctggaagaga

SEQ ID NO: 28715 - DNA, 15 bp, Homo sapiens
ggctgcctggaagag

SEQ ID NO: 28716 - DNA, 15 bp, Homo sapiens
cggctgcctggaaga

SEQ ID NO: 28717 - DNA, 15 bp, Homo sapiens
gcggctgcctggaag

SEQ ID NO: 28718 - DNA, 15 bp, Homo sapiens
cgcggctgcctggaa

SEQ ID NO: 28719 - DNA, 15 bp, Homo sapiens
ccgcggctgcctgga

SEQ ID NO: 28720 - DNA, 15 bp, Homo sapiens
accgcggctgcctgg

SEQ ID NO: 28721 - DNA, 15 bp, Homo sapiens
caccgcggctgcctg

SEQ ID NO: 28722 - DNA, 15 bp, Homo sapiens
gcaccgcggctgcct

SEQ ID NO: 28723 - DNA, 15 bp, Homo sapiens
ggcaccgcggctgcc

SEQ ID NO: 28724 - DNA, 15 bp, Homo sapiens
gggcaccgcggctgc

SEQ ID NO: 28725 - DNA, 15 bp, Homo sapiens
tgggcaccgcggctg

SEQ ID NO: 28726 - DNA, 15 bp, Homo sapiens
ttgggcaccgcggct

SEQ ID NO: 28727 - DNA, 15 bp, Homo sapiens
gttgggcaccgcggc

SEQ ID NO: 28728 - DNA, 15 bp, Homo sapiens
ggttgggcaccgcgg

SEQ ID NO: 28729 - DNA, 15 bp, Homo sapiens
tggttgggcaccgcg

SEQ ID NO: 28730 - DNA, 15 bp, Homo sapiens
gtggttgggcaccgc

SEQ ID NO: 28731 - DNA, 15 bp, Homo sapiens
tgtggttgggcaccg

SEQ ID NO: 28732 - DNA, 15 bp, Homo sapiens
gtgtggttgggcacc

SEQ ID NO: 28733 - DNA, 15 bp, Homo sapiens
agtgtggttgggcac

SEQ ID NO: 28734 - DNA, 15 bp, Homo sapiens
aagtgtggttgggca

SEQ ID NO: 28735 - DNA, 15 bp, Homo sapiens
caagtgtggttgggc

SEQ ID NO: 28736 - DNA, 15 bp, Homo sapiens
acaagtgtggttggg

SEQ ID NO: 28737 - DNA, 15 bp, Homo sapiens
gacaagtgtggttgg

SEQ ID NO: 28738 - DNA, 15 bp, Homo sapiens
cgacaagtgtggttg

SEQ ID NO: 28739 - DNA, 15 bp, Homo sapiens
ccgacaagtgtggtt

SEQ ID NO: 28740 - DNA, 15 bp, Homo sapiens
gccgacaagtgtggt

SEQ ID NO: 28741 - DNA, 15 bp, Homo sapiens
agccgacaagtgtgg

SEQ ID NO: 28742 - DNA, 15 bp, Homo sapiens
gagccgacaagtgtg

SEQ ID NO: 28743 - DNA, 15 bp, Homo sapiens
ggagccgacaagtgt

SEQ ID NO: 28744 - DNA, 15 bp, Homo sapiens
tggagccgacaagtg

SEQ ID NO: 28745 - DNA, 15 bp, Homo sapiens
ctggagccgacaagt

SEQ ID NO: 28746 - DNA, 15 bp, Homo sapiens
actggagccgacaag

SEQ ID NO: 28747 - DNA, 15 bp, Homo sapiens
gactggagccgacaa

SEQ ID NO: 28748 - DNA, 15 bp, Homo sapiens
ggactggagccgaca

SEQ ID NO: 28749 - DNA, 15 bp, Homo sapiens
gggactggagccgac

SEQ ID NO: 28750 - DNA, 15 bp, Homo sapiens
ggggactggagccga

SEQ ID NO: 28751 - DNA, 15 bp, Homo sapiens
tggggactggagccg

SEQ ID NO: 28752 - DNA, 15 bp, Homo sapiens
ctggggactggagcc

SEQ ID NO: 28753 - DNA, 15 bp, Homo sapiens
tctggggactggagc

SEQ ID NO: 28754 - DNA, 15 bp, Homo sapiens
ttctggggactggag

SEQ ID NO: 28755 - DNA, 15 bp, Homo sapiens
gttctggggactgga

SEQ ID NO: 28756 - DNA, 15 bp, Homo sapiens
agttctggggactgg

SEQ ID NO: 28757 - DNA, 15 bp, Homo sapiens
gagttctggggactg

SEQ ID NO: 28758 - DNA, 15 bp, Homo sapiens
agagttctggggact

SEQ ID NO: 28759 - DNA, 15 bp, Homo sapiens
cagagttctggggac

SEQ ID NO: 28760 - DNA, 15 bp, Homo sapiens
gcagagttctgggga

SEQ ID NO: 28761 - DNA, 15 bp, Homo sapiens
ggcagagttctgggg

SEQ ID NO: 28762 - DNA, 15 bp, Homo sapiens
aggcagagttctggg

SEQ ID NO: 28763 - DNA, 15 bp, Homo sapiens
caggcagagttctgg

SEQ ID NO: 28764 - DNA, 15 bp, Homo sapiens
gcaggcagagttctg

SEQ ID NO: 28765 - DNA, 15 bp, Homo sapiens
ggcaggcagagttct

SEQ ID NO: 28766 - DNA, 15 bp, Homo sapiens
gggcaggcagagttc

SEQ ID NO: 28767 - DNA, 15 bp, Homo sapiens
agggcaggcagagtt

SEQ ID NO: 28768 - DNA, 15 bp, Homo sapiens
aagggcaggcagagt

SEQ ID NO: 28769 - DNA, 15 bp, Homo sapiens
aaagggcaggcagag

SEQ ID NO: 28770 - DNA, 15 bp, Homo sapiens
caaagggcaggcaga

SEQ ID NO: 28771 - DNA, 15 bp, Homo sapiens
acaaagggcaggcag

SEQ ID NO: 28772 - DNA, 15 bp, Homo sapiens
gacaaagggcaggca

SEQ ID NO: 28773 - DNA, 15 bp, Homo sapiens
ggacaaagggcaggc

SEQ ID NO: 28774 - DNA, 15 bp, Homo sapiens
aggacaaagggcagg

SEQ ID NO: 28775 - DNA, 15 bp, Homo sapiens
gaggacaaagggcag

SEQ ID NO: 28776 - DNA, 15 bp, Homo sapiens
ggaggacaaagggca

SEQ ID NO: 28777 - DNA, 15 bp, Homo sapiens
aggaggacaaagggc

SEQ ID NO: 28778 - DNA, 15 bp, Homo sapiens
caggaggacaaaggg

SEQ ID NO: 28779 - DNA, 15 bp, Homo sapiens
gcaggaggacaaagg

SEQ ID NO: 28780 - DNA, 15 bp, Homo sapiens
agcaggaggacaaag

SEQ ID NO: 28781 - DNA, 15 bp, Homo sapiens
cagcaggaggacaaa

SEQ ID NO: 28782 - DNA, 15 bp, Homo sapiens
gcagcaggaggacaa

SEQ ID NO: 28783 - DNA, 15 bp, Homo sapiens
ggcagcaggaggaca

SEQ ID NO: 28784 - DNA, 15 bp, Homo sapiens
tggcagcaggaggac

SEQ ID NO: 28785 - DNA, 15 bp, Homo sapiens
ctggcagcaggagga

SEQ ID NO: 28786 - DNA, 15 bp, Homo sapiens
actggcagcaggagg

SEQ ID NO: 28787 - DNA, 15 bp, Homo sapiens
tactggcagcaggag

SEQ ID NO: 28788 - DNA, 15 bp, Homo sapiens
gtactggcagcagga

SEQ ID NO: 28789 - DNA, 15 bp, Homo sapiens
ggtactggcagcagg

SEQ ID NO: 28790 - DNA, 15 bp, Homo sapiens
tggtactggcagcag

SEQ ID NO: 28791 - DNA, 15 bp, Homo sapiens
ctggtactggcagca

SEQ ID NO: 28792 - DNA, 15 bp, Homo sapiens
gctggtactggcagc

SEQ ID NO: 28793 - DNA, 15 bp, Homo sapiens
ggctggtactggcag

SEQ ID NO: 28794 - DNA, 15 bp, Homo sapiens
gggctggtactggca

SEQ ID NO: 28795 - DNA, 15 bp, Homo sapiens
ggggctggtactggc

SEQ ID NO: 28796 - DNA, 15 bp, Homo sapiens
tggggctggtactgg

SEQ ID NO: 28797 - DNA, 15 bp, Homo sapiens
gtggggctggtactg

SEQ ID NO: 28798 - DNA, 15 bp, Homo sapiens
ggtggggctggtact

SEQ ID NO: 28799 - DNA, 15 bp, Homo sapiens
gggtggggctggtac

SEQ ID NO: 28800 - DNA, 15 bp, Homo sapiens
agggtggggctggta

SEQ ID NO: 28801 - DNA, 15 bp, Homo sapiens
cagggtggggctggt

SEQ ID NO: 28802 - DNA, 15 bp, Homo sapiens
acagggtggggctgg

SEQ ID NO: 28803 - DNA, 15 bp, Homo sapiens
aacagggtggggctg

SEQ ID NO: 28804 - DNA, 15 bp, Homo sapiens
aaacagggtggggct

SEQ ID NO: 28805 - DNA, 15 bp, Homo sapiens
aaaacagggtggggc

SEQ ID NO: 28806 - DNA, 15 bp, Homo sapiens
caaaacagggtgggg

SEQ ID NO: 28807 - DNA, 15 bp, Homo sapiens
tcaaaacagggtggg

SEQ ID NO: 28808 - DNA, 15 bp, Homo sapiens
ctcaaaacagggtgg

SEQ ID NO: 28809 - DNA, 15 bp, Homo sapiens
gctcaaaacagggtg

SEQ ID NO: 28810 - DNA, 15 bp, Homo sapiens
ggctcaaaacagggt

SEQ ID NO: 28811 - DNA, 15 bp, Homo sapiens
gggctcaaaacaggg

SEQ ID NO: 28812 - DNA, 15 bp, Homo sapiens
agggctcaaaacagg

SEQ ID NO: 28813 - DNA, 15 bp, Homo sapiens
cagggctcaaaacag

SEQ ID NO: 28814 - DNA, 15 bp, Homo sapiens
tcagggctcaaaaca

SEQ ID NO: 28815 - DNA, 15 bp, Homo sapiens
ctcagggctcaaaac

SEQ ID NO: 28816 - DNA, 15 bp, Homo sapiens
cctcagggctcaaaa

SEQ ID NO: 28817 - DNA, 15 bp, Homo sapiens
tcctcagggctcaaa

SEQ ID NO: 28818 - DNA, 15 bp, Homo sapiens
ctcctcagggctcaa

SEQ ID NO: 28819 - DNA, 15 bp, Homo sapiens
cctcctcagggctca

SEQ ID NO: 28820 - DNA, 15 bp, Homo sapiens
gcctcctcagggctc

SEQ ID NO: 28821 - DNA, 15 bp, Homo sapiens
ggcctcctcagggct

SEQ ID NO: 28822 - DNA, 15 bp, Homo sapiens
aggcctcctcagggc

SEQ ID NO: 28823 - DNA, 15 bp, Homo sapiens
aaggcctcctcaggg

SEQ ID NO: 28824 - DNA, 15 bp, Homo sapiens
caaggcctcctcagg

SEQ ID NO: 28825 - DNA, 15 bp, Homo sapiens
ccaaggcctcctcag

SEQ ID NO: 28826 - DNA, 15 bp, Homo sapiens
cccaaggcctcctca

SEQ ID NO: 28827 - DNA, 15 bp, Homo sapiens
gcccaaggcctcctc

SEQ ID NO: 28828 - DNA, 15 bp, Homo sapiens
agcccaaggcctcct

SEQ ID NO: 28829 - DNA, 15 bp, Homo sapiens
gagcccaaggcctcc

SEQ ID NO: 28830 - DNA, 15 bp, Homo sapiens
agagcccaaggcctc

SEQ ID NO: 28831 - DNA, 15 bp, Homo sapiens
cagagcccaaggcct

SEQ ID NO: 28832 - DNA, 15 bp, Homo sapiens
gcagagcccaaggcc

SEQ ID NO: 28833 - DNA, 15 bp, Homo sapiens
agcagagcccaaggc

SEQ ID NO: 28834 - DNA, 15 bp, Homo sapiens
cagcagagcccaagg

SEQ ID NO: 28835 - DNA, 15 bp, Homo sapiens
tcagcagagcccaag

SEQ ID NO: 28836 - DNA, 15 bp, Homo sapiens
ctcagcagagcccaa

SEQ ID NO: 28837 - DNA, 15 bp, Homo sapiens
actcagcagagccca

SEQ ID NO: 28838 - DNA, 15 bp, Homo sapiens
gactcagcagagccc

SEQ ID NO: 28839 - DNA, 15 bp, Homo sapiens
ggactcagcagagcc

SEQ ID NO: 28840 - DNA, 15 bp, Homo sapiens
cggactcagcagagc

SEQ ID NO: 28841 - DNA, 15 bp, Homo sapiens
tcggactcagcagag

SEQ ID NO: 28842 - DNA, 15 bp, Homo sapiens
gtcggactcagcaga

SEQ ID NO: 28843 - DNA, 15 bp, Homo sapiens
ggtcggactcagcag

SEQ ID NO: 28844 - DNA, 15 bp, Homo sapiens
aggtcggactcagca

SEQ ID NO: 28845 - DNA, 15 bp, Homo sapiens
caggtcggactcagc

SEQ ID NO: 28846 - DNA, 15 bp, Homo sapiens
ccaggtcggactcag

SEQ ID NO: 28847 - DNA, 15 bp, Homo sapiens
gccaggtcggactca

SEQ ID NO: 28848 - DNA, 15 bp, Homo sapiens
ggccaggtcggactc

SEQ ID NO: 28849 - DNA, 15 bp, Homo sapiens
aggccaggtcggact

SEQ ID NO: 28850 - DNA, 15 bp, Homo sapiens
caggccaggtcggac

SEQ ID NO: 28851 - DNA, 15 bp, Homo sapiens
acaggccaggtcgga

SEQ ID NO: 28852 - DNA, 15 bp, Homo sapiens
gacaggccaggtcgg

SEQ ID NO: 28853 - DNA, 15 bp, Homo sapiens
agacaggccaggtcg

SEQ ID NO: 28854 - DNA, 15 bp, Homo sapiens
cagacaggccaggtc

SEQ ID NO: 28855 - DNA, 15 bp, Homo sapiens
acagacaggccaggt

SEQ ID NO: 28856 - DNA, 15 bp, Homo sapiens
cacagacaggccagg

SEQ ID NO: 28857 - DNA, 15 bp, Homo sapiens
tcacagacaggccag

SEQ ID NO: 28858 - DNA, 15 bp, Homo sapiens
ttcacagacaggcca

SEQ ID NO: 28859 - DNA, 15 bp, Homo sapiens
cttcacagacaggcc

SEQ ID NO: 28860 - DNA, 15 bp, Homo sapiens
tcttcacagacaggc

SEQ ID NO: 28861 - DNA, 15 bp, Homo sapiens
ctcttcacagacagg

SEQ ID NO: 28862 - DNA, 15 bp, Homo sapiens
gctcttcacagacag

SEQ ID NO: 28863 - DNA, 15 bp, Homo sapiens
tgctcttcacagaca

SEQ ID NO: 28864 - DNA, 15 bp, Homo sapiens
ttgctcttcacagac

SEQ ID NO: 28865 - DNA, 15 bp, Homo sapiens
cttgctcttcacaga

SEQ ID NO: 28866 - DNA, 15 bp, Homo sapiens
tcttgctcttcacag

SEQ ID NO: 28867 - DNA, 15 bp, Homo sapiens
ctcttgctcttcaca

SEQ ID NO: 28868 - DNA, 15 bp, Homo sapiens
tctcttgctcttcac

SEQ ID NO: 28869 - DNA, 15 bp, Homo sapiens
ctctcttgctcttca

SEQ ID NO: 28870 - DNA, 15 bp, Homo sapiens
gctctcttgctcttc

SEQ ID NO: 28871 - DNA, 15 bp, Homo sapiens
tgctctcttgctctt

SEQ ID NO: 28872 - DNA, 15 bp, Homo sapiens
ctgctctcttgctct

SEQ ID NO: 28873 - DNA, 15 bp, Homo sapiens
gctgctctcttgctc

SEQ ID NO: 28874 - DNA, 15 bp, Homo sapiens
tgctgctctcttgct

SEQ ID NO: 28875 - DNA, 15 bp, Homo sapiens
ttgctgctctcttgc

SEQ ID NO: 28876 - DNA, 15 bp, Homo sapiens
cttgctgctctcttg

SEQ ID NO: 28877 - DNA, 15 bp, Homo sapiens
ccttgctgctctctt

SEQ ID NO: 28878 - DNA, 15 bp, Homo sapiens
accttgctgctctct

SEQ ID NO: 28879 - DNA, 15 bp, Homo sapiens
gaccttgctgctctc

SEQ ID NO: 28880 - DNA, 15 bp, Homo sapiens
agaccttgctgctct

SEQ ID NO: 28881 - DNA, 15 bp, Homo sapiens
aagaccttgctgctc

SEQ ID NO: 28882 - DNA, 15 bp, Homo sapiens
caagaccttgctgct

SEQ ID NO: 28883 - DNA, 15 bp, Homo sapiens
gcaagaccttgctgc

SEQ ID NO: 28884 - DNA, 15 bp, Homo sapiens
agcaagaccttgctg

SEQ ID NO: 28885 - DNA, 15 bp, Homo sapiens
gagcaagaccttgct

SEQ ID NO: 28886 - DNA, 15 bp, Homo sapiens
agagcaagaccttgc

SEQ ID NO: 28887 - DNA, 15 bp, Homo sapiens
gagagcaagaccttg

SEQ ID NO: 28888 - DNA, 15 bp, Homo sapiens
ggagagcaagacctt

SEQ ID NO: 28889 - DNA, 15 bp, Homo sapiens
aggagagcaagacct

SEQ ID NO: 28890 - DNA, 15 bp, Homo sapiens
taggagagcaagacc

SEQ ID NO: 28891 - DNA, 15 bp, Homo sapiens
ctaggagagcaagac

SEQ ID NO: 28892 - DNA, 15 bp, Homo sapiens
cctaggagagcaaga

SEQ ID NO: 28893 - DNA, 15 bp, Homo sapiens
acctaggagagcaag

SEQ ID NO: 28894 - DNA, 15 bp, Homo sapiens
tacctaggagagcaa

SEQ ID NO: 28895 - DNA, 15 bp, Homo sapiens
ctacctaggagagca

SEQ ID NO: 28896 - DNA, 15 bp, Homo sapiens
gctacctaggagagc

SEQ ID NO: 28897 - DNA, 15 bp, Homo sapiens
ggctacctaggagag

SEQ ID NO: 28898 - DNA, 15 bp, Homo sapiens
gggctacctaggaga

SEQ ID NO: 28899 - DNA, 15 bp, Homo sapiens
ggggctacctaggag

SEQ ID NO: 28900 - DNA, 15 bp, Homo sapiens
gggggctacctagga

SEQ ID NO: 28901 - DNA, 15 bp, Homo sapiens
agggggctacctagg

SEQ ID NO: 28902 - DNA, 15 bp, Homo sapiens
gagggggctacctag

SEQ ID NO: 28903 - DNA, 15 bp, Homo sapiens
agagggggctaccta

SEQ ID NO: 28904 - DNA, 15 bp, Homo sapiens
aagagggggctacct

SEQ ID NO: 28905 - DNA, 15 bp, Homo sapiens
gaagagggggctacc

SEQ ID NO: 28906 - DNA, 15 bp, Homo sapiens
ggaagagggggctac

SEQ ID NO: 28907 - DNA, 15 bp, Homo sapiens
gggaagagggggcta

SEQ ID NO: 28908 - DNA, 15 bp, Homo sapiens
agggaagagggggct

SEQ ID NO: 28909 - DNA, 15 bp, Homo sapiens
cagggaagagggggc

SEQ ID NO: 28910 - DNA, 15 bp, Homo sapiens
ccagggaagaggggg

SEQ ID NO: 28911 - DNA, 15 bp, Homo sapiens
accagggaagagggg

SEQ ID NO: 28912 - DNA, 15 bp, Homo sapiens
taccagggaagaggg

SEQ ID NO: 28913 - DNA, 15 bp, Homo sapiens
ttaccagggaagagg

SEQ ID NO: 28914 - DNA, 15 bp, Homo sapiens
cttaccagggaagag

SEQ ID NO: 28915 - DNA, 15 bp, Homo sapiens
tcttaccagggaaga

SEQ ID NO: 28916 - DNA, 15 bp, Homo sapiens
ttcttaccagggaag

SEQ ID NO: 28917 - DNA, 15 bp, Homo sapiens
tttcttaccagggaa

SEQ ID NO: 28918 - DNA, 15 bp, Homo sapiens
ttttcttaccaggga

SEQ ID NO: 28919 - DNA, 15 bp, Homo sapiens
tttttcttaccaggg

SEQ ID NO: 28920 - DNA, 15 bp, Homo sapiens
ctttttcttaccagg

SEQ ID NO: 28921 - DNA, 15 bp, Homo sapiens
gctttttcttaccag

SEQ ID NO: 28922 - DNA, 15 bp, Homo sapiens
tgctttttcttacca

SEQ ID NO: 28923 - DNA, 15 bp, Homo sapiens
ttgctttttcttacc

SEQ ID NO: 28924 - DNA, 15 bp, Homo sapiens
tttgctttttcttac

SEQ ID NO: 28925 - DNA, 15 bp, Homo sapiens
ttttgctttttctta

SEQ ID NO: 28926 - DNA, 15 bp, Homo sapiens
cttttgctttttctt

SEQ ID NO: 28927 - DNA, 15 bp, Homo sapiens
ccttttgctttttct

SEQ ID NO: 28928 - DNA, 15 bp, Homo sapiens
gccttttgctttttc

SEQ ID NO: 28929 - DNA, 15 bp, Homo sapiens
tgccttttgcttttt

SEQ ID NO: 28930 - DNA, 15 bp, Homo sapiens
atgccttttgctttt

SEQ ID NO: 28931 - DNA, 15 bp, Homo sapiens
aatgccttttgcttt

SEQ ID NO: 28932 - DNA, 15 bp, Homo sapiens
aaatgccttttgctt

SEQ ID NO: 28933 - DNA, 15 bp, Homo sapiens
gaaatgccttttgct

SEQ ID NO: 28934 - DNA, 15 bp, Homo sapiens
ggaaatgccttttgc

SEQ ID NO: 28935 - DNA, 15 bp, Homo sapiens
gggaaatgccttttg

SEQ ID NO: 28936 - DNA, 15 bp, Homo sapiens
tgggaaatgcctttt

SEQ ID NO: 28937 - DNA, 15 bp, Homo sapiens
gtgggaaatgccttt

SEQ ID NO: 28938 - DNA, 15 bp, Homo sapiens
ggtgggaaatgcctt

SEQ ID NO: 28939 - DNA, 15 bp, Homo sapiens
gggtgggaaatgcct

SEQ ID NO: 28940 - DNA, 15 bp, Homo sapiens
agggtgggaaatgcc

SEQ ID NO: 28941 - DNA, 15 bp, Homo sapiens
cagggtgggaaatgc

SEQ ID NO: 28942 - DNA, 15 bp, Homo sapiens
tcagggtgggaaatg

SEQ ID NO: 28943 - DNA, 15 bp, Homo sapiens
ttcagggtgggaaat

SEQ ID NO: 28944 - DNA, 15 bp, Homo sapiens
gttcagggtgggaaa

SEQ ID NO: 28945 - DNA, 15 bp, Homo sapiens
tgttcagggtgggaa

SEQ ID NO: 28946 - DNA, 15 bp, Homo sapiens
ttgttcagggtggga

SEQ ID NO: 28947 - DNA, 15 bp, Homo sapiens
gttgttcagggtggg

SEQ ID NO: 28948 - DNA, 15 bp, Homo sapiens
cgttgttcagggtgg

SEQ ID NO: 28949 - DNA, 15 bp, Homo sapiens
tcgttgttcagggtg

SEQ ID NO: 28950 - DNA, 15 bp, Homo sapiens
ctcgttgttcagggt

SEQ ID NO: 28951 - DNA, 15 bp, Homo sapiens
gctcgttgttcaggg

SEQ ID NO: 28952 - DNA, 15 bp, Homo sapiens
ggctcgttgttcagg

SEQ ID NO: 28953 - DNA, 15 bp, Homo sapiens
aggctcgttgttcag

SEQ ID NO: 28954 - DNA, 15 bp, Homo sapiens
aaggctcgttgttca

SEQ ID NO: 28955 - DNA, 15 bp, Homo sapiens
aaaggctcgttgttc

SEQ ID NO: 28956 - DNA, 15 bp, Homo sapiens
aaaaggctcgttgtt

SEQ ID NO: 28957 - DNA, 15 bp, Homo sapiens
gaaaaggctcgttgt

SEQ ID NO: 28958 - DNA, 15 bp, Homo sapiens
tgaaaaggctcgttg

SEQ ID NO: 28959 - DNA, 15 bp, Homo sapiens
gtgaaaaggctcgtt

SEQ ID NO: 28960 - DNA, 15 bp, Homo sapiens
ggtgaaaaggctcgt

SEQ ID NO: 28961 - DNA, 15 bp, Homo sapiens
gggtgaaaaggctcg

SEQ ID NO: 28962 - DNA, 15 bp, Homo sapiens
agggtgaaaaggctc

SEQ ID NO: 28963 - DNA, 15 bp, Homo sapiens
aagggtgaaaaggct

SEQ ID NO: 28964 - DNA, 15 bp, Homo sapiens
gaagggtgaaaaggc

SEQ ID NO: 28965 - DNA, 15 bp, Homo sapiens
agaagggtgaaaagg

SEQ ID NO: 28966 - DNA, 15 bp, Homo sapiens
tagaagggtgaaaag

SEQ ID NO: 28967 - DNA, 15 bp, Homo sapiens
gtagaagggtgaaaa

SEQ ID NO: 28968 - DNA, 15 bp, Homo sapiens
agtagaagggtgaaa

SEQ ID NO: 28969 - DNA, 15 bp, Homo sapiens
gagtagaagggtgaa

SEQ ID NO: 28970 - DNA, 15 bp, Homo sapiens
agagtagaagggtga

SEQ ID NO: 28971 - DNA, 15 bp, Homo sapiens
tagagtagaagggtg

SEQ ID NO: 28972 - DNA, 15 bp, Homo sapiens
ctagagtagaagggt

SEQ ID NO: 28973 - DNA, 15 bp, Homo sapiens
tctagagtagaaggg

SEQ ID NO: 28974 - DNA, 15 bp, Homo sapiens
ctctagagtagaagg

SEQ ID NO: 28975 - DNA, 15 bp, Homo sapiens
tctctagagtagaag

SEQ ID NO: 28976 - DNA, 15 bp, Homo sapiens
ttctctagagtagaa

SEQ ID NO: 28977 - DNA, 15 bp, Homo sapiens
cttctctagagtaga

SEQ ID NO: 28978 - DNA, 15 bp, Homo sapiens
acttctctagagtag

SEQ ID NO: 28979 - DNA, 15 bp, Homo sapiens
cacttctctagagta

SEQ ID NO: 28980 - DNA, 15 bp, Homo sapiens
ccacttctctagagt

SEQ ID NO: 28981 - DNA, 15 bp, Homo sapiens
tccacttctctagag

SEQ ID NO: 28982 - DNA, 15 bp, Homo sapiens
gtccacttctctaga

SEQ ID NO: 28983 - DNA, 15 bp, Homo sapiens
agtccacttctctag

SEQ ID NO: 28984 - DNA, 15 bp, Homo sapiens
cagtccacttctcta

SEQ ID NO: 28985 - DNA, 15 bp, Homo sapiens
ccagtccacttctct

SEQ ID NO: 28986 - DNA, 15 bp, Homo sapiens
tccagtccacttctc

SEQ ID NO: 28987 - DNA, 15 bp, Homo sapiens
ctccagtccacttct

SEQ ID NO: 28988 - DNA, 15 bp, Homo sapiens
cctccagtccacttc

SEQ ID NO: 28989 - DNA, 15 bp, Homo sapiens
tcctccagtccactt

SEQ ID NO: 28990 - DNA, 15 bp, Homo sapiens
ctcctccagtccact

SEQ ID NO: 28991 - DNA, 15 bp, Homo sapiens
gctcctccagtccac

SEQ ID NO: 28992 - DNA, 15 bp, Homo sapiens
agctcctccagtcca

SEQ ID NO: 28993 - DNA, 15 bp, Homo sapiens
cagctcctccagtcc

SEQ ID NO: 28994 - DNA, 15 bp, Homo sapiens
ccagctcctccagtc

SEQ ID NO: 28995 - DNA, 15 bp, Homo sapiens
cccagctcctccagt

SEQ ID NO: 28996 - DNA, 15 bp, Homo sapiens
gcccagctcctccag

SEQ ID NO: 28997 - DNA, 15 bp, Homo sapiens
ggcccagctcctcca

SEQ ID NO: 28998 - DNA, 15 bp, Homo sapiens
gggcccagctcctcc

SEQ ID NO: 28999 - DNA, 15 bp, Homo sapiens
cgggcccagctcctc

SEQ ID NO: 29000 - DNA, 15 bp, Homo sapiens
tcgggcccagctcct

SEQ ID NO: 29001 - DNA, 15 bp, Homo sapiens
atcgggcccagctcc

SEQ ID NO: 29002 - DNA, 15 bp, Homo sapiens
aatcgggcccagctc

SEQ ID NO: 29003 - DNA, 15 bp, Homo sapiens
aaatcgggcccagct

SEQ ID NO: 29004 - DNA, 15 bp, Homo sapiens
caaatcgggcccagc

SEQ ID NO: 29005 - DNA, 15 bp, Homo sapiens
ccaaatcgggcccag

SEQ ID NO: 29006 - DNA, 15 bp, Homo sapiens
accaaatcgggccca

SEQ ID NO: 29007 - DNA, 15 bp, Homo sapiens
taccaaatcgggccc

SEQ ID NO: 29008 - DNA, 15 bp, Homo sapiens
ctaccaaatcgggcc

SEQ ID NO: 29009 - DNA, 15 bp, Homo sapiens
actaccaaatcgggc

SEQ ID NO: 29010 - DNA, 15 bp, Homo sapiens
aactaccaaatcggg

SEQ ID NO: 29011 - DNA, 15 bp, Homo sapiens
caactaccaaatcgg

SEQ ID NO: 29012 - DNA, 15 bp, Homo sapiens
tcaactaccaaatcg

SEQ ID NO: 29013 - DNA, 15 bp, Homo sapiens
ctcaactaccaaatc

SEQ ID NO: 29014 - DNA, 15 bp, Homo sapiens
cctcaactaccaaat

SEQ ID NO: 29015 - DNA, 15 bp, Homo sapiens
tcctcaactaccaaa

SEQ ID NO: 29016 - DNA, 15 bp, Homo sapiens
ttcctcaactaccaa

SEQ ID NO: 29017 - DNA, 15 bp, Homo sapiens
tttcctcaactacca

SEQ ID NO: 29018 - DNA, 15 bp, Homo sapiens
ctttcctcaactacc

SEQ ID NO: 29019 - DNA, 15 bp, Homo sapiens
gctttcctcaactac

SEQ ID NO: 29020 - DNA, 15 bp, Homo sapiens
tgctttcctcaacta

SEQ ID NO: 29021 - DNA, 15 bp, Homo sapiens
gtgctttcctcaact

SEQ ID NO: 29022 - DNA, 15 bp, Homo sapiens
tgtgctttcctcaac

SEQ ID NO: 29023 - DNA, 15 bp, Homo sapiens
ctgtgctttcctcaa

SEQ ID NO: 29024 - DNA, 15 bp, Homo sapiens
tctgtgctttcctca

SEQ ID NO: 29025 - DNA, 15 bp, Homo sapiens
ctctgtgctttcctc

SEQ ID NO: 29026 - DNA, 15 bp, Homo sapiens
cctctgtgctttcct

SEQ ID NO: 29027 - DNA, 15 bp, Homo sapiens
gcctctgtgctttcc

SEQ ID NO: 29028 - DNA, 15 bp, Homo sapiens
ggcctctgtgctttc

SEQ ID NO: 29029 - DNA, 15 bp, Homo sapiens
aggcctctgtgcttt

SEQ ID NO: 29030 - DNA, 15 bp, Homo sapiens
gaggcctctgtgctt

SEQ ID NO: 29031 - DNA, 15 bp, Homo sapiens
ggaggcctctgtgct

SEQ ID NO: 29032 - DNA, 15 bp, Homo sapiens
aggaggcctctgtgc

SEQ ID NO: 29033 - DNA, 15 bp, Homo sapiens
caggaggcctctgtg

SEQ ID NO: 29034 - DNA, 15 bp, Homo sapiens
acaggaggcctctgt

SEQ ID NO: 29035 - DNA, 15 bp, Homo sapiens
cacaggaggcctctg

SEQ ID NO: 29036 - DNA, 15 bp, Homo sapiens
ccacaggaggcctct

SEQ ID NO: 29037 - DNA, 15 bp, Homo sapiens
gccacaggaggcctc

SEQ ID NO: 29038 - DNA, 15 bp, Homo sapiens
ggccacaggaggcct

SEQ ID NO: 29039 - DNA, 15 bp, Homo sapiens
aggccacaggaggcc

SEQ ID NO: 29040 - DNA, 15 bp, Homo sapiens
caggccacaggaggc

SEQ ID NO: 29041 - DNA, 15 bp, Homo sapiens
gcaggccacaggagg

SEQ ID NO: 29042 - DNA, 15 bp, Homo sapiens
ggcaggccacaggag

SEQ ID NO: 29043 - DNA, 15 bp, Homo sapiens
tggcaggccacagga

SEQ ID NO: 29044 - DNA, 15 bp, Homo sapiens
ctggcaggccacagg

SEQ ID NO: 29045 - DNA, 15 bp, Homo sapiens
actggcaggccacag

SEQ ID NO: 29046 - DNA, 15 bp, Homo sapiens
gactggcaggccaca

SEQ ID NO: 29047 - DNA, 15 bp, Homo sapiens
tgactggcaggccac

SEQ ID NO: 29048 - DNA, 15 bp, Homo sapiens
atgactggcaggcca

SEQ ID NO: 29049 - DNA, 15 bp, Homo sapiens
gatgactggcaggcc

SEQ ID NO: 29050 - DNA, 15 bp, Homo sapiens
cgatgactggcaggc

SEQ ID NO: 29051 - DNA, 15 bp, Homo sapiens
tcgatgactggcagg

SEQ ID NO: 29052 - DNA, 15 bp, Homo sapiens
ctcgatgactggcag

SEQ ID NO: 29053 - DNA, 15 bp, Homo sapiens
actcgatgactggca

SEQ ID NO: 29054 - DNA, 15 bp, Homo sapiens
cactcgatgactggc

SEQ ID NO: 29055 - DNA, 15 bp, Homo sapiens
ccactcgatgactgg

SEQ ID NO: 29056 - DNA, 15 bp, Homo sapiens
gccactcgatgactg

SEQ ID NO: 29057 - DNA, 15 bp, Homo sapiens
ggccactcgatgact

SEQ ID NO: 29058 - DNA, 15 bp, Homo sapiens
gggccactcgatgac

SEQ ID NO: 29059 - DNA, 15 bp, Homo sapiens
tgggccactcgatga

SEQ ID NO: 29060 - DNA, 15 bp, Homo sapiens
ttgggccactcgatg

SEQ ID NO: 29061 - DNA, 15 bp, Homo sapiens
gttgggccactcgat

SEQ ID NO: 29062 - DNA, 15 bp, Homo sapiens
tgttgggccactcga

SEQ ID NO: 29063 - DNA, 15 bp, Homo sapiens
ctgttgggccactcg

SEQ ID NO: 29064 - DNA, 15 bp, Homo sapiens
cctgttgggccactc

SEQ ID NO: 29065 - DNA, 15 bp, Homo sapiens
ccctgttgggccact

SEQ ID NO: 29066 - DNA, 15 bp, Homo sapiens
cccctgttgggccac

SEQ ID NO: 29067 - DNA, 15 bp, Homo sapiens
gcccctgttgggcca

SEQ ID NO: 29068 - DNA, 15 bp, Homo sapiens
agcccctgttgggcc

SEQ ID NO: 29069 - DNA, 15 bp, Homo sapiens
gagcccctgttgggc

SEQ ID NO: 29070 - DNA, 15 bp, Homo sapiens
ggagcccctgttggg

SEQ ID NO: 29071 - DNA, 15 bp, Homo sapiens
tggagcccctgttgg

SEQ ID NO: 29072 - DNA, 15 bp, Homo sapiens
atggagcccctgttg

SEQ ID NO: 29073 - DNA, 15 bp, Homo sapiens
catggagcccctgtt

SEQ ID NO: 29074 - DNA, 15 bp, Homo sapiens
gcatggagcccctgt

SEQ ID NO: 29075 - DNA, 15 bp, Homo sapiens
ggcatggagcccctg

SEQ ID NO: 29076 - DNA, 15 bp, Homo sapiens
tggcatggagcccct

SEQ ID NO: 29077 - DNA, 15 bp, Homo sapiens
ctggcatggagcccc

SEQ ID NO: 29078 - DNA, 15 bp, Homo sapiens
gctggcatggagccc

SEQ ID NO: 29079 - DNA, 15 bp, Homo sapiens
ggctggcatggagcc

SEQ ID NO: 29080 - DNA, 15 bp, Homo sapiens
cggctggcatggagc

SEQ ID NO: 29081 - DNA, 15 bp, Homo sapiens
tcggctggcatggag

SEQ ID NO: 29082 - DNA, 15 bp, Homo sapiens
gtcggctggcatgga

SEQ ID NO: 29083 - DNA, 15 bp, Homo sapiens
ggtcggctggcatgg

SEQ ID NO: 29084 - DNA, 15 bp, Homo sapiens
aggtcggctggcatg

SEQ ID NO: 29085 - DNA, 15 bp, Homo sapiens
aaggtcggctggcat

SEQ ID NO: 29086 - DNA, 15 bp, Homo sapiens
caaggtcggctggca

SEQ ID NO: 29087 - DNA, 15 bp, Homo sapiens
tcaaggtcggctggc

SEQ ID NO: 29088 - DNA, 15 bp, Homo sapiens
gtcaaggtcggctgg

SEQ ID NO: 29089 - DNA, 15 bp, Homo sapiens
ggtcaaggtcggctg

SEQ ID NO: 29090 - DNA, 15 bp, Homo sapiens
aggtcaaggtcggct

SEQ ID NO: 29091 - DNA, 15 bp, Homo sapiens
gaggtcaaggtcggc

SEQ ID NO: 29092 - DNA, 15 bp, Homo sapiens
tgaggtcaaggtcgg

SEQ ID NO: 29093 - DNA, 15 bp, Homo sapiens
gtgaggtcaaggtcg

SEQ ID NO: 29094 - DNA, 15 bp, Homo sapiens
agtgaggtcaaggtc

SEQ ID NO: 29095 - DNA, 15 bp, Homo sapiens
gagtgaggtcaaggt

SEQ ID NO: 29096 - DNA, 15 bp, Homo sapiens
tgagtgaggtcaagg

SEQ ID NO: 29097 - DNA, 15 bp, Homo sapiens
ctgagtgaggtcaag

SEQ ID NO: 29098 - DNA, 15 bp, Homo sapiens
tctgagtgaggtcaa

SEQ ID NO: 29099 - DNA, 15 bp, Homo sapiens
ttctgagtgaggtca

SEQ ID NO: 29100 - DNA, 15 bp, Homo sapiens
cttctgagtgaggtc

SEQ ID NO: 29101 - DNA, 15 bp, Homo sapiens
acttctgagtgaggt

SEQ ID NO: 29102 - DNA, 15 bp, Homo sapiens
gacttctgagtgagg

SEQ ID NO: 29103 - DNA, 15 bp, Homo sapiens
ggacttctgagtgag

SEQ ID NO: 29104 - DNA, 15 bp, Homo sapiens
tggacttctgagtga

SEQ ID NO: 29105 - DNA, 15 bp, Homo sapiens
ctggacttctgagtg

SEQ ID NO: 29106 - DNA, 15 bp, Homo sapiens
tctggacttctgagt

SEQ ID NO: 29107 - DNA, 15 bp, Homo sapiens
ctctggacttctgag

SEQ ID NO: 29108 - DNA, 15 bp, Homo sapiens
actctggacttctga

SEQ ID NO: 29109 - DNA, 15 bp, Homo sapiens
gactctggacttctg

SEQ ID NO: 29110 - DNA, 15 bp, Homo sapiens
agactctggacttct

SEQ ID NO: 29111 - DNA, 15 bp, Homo sapiens
tagactctggacttc

SEQ ID NO: 29112 - DNA, 15 bp, Homo sapiens
ctagactctggactt

SEQ ID NO: 29113 - DNA, 15 bp, Homo sapiens
gctagactctggact

SEQ ID NO: 29114 - DNA, 15 bp, Homo sapiens
cgctagactctggac

SEQ ID NO: 29115 - DNA, 15 bp, Homo sapiens
acgctagactctgga

SEQ ID NO: 29116 - DNA, 15 bp, Homo sapiens
tacgctagactctgg

SEQ ID NO: 29117 - DNA, 15 bp, Homo sapiens
ctacgctagactctg

SEQ ID NO: 29118 - DNA, 15 bp, Homo sapiens
actacgctagactct

SEQ ID NO: 29119 - DNA, 15 bp, Homo sapiens
cactacgctagactc

SEQ ID NO: 29120 - DNA, 15 bp, Homo sapiens
gcactacgctagact

SEQ ID NO: 29121 - DNA, 15 bp, Homo sapiens
tgcactacgctagac

SEQ ID NO: 29122 - DNA, 15 bp, Homo sapiens
ctgcactacgctaga

SEQ ID NO: 29123 - DNA, 15 bp, Homo sapiens
gctgcactacgctag

SEQ ID NO: 29124 - DNA, 15 bp, Homo sapiens
tgctgcactacgcta

SEQ ID NO: 29125 - DNA, 15 bp, Homo sapiens
ctgctgcactacgct

SEQ ID NO: 29126 - DNA, 15 bp, Homo sapiens
cctgctgcactacgc

SEQ ID NO: 29127 - DNA, 15 bp, Homo sapiens
ccctgctgcactacg

SEQ ID NO: 29128 - DNA, 15 bp, Homo sapiens
gccctgctgcactac

SEQ ID NO: 29129 - DNA, 15 bp, Homo sapiens
tgccctgctgcacta

SEQ ID NO: 29130 - DNA, 15 bp, Homo sapiens
ctgccctgctgcact

SEQ ID NO: 29131 - DNA, 15 bp, Homo sapiens
actgccctgctgcac

SEQ ID NO: 29132 - DNA, 15 bp, Homo sapiens
tactgccctgctgca

SEQ ID NO: 29133 - DNA, 15 bp, Homo sapiens
ctactgccctgctgc

SEQ ID NO: 29134 - DNA, 15 bp, Homo sapiens
gctactgccctgctg

SEQ ID NO: 29135 - DNA, 15 bp, Homo sapiens
cgctactgccctgct

SEQ ID NO: 29136 - DNA, 15 bp, Homo sapiens
ccgctactgccctgc

SEQ ID NO: 29137 - DNA, 15 bp, Homo sapiens
accgctactgccctg

SEQ ID NO: 29138 - DNA, 15 bp, Homo sapiens
taccgctactgccct

SEQ ID NO: 29139 - DNA, 15 bp, Homo sapiens
gtaccgctactgccc

SEQ ID NO: 29140 - DNA, 15 bp, Homo sapiens
ggtaccgctactgcc

SEQ ID NO: 29141 - DNA, 15 bp, Homo sapiens
tggtaccgctactgc

SEQ ID NO: 29142 - DNA, 15 bp, Homo sapiens
ttggtaccgctactg

SEQ ID NO: 29143 - DNA, 15 bp, Homo sapiens
attggtaccgctact

SEQ ID NO: 29144 - DNA, 15 bp, Homo sapiens
cattggtaccgctac

SEQ ID NO: 29145 - DNA, 15 bp, Homo sapiens
gcattggtaccgcta

SEQ ID NO: 29146 - DNA, 15 bp, Homo sapiens
tgcattggtaccgct

SEQ ID NO: 29147 - DNA, 15 bp, Homo sapiens
ctgcattggtaccgc

SEQ ID NO: 29148 - DNA, 15 bp, Homo sapiens
tctgcattggtaccg

SEQ ID NO: 29149 - DNA, 15 bp, Homo sapiens
ttctgcattggtacc

SEQ ID NO: 29150 - DNA, 15 bp, Homo sapiens
gttctgcattggtac

SEQ ID NO: 29151 - DNA, 15 bp, Homo sapiens
agttctgcattggta

SEQ ID NO: 29152 - DNA, 15 bp, Homo sapiens
gagttctgcattggt

SEQ ID NO: 29153 - DNA, 15 bp, Homo sapiens
ggagttctgcattgg

SEQ ID NO: 29154 - DNA, 15 bp, Homo sapiens
gggagttctgcattg

SEQ ID NO: 29155 - DNA, 15 bp, Homo sapiens
tgggagttctgcatt

SEQ ID NO: 29156 - DNA, 15 bp, Homo sapiens
ttgggagttctgcat

SEQ ID NO: 29157 - DNA, 15 bp, Homo sapiens
cttgggagttctgca

SEQ ID NO: 29158 - DNA, 15 bp, Homo sapiens
tcttgggagttctgc

SEQ ID NO: 29159 - DNA, 15 bp, Homo sapiens
gtcttgggagttctg

SEQ ID NO: 29160 - DNA, 15 bp, Homo sapiens
ggtcttgggagttct

SEQ ID NO: 29161 - DNA, 15 bp, Homo sapiens
gggtcttgggagttc

SEQ ID NO: 29162 - DNA, 15 bp, Homo sapiens
cgggtcttgggagtt

SEQ ID NO: 29163 - DNA, 15 bp, Homo sapiens
tcgggtcttgggagt

SEQ ID NO: 29164 - DNA, 15 bp, Homo sapiens
ctcgggtcttgggag

SEQ ID NO: 29165 - DNA, 15 bp, Homo sapiens
gctcgggtcttggga

SEQ ID NO: 29166 - DNA, 15 bp, Homo sapiens
agctcgggtcttggg

SEQ ID NO: 29167 - DNA, 15 bp, Homo sapiens
cagctcgggtcttgg

SEQ ID NO: 29168 - DNA, 15 bp, Homo sapiens
ccagctcgggtcttg

SEQ ID NO: 29169 - DNA, 15 bp, Homo sapiens
cccagctcgggtctt

SEQ ID NO: 29170 - DNA, 15 bp, Homo sapiens
tcccagctcgggtct

SEQ ID NO: 29171 - DNA, 15 bp, Homo sapiens
gtcccagctcgggtc

SEQ ID NO: 29172 - DNA, 15 bp, Homo sapiens
ggtcccagctcgggt

SEQ ID NO: 29173 - DNA, 15 bp, Homo sapiens
tggtcccagctcggg

SEQ ID NO: 29174 - DNA, 15 bp, Homo sapiens
ctggtcccagctcgg

SEQ ID NO: 29175 - DNA, 15 bp, Homo sapiens
actggtcccagctcg

SEQ ID NO: 29176 - DNA, 15 bp, Homo sapiens
tactggtcccagctc

SEQ ID NO: 29177 - DNA, 15 bp, Homo sapiens
gtactggtcccagct

SEQ ID NO: 29178 - DNA, 15 bp, Homo sapiens
ggtactggtcccagc

SEQ ID NO: 29179 - DNA, 15 bp, Homo sapiens
aggtactggtcccag

SEQ ID NO: 29180 - DNA, 15 bp, Homo sapiens
caggtactggtccca

SEQ ID NO: 29181 - DNA, 15 bp, Homo sapiens
ccaggtactggtccc

SEQ ID NO: 29182 - DNA, 15 bp, Homo sapiens
cccaggtactggtcc

SEQ ID NO: 29183 - DNA, 15 bp, Homo sapiens
acccaggtactggtc

SEQ ID NO: 29184 - DNA, 15 bp, Homo sapiens
gacccaggtactggt

SEQ ID NO: 29185 - DNA, 15 bp, Homo sapiens
ggacccaggtactgg

SEQ ID NO: 29186 - DNA, 15 bp, Homo sapiens
gggacccaggtactg

SEQ ID NO: 29187 - DNA, 15 bp, Homo sapiens
ggggacccaggtact

SEQ ID NO: 29188 - DNA, 15 bp, Homo sapiens
tggggacccaggtac

SEQ ID NO: 29189 - DNA, 15 bp, Homo sapiens
ctggggacccaggta

SEQ ID NO: 29190 - DNA, 15 bp, Homo sapiens
gctggggacccaggt

SEQ ID NO: 29191 - DNA, 15 bp, Homo sapiens
ggctggggacccagg

SEQ ID NO: 29192 - DNA, 15 bp, Homo sapiens
gggctggggacccag

SEQ ID NO: 29193 - DNA, 15 bp, Homo sapiens
agggctggggaccca

SEQ ID NO: 29194 - DNA, 15 bp, Homo sapiens
aagggctggggaccc

SEQ ID NO: 29195 - DNA, 15 bp, Homo sapiens
gaagggctggggacc

SEQ ID NO: 29196 - DNA, 15 bp, Homo sapiens
ggaagggctggggac

SEQ ID NO: 29197 - DNA, 15 bp, Homo sapiens
aggaagggctgggga

SEQ ID NO: 29198 - DNA, 15 bp, Homo sapiens
gaggaagggctgggg

SEQ ID NO: 29199 - DNA, 15 bp, Homo sapiens
agaggaagggctggg

SEQ ID NO: 29200 - DNA, 15 bp, Homo sapiens
cagaggaagggctgg

SEQ ID NO: 29201 - DNA, 15 bp, Homo sapiens
gcagaggaagggctg

SEQ ID NO: 29202 - DNA, 15 bp, Homo sapiens
agcagaggaagggct

SEQ ID NO: 29203 - DNA, 15 bp, Homo sapiens
gagcagaggaagggc

SEQ ID NO: 29204 - DNA, 15 bp, Homo sapiens
ggagcagaggaaggg

SEQ ID NO: 29205 - DNA, 15 bp, Homo sapiens
gggagcagaggaagg

SEQ ID NO: 29206 - DNA, 15 bp, Homo sapiens
ggggagcagaggaag

SEQ ID NO: 29207 - DNA, 15 bp, Homo sapiens
gggggagcagaggaa

SEQ ID NO: 29208 - DNA, 15 bp, Homo sapiens
agggggagcagagga

SEQ ID NO: 29209 - DNA, 15 bp, Homo sapiens
aagggggagcagagg

SEQ ID NO: 29210 - DNA, 15 bp, Homo sapiens
aaagggggagcagag

SEQ ID NO: 29211 - DNA, 15 bp, Homo sapiens
aaaagggggagcaga

SEQ ID NO: 29212 - DNA, 15 bp, Homo sapiens
gaaaagggggagcag

SEQ ID NO: 29213 - DNA, 15 bp, Homo sapiens
ggaaaagggggagca

SEQ ID NO: 29214 - DNA, 15 bp, Homo sapiens
gggaaaagggggagc

SEQ ID NO: 29215 - DNA, 15 bp, Homo sapiens
agggaaaagggggag

SEQ ID NO: 29216 - DNA, 15 bp, Homo sapiens
gagggaaaaggggga

SEQ ID NO: 29217 - DNA, 15 bp, Homo sapiens
cgagggaaaaggggg

SEQ ID NO: 29218 - DNA, 15 bp, Homo sapiens
ccgagggaaaagggg

SEQ ID NO: 29219 - DNA, 15 bp, Homo sapiens
tccgagggaaaaggg

SEQ ID NO: 29220 - DNA, 15 bp, Homo sapiens
ctccgagggaaaagg

SEQ ID NO: 29221 - DNA, 15 bp, Homo sapiens
actccgagggaaaag

SEQ ID NO: 29222 - DNA, 15 bp, Homo sapiens
aactccgagggaaaa

SEQ ID NO: 29223 - DNA, 15 bp, Homo sapiens
gaactccgagggaaa

SEQ ID NO: 29224 - DNA, 15 bp, Homo sapiens
agaactccgagggaa

SEQ ID NO: 29225 - DNA, 15 bp, Homo sapiens
aagaactccgaggga

SEQ ID NO: 29226 - DNA, 15 bp, Homo sapiens
gaagaactccgaggg

SEQ ID NO: 29227 - DNA, 15 bp, Homo sapiens
agaagaactccgagg

SEQ ID NO: 29228 - DNA, 15 bp, Homo sapiens
aagaagaactccgag

SEQ ID NO: 29229 - DNA, 15 bp, Homo sapiens
caagaagaactccga

SEQ ID NO: 29230 - DNA, 15 bp, Homo sapiens
tcaagaagaactccg

SEQ ID NO: 29231 - DNA, 15 bp, Homo sapiens
ttcaagaagaactcc

SEQ ID NO: 29232 - DNA, 15 bp, Homo sapiens
attcaagaagaactc

SEQ ID NO: 29233 - DNA, 15 bp, Homo sapiens
cattcaagaagaact

SEQ ID NO: 29234 - DNA, 15 bp, Homo sapiens
ccattcaagaagaac

SEQ ID NO: 29235 - DNA, 15 bp, Homo sapiens
gccattcaagaagaa

SEQ ID NO: 29236 - DNA, 15 bp, Homo sapiens
tgccattcaagaaga

SEQ ID NO: 29237 - DNA, 15 bp, Homo sapiens
ttgccattcaagaag

SEQ ID NO: 29238 - DNA, 15 bp, Homo sapiens
attgccattcaagaa

SEQ ID NO: 29239 - DNA, 15 bp, Homo sapiens
cattgccattcaaga

SEQ ID NO: 29240 - DNA, 15 bp, Homo sapiens
acattgccattcaag

SEQ ID NO: 29241 - DNA, 15 bp, Homo sapiens
aacattgccattcaa

SEQ ID NO: 29242 - DNA, 15 bp, Homo sapiens
aaacattgccattca

SEQ ID NO: 29243 - DNA, 15 bp, Homo sapiens
aaaacattgccattc

SEQ ID NO: 29244 - DNA, 15 bp, Homo sapiens
caaaacattgccatt

SEQ ID NO: 29245 - DNA, 15 bp, Homo sapiens
gcaaaacattgccat

SEQ ID NO: 29246 - DNA, 15 bp, Homo sapiens
agcaaaacattgcca

SEQ ID NO: 29247 - DNA, 15 bp, Homo sapiens
aagcaaaacattgcc

SEQ ID NO: 29248 - DNA, 15 bp, Homo sapiens
aaagcaaaacattgc

SEQ ID NO: 29249 - DNA, 15 bp, Homo sapiens
aaaagcaaaacattg

SEQ ID NO: 29250 - DNA, 15 bp, Homo sapiens
caaaagcaaaacatt

SEQ ID NO: 29251 - DNA, 15 bp, Homo sapiens
gcaaaagcaaaacat

SEQ ID NO: 29252 - DNA, 15 bp, Homo sapiens
agcaaaagcaaaaca

SEQ ID NO: 29253 - DNA, 15 bp, Homo sapiens
gagcaaaagcaaaac

SEQ ID NO: 29254 - DNA, 15 bp, Homo sapiens
cgagcaaaagcaaaa

SEQ ID NO: 29255 - DNA, 15 bp, Homo sapiens
tcgagcaaaagcaaa

SEQ ID NO: 29256 - DNA, 15 bp, Homo sapiens
atcgagcaaaagcaa

SEQ ID NO: 29257 - DNA, 15 bp, Homo sapiens
catcgagcaaaagca

SEQ ID NO: 29258 - DNA, 15 bp, Homo sapiens
gcatcgagcaaaagc

SEQ ID NO: 29259 - DNA, 15 bp, Homo sapiens
tgcatcgagcaaaag

SEQ ID NO: 29260 - DNA, 15 bp, Homo sapiens
ctgcatcgagcaaaa

SEQ ID NO: 29261 - DNA, 15 bp, Homo sapiens
tctgcatcgagcaaa

SEQ ID NO: 29262 - DNA, 15 bp, Homo sapiens
gtctgcatcgagcaa

SEQ ID NO: 29263 - DNA, 15 bp, Homo sapiens
tgtctgcatcgagca

SEQ ID NO: 29264 - DNA, 15 bp, Homo sapiens
ctgtctgcatcgagc

SEQ ID NO: 29265 - DNA, 15 bp, Homo sapiens
cctgtctgcatcgag

SEQ ID NO: 29266 - DNA, 15 bp, Homo sapiens
ccctgtctgcatcga

SEQ ID NO: 29267 - DNA, 15 bp, Homo sapiens
cccctgtctgcatcg

SEQ ID NO: 29268 - DNA, 15 bp, Homo sapiens
ccccctgtctgcatc

SEQ ID NO: 29269 - DNA, 15 bp, Homo sapiens
gccccctgtctgcat

SEQ ID NO: 29270 - DNA, 15 bp, Homo sapiens
ggccccctgtctgca

SEQ ID NO: 29271 - DNA, 15 bp, Homo sapiens
tggccccctgtctgc

SEQ ID NO: 29272 - DNA, 15 bp, Homo sapiens
ctggccccctgtctg

SEQ ID NO: 29273 - DNA, 15 bp, Homo sapiens
tctggccccctgtct

SEQ ID NO: 29274 - DNA, 15 bp, Homo sapiens
ttctggccccctgtc

SEQ ID NO: 29275 - DNA, 15 bp, Homo sapiens
gttctggccccctgt

SEQ ID NO: 29276 - DNA, 15 bp, Homo sapiens
tgttctggccccctg

SEQ ID NO: 29277 - DNA, 15 bp, Homo sapiens
gtgttctggccccct

SEQ ID NO: 29278 - DNA, 15 bp, Homo sapiens
ggtgttctggccccc

SEQ ID NO: 29279 - DNA, 15 bp, Homo sapiens
tggtgttctggcccc

SEQ ID NO: 29280 - DNA, 15 bp, Homo sapiens
gtggtgttctggccc

SEQ ID NO: 29281 - DNA, 15 bp, Homo sapiens
tgtggtgttctggcc

SEQ ID NO: 29282 - DNA, 15 bp, Homo sapiens
gtgtggtgttctggc

SEQ ID NO: 29283 - DNA, 15 bp, Homo sapiens
tgtgtggtgttctgg

SEQ ID NO: 29284 - DNA, 15 bp, Homo sapiens
atgtgtggtgttctg

SEQ ID NO: 29285 - DNA, 15 bp, Homo sapiens
aatgtgtggtgttct

SEQ ID NO: 29286 - DNA, 15 bp, Homo sapiens
aaatgtgtggtgttc

SEQ ID NO: 29287 - DNA, 15 bp, Homo sapiens
gaaatgtgtggtgtt

SEQ ID NO: 29288 - DNA, 15 bp, Homo sapiens
tgaaatgtgtggtgt

SEQ ID NO: 29289 - DNA, 15 bp, Homo sapiens
gtgaaatgtgtggtg

SEQ ID NO: 29290 - DNA, 15 bp, Homo sapiens
agtgaaatgtgtggt

SEQ ID NO: 29291 - DNA, 15 bp, Homo sapiens
cagtgaaatgtgtgg

SEQ ID NO: 29292 - DNA, 15 bp, Homo sapiens
acagtgaaatgtgtg

SEQ ID NO: 29293 - DNA, 15 bp, Homo sapiens
gacagtgaaatgtgt

SEQ ID NO: 29294 - DNA, 15 bp, Homo sapiens
agacagtgaaatgtg

SEQ ID NO: 29295 - DNA, 15 bp, Homo sapiens
cagacagtgaaatgt

SEQ ID NO: 29296 - DNA, 15 bp, Homo sapiens
acagacagtgaaatg

SEQ ID NO: 29297 - DNA, 15 bp, Homo sapiens
gacagacagtgaaat

SEQ ID NO: 29298 - DNA, 15 bp, Homo sapiens
agacagacagtgaaa

SEQ ID NO: 29299 - DNA, 15 bp, Homo sapiens
cagacagacagtgaa

SEQ ID NO: 29300 - DNA, 15 bp, Homo sapiens
ccagacagacagtga

SEQ ID NO: 29301 - DNA, 15 bp, Homo sapiens
accagacagacagtg

SEQ ID NO: 29302 - DNA, 15 bp, Homo sapiens
gaccagacagacagt

SEQ ID NO: 29303 - DNA, 15 bp, Homo sapiens
ggaccagacagacag

SEQ ID NO: 29304 - DNA, 15 bp, Homo sapiens
tggaccagacagaca

SEQ ID NO: 29305 - DNA, 15 bp, Homo sapiens
atggaccagacagac

SEQ ID NO: 29306 - DNA, 15 bp, Homo sapiens
tatggaccagacaga

SEQ ID NO: 29307 - DNA, 15 bp, Homo sapiens
ctatggaccagacag

SEQ ID NO: 29308 - DNA, 15 bp, Homo sapiens
gctatggaccagaca

SEQ ID NO: 29309 - DNA, 15 bp, Homo sapiens
agctatggaccagac

SEQ ID NO: 29310 - DNA, 15 bp, Homo sapiens
cagctatggaccaga

SEQ ID NO: 29311 - DNA, 15 bp, Homo sapiens
acagctatggaccag

SEQ ID NO: 29312 - DNA, 15 bp, Homo sapiens
cacagctatggacca

SEQ ID NO: 29313 - DNA, 15 bp, Homo sapiens
ccacagctatggacc

SEQ ID NO: 29314 - DNA, 15 bp, Homo sapiens
accacagctatggac

SEQ ID NO: 29315 - DNA, 15 bp, Homo sapiens
caccacagctatgga

SEQ ID NO: 29316 - DNA, 15 bp, Homo sapiens
acaccacagctatgg

SEQ ID NO: 29317 - DNA, 15 bp, Homo sapiens
tacaccacagctatg

SEQ ID NO: 29318 - DNA, 15 bp, Homo sapiens
ctacaccacagctat

SEQ ID NO: 29319 - DNA, 15 bp, Homo sapiens
cctacaccacagcta

SEQ ID NO: 29320 - DNA, 15 bp, Homo sapiens
ccctacaccacagct

SEQ ID NO: 29321 - DNA, 15 bp, Homo sapiens
cccctacaccacagc

SEQ ID NO: 29322 - DNA, 15 bp, Homo sapiens
gcccctacaccacag

SEQ ID NO: 29323 - DNA, 15 bp, Homo sapiens
agcccctacaccaca

SEQ ID NO: 29324 - DNA, 15 bp, Homo sapiens
aagcccctacaccac

SEQ ID NO: 29325 - DNA, 15 bp, Homo sapiens
taagcccctacacca

SEQ ID NO: 29326 - DNA, 15 bp, Homo sapiens
ctaagcccctacacc

SEQ ID NO: 29327 - DNA, 15 bp, Homo sapiens
tctaagcccctacac

SEQ ID NO: 29328 - DNA, 15 bp, Homo sapiens
ctctaagcccctaca

SEQ ID NO: 29329 - DNA, 15 bp, Homo sapiens
cctctaagcccctac

SEQ ID NO: 29330 - DNA, 15 bp, Homo sapiens
gcctctaagccccta

SEQ ID NO: 29331 - DNA, 15 bp, Homo sapiens
tgcctctaagcccct

SEQ ID NO: 29332 - DNA, 15 bp, Homo sapiens
atgcctctaagcccc

SEQ ID NO: 29333 - DNA, 15 bp, Homo sapiens
catgcctctaagccc

SEQ ID NO: 29334 - DNA, 15 bp, Homo sapiens
ccatgcctctaagcc

SEQ ID NO: 29335 - DNA, 15 bp, Homo sapiens
cccatgcctctaagc

SEQ ID NO: 29336 - DNA, 15 bp, Homo sapiens
gcccatgcctctaag

SEQ ID NO: 29337 - DNA, 15 bp, Homo sapiens
agcccatgcctctaa

SEQ ID NO: 29338 - DNA, 15 bp, Homo sapiens
aagcccatgcctcta

SEQ ID NO: 29339 - DNA, 15 bp, Homo sapiens
caagcccatgcctct

SEQ ID NO: 29340 - DNA, 15 bp, Homo sapiens
gcaagcccatgcctc

SEQ ID NO: 29341 - DNA, 15 bp, Homo sapiens
agcaagcccatgcct

SEQ ID NO: 29342 - DNA, 15 bp, Homo sapiens
cagcaagcccatgcc

SEQ ID NO: 29343 - DNA, 15 bp, Homo sapiens
acagcaagcccatgc

SEQ ID NO: 29344 - DNA, 15 bp, Homo sapiens
cacagcaagcccatg

SEQ ID NO: 29345 - DNA, 15 bp, Homo sapiens
ccacagcaagcccat

SEQ ID NO: 29346 - DNA, 15 bp, Homo sapiens
cccacagcaagccca

SEQ ID NO: 29347 - DNA, 15 bp, Homo sapiens
acccacagcaagccc

SEQ ID NO: 29348 - DNA, 15 bp, Homo sapiens
aacccacagcaagcc

SEQ ID NO: 29349 - DNA, 15 bp, Homo sapiens
aaacccacagcaagc

SEQ ID NO: 29350 - DNA, 15 bp, Homo sapiens
aaaacccacagcaag

SEQ ID NO: 29351 - DNA, 15 bp, Homo sapiens
aaaaacccacagcaa

SEQ ID NO: 29352 - DNA, 15 bp, Homo sapiens
taaaaacccacagca

SEQ ID NO: 29353 - DNA, 15 bp, Homo sapiens
ttaaaaacccacagc

SEQ ID NO: 29354 - DNA, 15 bp, Homo sapiens
attaaaaacccacag

SEQ ID NO: 29355 - DNA, 15 bp, Homo sapiens
aattaaaaacccaca

SEQ ID NO: 29356 - DNA, 15 bp, Homo sapiens
caattaaaaacccac

SEQ ID NO: 29357 - DNA, 15 bp, Homo sapiens
tcaattaaaaaccca

SEQ ID NO: 29358 - DNA, 15 bp, Homo sapiens
atcaattaaaaaccc

SEQ ID NO: 29359 - DNA, 15 bp, Homo sapiens
gatcaattaaaaacc

SEQ ID NO: 29360 - DNA, 15 bp, Homo sapiens
tgatcaattaaaaac

SEQ ID NO: 29361 - DNA, 15 bp, Homo sapiens
ctgatcaattaaaaa

SEQ ID NO: 29362 - DNA, 15 bp, Homo sapiens
actgatcaattaaaa

SEQ ID NO: 29363 - DNA, 15 bp, Homo sapiens
aactgatcaattaaa

SEQ ID NO: 29364 - DNA, 15 bp, Homo sapiens
aaactgatcaattaa

SEQ ID NO: 29365 - DNA, 15 bp, Homo sapiens
aaaactgatcaatta

SEQ ID NO: 29366 - DNA, 15 bp, Homo sapiens
gaaaactgatcaatt

SEQ ID NO: 29367 - DNA, 15 bp, Homo sapiens
tgaaaactgatcaat

SEQ ID NO: 29368 - DNA, 15 bp, Homo sapiens
atgaaaactgatcaa

SEQ ID NO: 29369 - DNA, 15 bp, Homo sapiens
catgaaaactgatca

SEQ ID NO: 29370 - DNA, 15 bp, Homo sapiens
acatgaaaactgatc

SEQ ID NO: 29371 - DNA, 15 bp, Homo sapiens
cacatgaaaactgat

SEQ ID NO: 29372 - DNA, 15 bp, Homo sapiens
ccacatgaaaactga

SEQ ID NO: 29373 - DNA, 15 bp, Homo sapiens
cccacatgaaaactg

SEQ ID NO: 29374 - DNA, 15 bp, Homo sapiens
tcccacatgaaaact

SEQ ID NO: 29375 - DNA, 15 bp, Homo sapiens
atcccacatgaaaac

SEQ ID NO: 29376 - DNA, 15 bp, Homo sapiens
gatcccacatgaaaa

SEQ ID NO: 29377 - DNA, 15 bp, Homo sapiens
ggatcccacatgaaa

SEQ ID NO: 29378 - DNA, 15 bp, Homo sapiens
gggatcccacatgaa

SEQ ID NO: 29379 - DNA, 15 bp, Homo sapiens
tgggatcccacatga

SEQ ID NO: 29380 - DNA, 15 bp, Homo sapiens
atgggatcccacatg

SEQ ID NO: 29381 - DNA, 15 bp, Homo sapiens
gatgggatcccacat

SEQ ID NO: 29382 - DNA, 15 bp, Homo sapiens
agatgggatcccaca

SEQ ID NO: 29383 - DNA, 15 bp, Homo sapiens
aagatgggatcccac

SEQ ID NO: 29384 - DNA, 15 bp, Homo sapiens
aaagatgggatccca

SEQ ID NO: 29385 - DNA, 15 bp, Homo sapiens
aaaagatgggatccc

SEQ ID NO: 29386 - DNA, 15 bp, Homo sapiens
aaaaagatgggatcc

SEQ ID NO: 29387 - DNA, 15 bp, Homo sapiens
taaaaagatgggatc

SEQ ID NO: 29388 - DNA, 15 bp, Homo sapiens
ttaaaaagatgggat

SEQ ID NO: 29389 - DNA, 15 bp, Homo sapiens
gttaaaaagatggga

SEQ ID NO: 29390 - DNA, 15 bp, Homo sapiens
ggttaaaaagatggg

SEQ ID NO: 29391 - DNA, 15 bp, Homo sapiens
aggttaaaaagatgg

SEQ ID NO: 29392 - DNA, 15 bp, Homo sapiens
gaggttaaaaagatg

SEQ ID NO: 29393 - DNA, 15 bp, Homo sapiens
agaggttaaaaagat

SEQ ID NO: 29394 - DNA, 15 bp, Homo sapiens
cagaggttaaaaaga

SEQ ID NO: 29395 - DNA, 15 bp, Homo sapiens
acagaggttaaaaag

SEQ ID NO: 29396 - DNA, 15 bp, Homo sapiens
aacagaggttaaaaa

SEQ ID NO: 29397 - DNA, 15 bp, Homo sapiens
gaacagaggttaaaa

SEQ ID NO: 29398 - DNA, 15 bp, Homo sapiens
tgaacagaggttaaa

SEQ ID NO: 29399 - DNA, 15 bp, Homo sapiens
ctgaacagaggttaa

SEQ ID NO: 29400 - DNA, 15 bp, Homo sapiens
cctgaacagaggtta

SEQ ID NO: 29401 - DNA, 15 bp, Homo sapiens
tcctgaacagaggtt

SEQ ID NO: 29402 - DNA, 15 bp, Homo sapiens
ttcctgaacagaggt

SEQ ID NO: 29403 - DNA, 15 bp, Homo sapiens
cttcctgaacagagg

SEQ ID NO: 29404 - DNA, 15 bp, Homo sapiens
acttcctgaacagag

SEQ ID NO: 29405 - DNA, 15 bp, Homo sapiens
gacttcctgaacaga

SEQ ID NO: 29406 - DNA, 15 bp, Homo sapiens
ggacttcctgaacag

SEQ ID NO: 29407 - DNA, 15 bp, Homo sapiens
aggacttcctgaaca

SEQ ID NO: 29408 - DNA, 15 bp, Homo sapiens
aaggacttcctgaac

SEQ ID NO: 29409 - DNA, 15 bp, Homo sapiens
taaggacttcctgaa

SEQ ID NO: 29410 - DNA, 15 bp, Homo sapiens
ataaggacttcctga

SEQ ID NO: 29411 - DNA, 15 bp, Homo sapiens
gataaggacttcctg

SEQ ID NO: 29412 - DNA, 15 bp, Homo sapiens
agataaggacttcct

SEQ ID NO: 29413 - DNA, 15 bp, Homo sapiens
tagataaggacttcc

SEQ ID NO: 29414 - DNA, 15 bp, Homo sapiens
ctagataaggacttc

SEQ ID NO: 29415 - DNA, 15 bp, Homo sapiens
gctagataaggactt

SEQ ID NO: 29416 - DNA, 15 bp, Homo sapiens
agctagataaggact

SEQ ID NO: 29417 - DNA, 15 bp, Homo sapiens
cagctagataaggac

SEQ ID NO: 29418 - DNA, 15 bp, Homo sapiens
gcagctagataagga

SEQ ID NO: 29419 - DNA, 15 bp, Homo sapiens
tgcagctagataagg

SEQ ID NO: 29420 - DNA, 15 bp, Homo sapiens
atgcagctagataag

SEQ ID NO: 29421 - DNA, 15 bp, Homo sapiens
tatgcagctagataa

SEQ ID NO: 29422 - DNA, 15 bp, Homo sapiens
atatgcagctagata

SEQ ID NO: 29423 - DNA, 15 bp, Homo sapiens
gatatgcagctagat

SEQ ID NO: 29424 - DNA, 15 bp, Homo sapiens
agatatgcagctaga

SEQ ID NO: 29425 - DNA, 15 bp, Homo sapiens
aagatatgcagctag

SEQ ID NO: 29426 - DNA, 15 bp, Homo sapiens
gaagatatgcagcta

SEQ ID NO: 29427 - DNA, 15 bp, Homo sapiens
tgaagatatgcagct

SEQ ID NO: 29428 - DNA, 15 bp, Homo sapiens
atgaagatatgcagc

SEQ ID NO: 29429 - DNA, 15 bp, Homo sapiens
gatgaagatatgcag

SEQ ID NO: 29430 - DNA, 15 bp, Homo sapiens
tgatgaagatatgca

SEQ ID NO: 29431 - DNA, 15 bp, Homo sapiens
atgatgaagatatgc

SEQ ID NO: 29432 - DNA, 15 bp, Homo sapiens
tatgatgaagatatg

SEQ ID NO: 29433 - DNA, 15 bp, Homo sapiens
atatgatgaagatat

SEQ ID NO: 29434 - DNA, 15 bp, Homo sapiens
aatatgatgaagata

SEQ ID NO: 29435 - DNA, 15 bp, Homo sapiens
caatatgatgaagat

SEQ ID NO: 29436 - DNA, 15 bp, Homo sapiens
ccaatatgatgaaga

SEQ ID NO: 29437 - DNA, 15 bp, Homo sapiens
accaatatgatgaag

SEQ ID NO: 29438 - DNA, 15 bp, Homo sapiens
taccaatatgatgaa

SEQ ID NO: 29439 - DNA, 15 bp, Homo sapiens
ataccaatatgatga

SEQ ID NO: 29440 - DNA, 15 bp, Homo sapiens
tataccaatatgatg

SEQ ID NO: 29441 - DNA, 15 bp, Homo sapiens
atataccaatatgat

SEQ ID NO: 29442 - DNA, 15 bp, Homo sapiens
gatataccaatatga

SEQ ID NO: 29443 - DNA, 15 bp, Homo sapiens
ggatataccaatatg

SEQ ID NO: 29444 - DNA, 15 bp, Homo sapiens
aggatataccaatat

SEQ ID NO: 29445 - DNA, 15 bp, Homo sapiens
aaggatataccaata

SEQ ID NO: 29446 - DNA, 15 bp, Homo sapiens
aaaggatataccaat

SEQ ID NO: 29447 - DNA, 15 bp, Homo sapiens
aaaaggatataccaa

SEQ ID NO: 29448 - DNA, 15 bp, Homo sapiens
gaaaaggatatacca

SEQ ID NO: 29449 - DNA, 15 bp, Homo sapiens
agaaaaggatatacc

SEQ ID NO: 29450 - DNA, 15 bp, Homo sapiens
cagaaaaggatatac

SEQ ID NO: 29451 - DNA, 15 bp, Homo sapiens
acagaaaaggatata

SEQ ID NO: 29452 - DNA, 15 bp, Homo sapiens
cacagaaaaggatat

SEQ ID NO: 29453 - DNA, 15 bp, Homo sapiens
acacagaaaaggata

SEQ ID NO: 29454 - DNA, 15 bp, Homo sapiens
aacacagaaaaggat

SEQ ID NO: 29455 - DNA, 15 bp, Homo sapiens
aaacacagaaaagga

SEQ ID NO: 29456 - DNA, 15 bp, Homo sapiens
taaacacagaaaagg

SEQ ID NO: 29457 - DNA, 15 bp, Homo sapiens
gtaaacacagaaaag

SEQ ID NO: 29458 - DNA, 15 bp, Homo sapiens
tgtaaacacagaaaa

SEQ ID NO: 29459 - DNA, 15 bp, Homo sapiens
ctgtaaacacagaaa

SEQ ID NO: 29460 - DNA, 15 bp, Homo sapiens
tctgtaaacacagaa

SEQ ID NO: 29461 - DNA, 15 bp, Homo sapiens
ctctgtaaacacaga

SEQ ID NO: 29462 - DNA, 15 bp, Homo sapiens
tctctgtaaacacag

SEQ ID NO: 29463 - DNA, 15 bp, Homo sapiens
atctctgtaaacaca

SEQ ID NO: 29464 - DNA, 15 bp, Homo sapiens
catctctgtaaacac

SEQ ID NO: 29465 - DNA, 15 bp, Homo sapiens
acatctctgtaaaca

SEQ ID NO: 29466 - DNA, 15 bp, Homo sapiens
gacatctctgtaaac

SEQ ID NO: 29467 - DNA, 15 bp, Homo sapiens
agacatctctgtaaa

SEQ ID NO: 29468 - DNA, 15 bp, Homo sapiens
gagacatctctgtaa

SEQ ID NO: 29469 - DNA, 15 bp, Homo sapiens
agagacatctctgta

SEQ ID NO: 29470 - DNA, 15 bp, Homo sapiens
aagagacatctctgt

SEQ ID NO: 29471 - DNA, 15 bp, Homo sapiens
taagagacatctctg

SEQ ID NO: 29472 - DNA, 15 bp, Homo sapiens
ataagagacatctct

SEQ ID NO: 29473 - DNA, 15 bp, Homo sapiens
tataagagacatctc

SEQ ID NO: 29474 - DNA, 15 bp, Homo sapiens
atataagagacatct

SEQ ID NO: 29475 - DNA, 15 bp, Homo sapiens
gatataagagacatc

SEQ ID NO: 29476 - DNA, 15 bp, Homo sapiens
agatataagagacat

SEQ ID NO: 29477 - DNA, 15 bp, Homo sapiens
tagatataagagaca

SEQ ID NO: 29478 - DNA, 15 bp, Homo sapiens
ttagatataagagac

SEQ ID NO: 29479 - DNA, 15 bp, Homo sapiens
tttagatataagaga

SEQ ID NO: 29480 - DNA, 15 bp, Homo sapiens
atttagatataagag

SEQ ID NO: 29481 - DNA, 15 bp, Homo sapiens
gatttagatataaga

SEQ ID NO: 29482 - DNA, 15 bp, Homo sapiens
agatttagatataag

SEQ ID NO: 29483 - DNA, 15 bp, Homo sapiens
cagatttagatataa

SEQ ID NO: 29484 - DNA, 15 bp, Homo sapiens
acagatttagatata

SEQ ID NO: 29485 - DNA, 15 bp, Homo sapiens
gacagatttagatat

SEQ ID NO: 29486 - DNA, 15 bp, Homo sapiens
ggacagatttagata

SEQ ID NO: 29487 - DNA, 15 bp, Homo sapiens
tggacagatttagat

SEQ ID NO: 29488 - DNA, 15 bp, Homo sapiens
ttggacagatttaga

SEQ ID NO: 29489 - DNA, 15 bp, Homo sapiens
gttggacagatttag

SEQ ID NO: 29490 - DNA, 15 bp, Homo sapiens
agttggacagattta

SEQ ID NO: 29491 - DNA, 15 bp, Homo sapiens
cagttggacagattt

SEQ ID NO: 29492 - DNA, 15 bp, Homo sapiens
tcagttggacagatt

SEQ ID NO: 29493 - DNA, 15 bp, Homo sapiens
ctcagttggacagat

SEQ ID NO: 29494 - DNA, 15 bp, Homo sapiens
tctcagttggacaga

SEQ ID NO: 29495 - DNA, 15 bp, Homo sapiens
ttctcagttggacag

SEQ ID NO: 29496 - DNA, 15 bp, Homo sapiens
cttctcagttggaca

SEQ ID NO: 29497 - DNA, 15 bp, Homo sapiens
acttctcagttggac

SEQ ID NO: 29498 - DNA, 15 bp, Homo sapiens
tacttctcagttgga

SEQ ID NO: 29499 - DNA, 15 bp, Homo sapiens
gtacttctcagttgg

SEQ ID NO: 29500 - DNA, 15 bp, Homo sapiens
ggtacttctcagttg

SEQ ID NO: 29501 - DNA, 15 bp, Homo sapiens
aggtacttctcagtt

SEQ ID NO: 29502 - DNA, 15 bp, Homo sapiens
aaggtacttctcagt

SEQ ID NO: 29503 - DNA, 15 bp, Homo sapiens
taaggtacttctcag

SEQ ID NO: 29504 - DNA, 15 bp, Homo sapiens
ataaggtacttctca

SEQ ID NO: 29505 - DNA, 15 bp, Homo sapiens
gataaggtacttctc

SEQ ID NO: 29506 - DNA, 15 bp, Homo sapiens
tgataaggtacttct

SEQ ID NO: 29507 - DNA, 15 bp, Homo sapiens
ttgataaggtacttc

SEQ ID NO: 29508 - DNA, 15 bp, Homo sapiens
tttgataaggtactt

SEQ ID NO: 29509 - DNA, 15 bp, Homo sapiens
ctttgataaggtact

SEQ ID NO: 29510 - DNA, 15 bp, Homo sapiens
actttgataaggtac

SEQ ID NO: 29511 - DNA, 15 bp, Homo sapiens
tactttgataaggta

SEQ ID NO: 29512 - DNA, 15 bp, Homo sapiens
ctactttgataaggt

SEQ ID NO: 29513 - DNA, 15 bp, Homo sapiens
gctactttgataagg

SEQ ID NO: 29514 - DNA, 15 bp, Homo sapiens
tgctactttgataag

SEQ ID NO: 29515 - DNA, 15 bp, Homo sapiens
ttgctactttgataa

SEQ ID NO: 29516 - DNA, 15 bp, Homo sapiens
tttgctactttgata

SEQ ID NO: 29517 - DNA, 15 bp, Homo sapiens
atttgctactttgat

SEQ ID NO: 29518 - DNA, 15 bp, Homo sapiens
catttgctactttga

SEQ ID NO: 29519 - DNA, 15 bp, Homo sapiens
tcatttgctactttg

SEQ ID NO: 29520 - DNA, 15 bp, Homo sapiens
ctcatttgctacttt

SEQ ID NO: 29521 - DNA, 15 bp, Homo sapiens
tctcatttgctactt

SEQ ID NO: 29522 - DNA, 15 bp, Homo sapiens
gtctcatttgctact

SEQ ID NO: 29523 - DNA, 15 bp, Homo sapiens
tgtctcatttgctac

SEQ ID NO: 29524 - DNA, 15 bp, Homo sapiens
ctgtctcatttgcta

SEQ ID NO: 29525 - DNA, 15 bp, Homo sapiens
gctgtctcatttgct

SEQ ID NO: 29526 - DNA, 15 bp, Homo sapiens
tgctgtctcatttgc

SEQ ID NO: 29527 - DNA, 15 bp, Homo sapiens
ctgctgtctcatttg

SEQ ID NO: 29528 - DNA, 15 bp, Homo sapiens
actgctgtctcattt

SEQ ID NO: 29529 - DNA, 15 bp, Homo sapiens
gactgctgtctcatt

SEQ ID NO: 29530 - DNA, 15 bp, Homo sapiens
agactgctgtctcat

SEQ ID NO: 29531 - DNA, 15 bp, Homo sapiens
aagactgctgtctca

SEQ ID NO: 29532 - DNA, 15 bp, Homo sapiens
taagactgctgtctc

SEQ ID NO: 29533 - DNA, 15 bp, Homo sapiens
ataagactgctgtct

SEQ ID NO: 29534 - DNA, 15 bp, Homo sapiens
cataagactgctgtc

SEQ ID NO: 29535 - DNA, 15 bp, Homo sapiens
gcataagactgctgt

SEQ ID NO: 29536 - DNA, 15 bp, Homo sapiens
agcataagactgctg

SEQ ID NO: 29537 - DNA, 15 bp, Homo sapiens
aagcataagactgct

SEQ ID NO: 29538 - DNA, 15 bp, Homo sapiens
gaagcataagactgc

SEQ ID NO: 29539 - DNA, 15 bp, Homo sapiens
ggaagcataagactg

SEQ ID NO: 29540 - DNA, 15 bp, Homo sapiens
tggaagcataagact

SEQ ID NO: 29541 - DNA, 15 bp, Homo sapiens
ctggaagcataagac

SEQ ID NO: 29542 - DNA, 15 bp, Homo sapiens
tctggaagcataaga

SEQ ID NO: 29543 - DNA, 15 bp, Homo sapiens
ttctggaagcataag

SEQ ID NO: 29544 - DNA, 15 bp, Homo sapiens
tttctggaagcataa

SEQ ID NO: 29545 - DNA, 15 bp, Homo sapiens
gtttctggaagcata

SEQ ID NO: 29546 - DNA, 15 bp, Homo sapiens
tgtttctggaagcat

SEQ ID NO: 29547 - DNA, 15 bp, Homo sapiens
gtgtttctggaagca

SEQ ID NO: 29548 - DNA, 15 bp, Homo sapiens
ggtgtttctggaagc

SEQ ID NO: 29549 - DNA, 15 bp, Homo sapiens
gggtgtttctggaag

SEQ ID NO: 29550 - DNA, 15 bp, Homo sapiens
tgggtgtttctggaa

SEQ ID NO: 29551 - DNA, 15 bp, Homo sapiens
gtgggtgtttctgga

SEQ ID NO: 29552 - DNA, 15 bp, Homo sapiens
tgtgggtgtttctgg

SEQ ID NO: 29553 - DNA, 15 bp, Homo sapiens
ctgtgggtgtttctg

SEQ ID NO: 29554 - DNA, 15 bp, Homo sapiens
cctgtgggtgtttct

SEQ ID NO: 29555 - DNA, 15 bp, Homo sapiens
gcctgtgggtgtttc

SEQ ID NO: 29556 - DNA, 15 bp, Homo sapiens
tgcctgtgggtgttt

SEQ ID NO: 29557 - DNA, 15 bp, Homo sapiens
atgcctgtgggtgtt

SEQ ID NO: 29558 - DNA, 15 bp, Homo sapiens
catgcctgtgggtgt

SEQ ID NO: 29559 - DNA, 15 bp, Homo sapiens
acatgcctgtgggtg

SEQ ID NO: 29560 - DNA, 15 bp, Homo sapiens
gacatgcctgtgggt

SEQ ID NO: 29561 - DNA, 15 bp, Homo sapiens
ggacatgcctgtggg

SEQ ID NO: 29562 - DNA, 15 bp, Homo sapiens
gggacatgcctgtgg

SEQ ID NO: 29563 - DNA, 15 bp, Homo sapiens
tgggacatgcctgtg

SEQ ID NO: 29564 - DNA, 15 bp, Homo sapiens
atgggacatgcctgt

SEQ ID NO: 29565 - DNA, 15 bp, Homo sapiens
catgggacatgcctg

SEQ ID NO: 29566 - DNA, 15 bp, Homo sapiens
acatgggacatgcct

SEQ ID NO: 29567 - DNA, 15 bp, Homo sapiens
cacatgggacatgcc

SEQ ID NO: 29568 - DNA, 15 bp, Homo sapiens
tcacatgggacatgc

SEQ ID NO: 29569 - DNA, 15 bp, Homo sapiens
ctcacatgggacatg

SEQ ID NO: 29570 - DNA, 15 bp, Homo sapiens
gctcacatgggacat

SEQ ID NO: 29571 - DNA, 15 bp, Homo sapiens
agctcacatgggaca

SEQ ID NO: 29572 - DNA, 15 bp, Homo sapiens
cagctcacatgggac

SEQ ID NO: 29573 - DNA, 15 bp, Homo sapiens
gcagctcacatggga

SEQ ID NO: 29574 - DNA, 15 bp, Homo sapiens
agcagctcacatggg

SEQ ID NO: 29575 - DNA, 15 bp, Homo sapiens
cagcagctcacatgg

SEQ ID NO: 29576 - DNA, 15 bp, Homo sapiens
gcagcagctcacatg

SEQ ID NO: 29577 - DNA, 15 bp, Homo sapiens
ggcagcagctcacat

SEQ ID NO: 29578 - DNA, 15 bp, Homo sapiens
tggcagcagctcaca

SEQ ID NO: 29579 - DNA, 15 bp, Homo sapiens
atggcagcagctcac

SEQ ID NO: 29580 - DNA, 15 bp, Homo sapiens
catggcagcagctca

SEQ ID NO: 29581 - DNA, 15 bp, Homo sapiens
tcatggcagcagctc

SEQ ID NO: 29582 - DNA, 15 bp, Homo sapiens
ttcatggcagcagct

SEQ ID NO: 29583 - DNA, 15 bp, Homo sapiens
gttcatggcagcagc

SEQ ID NO: 29584 - DNA, 15 bp, Homo sapiens
agttcatggcagcag

SEQ ID NO: 29585 - DNA, 15 bp, Homo sapiens
cagttcatggcagca

SEQ ID NO: 29586 - DNA, 15 bp, Homo sapiens
acagttcatggcagc

SEQ ID NO: 29587 - DNA, 15 bp, Homo sapiens
gacagttcatggcag

SEQ ID NO: 29588 - DNA, 15 bp, Homo sapiens
tgacagttcatggca

SEQ ID NO: 29589 - DNA, 15 bp, Homo sapiens
ttgacagttcatggc

SEQ ID NO: 29590 - DNA, 15 bp, Homo sapiens
cttgacagttcatgg

SEQ ID NO: 29591 - DNA, 15 bp, Homo sapiens
acttgacagttcatg

SEQ ID NO: 29592 - DNA, 15 bp, Homo sapiens
cacttgacagttcat

SEQ ID NO: 29593 - DNA, 15 bp, Homo sapiens
acacttgacagttca

SEQ ID NO: 29594 - DNA, 15 bp, Homo sapiens
cacacttgacagttc

SEQ ID NO: 29595 - DNA, 15 bp, Homo sapiens
acacacttgacagtt

SEQ ID NO: 29596 - DNA, 15 bp, Homo sapiens
cacacacttgacagt

SEQ ID NO: 29597 - DNA, 15 bp, Homo sapiens
acacacacttgacag

SEQ ID NO: 29598 - DNA, 15 bp, Homo sapiens
aacacacacttgaca

SEQ ID NO: 29599 - DNA, 15 bp, Homo sapiens
caacacacacttgac

SEQ ID NO: 29600 - DNA, 15 bp, Homo sapiens
acaacacacacttga

SEQ ID NO: 29601 - DNA, 15 bp, Homo sapiens
gacaacacacacttg

SEQ ID NO: 29602 - DNA, 15 bp, Homo sapiens
agacaacacacactt

SEQ ID NO: 29603 - DNA, 15 bp, Homo sapiens
aagacaacacacact

SEQ ID NO: 29604 - DNA, 15 bp, Homo sapiens
caagacaacacacac

SEQ ID NO: 29605 - DNA, 15 bp, Homo sapiens
acaagacaacacaca

SEQ ID NO: 29606 - DNA, 15 bp, Homo sapiens
cacaagacaacacac

SEQ ID NO: 29607 - DNA, 15 bp, Homo sapiens
acacaagacaacaca

SEQ ID NO: 29608 - DNA, 15 bp, Homo sapiens
tacacaagacaacac

SEQ ID NO: 29609 - DNA, 15 bp, Homo sapiens
atacacaagacaaca

SEQ ID NO: 29610 - DNA, 15 bp, Homo sapiens
aatacacaagacaac

SEQ ID NO: 29611 - DNA, 15 bp, Homo sapiens
aaatacacaagacaa

SEQ ID NO: 29612 - DNA, 15 bp, Homo sapiens
gaaatacacaagaca

SEQ ID NO: 29613 - DNA, 15 bp, Homo sapiens
tgaaatacacaagac

SEQ ID NO: 29614 - DNA, 15 bp, Homo sapiens
ctgaaatacacaaga

SEQ ID NO: 29615 - DNA, 15 bp, Homo sapiens
actgaaatacacaag

SEQ ID NO: 29616 - DNA, 15 bp, Homo sapiens
aactgaaatacacaa

SEQ ID NO: 29617 - DNA, 15 bp, Homo sapiens
taactgaaatacaca

SEQ ID NO: 29618 - DNA, 15 bp, Homo sapiens
ataactgaaatacac

SEQ ID NO: 29619 - DNA, 15 bp, Homo sapiens
aataactgaaataca

SEQ ID NO: 29620 - DNA, 15 bp, Homo sapiens
caataactgaaatac

SEQ ID NO: 29621 - DNA, 15 bp, Homo sapiens
acaataactgaaata

SEQ ID NO: 29622 - DNA, 15 bp, Homo sapiens
gacaataactgaaat

SEQ ID NO: 29623 - DNA, 15 bp, Homo sapiens
ggacaataactgaaa

SEQ ID NO: 29624 - DNA, 15 bp, Homo sapiens
gggacaataactgaa

SEQ ID NO: 29625 - DNA, 15 bp, Homo sapiens
agggacaataactga

SEQ ID NO: 29626 - DNA, 15 bp, Homo sapiens
cagggacaataactg

SEQ ID NO: 29627 - DNA, 15 bp, Homo sapiens
ccagggacaataact

SEQ ID NO: 29628 - DNA, 15 bp, Homo sapiens
gccagggacaataac

SEQ ID NO: 29629 - DNA, 15 bp, Homo sapiens
agccagggacaataa

SEQ ID NO: 29630 - DNA, 15 bp, Homo sapiens
aagccagggacaata

SEQ ID NO: 29631 - DNA, 15 bp, Homo sapiens
gaagccagggacaat

SEQ ID NO: 29632 - DNA, 15 bp, Homo sapiens
ggaagccagggacaa

SEQ ID NO: 29633 - DNA, 15 bp, Homo sapiens
aggaagccagggaca

SEQ ID NO: 29634 - DNA, 15 bp, Homo sapiens
aaggaagccagggac

SEQ ID NO: 29635 - DNA, 15 bp, Homo sapiens
taaggaagccaggga

SEQ ID NO: 29636 - DNA, 15 bp, Homo sapiens
gtaaggaagccaggg

SEQ ID NO: 29637 - DNA, 15 bp, Homo sapiens
agtaaggaagccagg

SEQ ID NO: 29638 - DNA, 15 bp, Homo sapiens
tagtaaggaagccag

SEQ ID NO: 29639 - DNA, 15 bp, Homo sapiens
atagtaaggaagcca

SEQ ID NO: 29640 - DNA, 15 bp, Homo sapiens
catagtaaggaagcc

SEQ ID NO: 29641 - DNA, 15 bp, Homo sapiens
ccatagtaaggaagc

SEQ ID NO: 29642 - DNA, 15 bp, Homo sapiens
accatagtaaggaag

SEQ ID NO: 29643 - DNA, 15 bp, Homo sapiens
caccatagtaaggaa

SEQ ID NO: 29644 - DNA, 15 bp, Homo sapiens
acaccatagtaagga

SEQ ID NO: 29645 - DNA, 15 bp, Homo sapiens
tacaccatagtaagg

SEQ ID NO: 29646 - DNA, 15 bp, Homo sapiens
ttacaccatagtaag

SEQ ID NO: 29647 - DNA, 15 bp, Homo sapiens
attacaccatagtaa

SEQ ID NO: 29648 - DNA, 15 bp, Homo sapiens
gattacaccatagta

SEQ ID NO: 29649 - DNA, 15 bp, Homo sapiens
tgattacaccatagt

SEQ ID NO: 29650 - DNA, 15 bp, Homo sapiens
atgattacaccatag

SEQ ID NO: 29651 - DNA, 15 bp, Homo sapiens
catgattacaccata

SEQ ID NO: 29652 - DNA, 15 bp, Homo sapiens
tcatgattacaccat

SEQ ID NO: 29653 - DNA, 15 bp, Homo sapiens
ttcatgattacacca

SEQ ID NO: 29654 - DNA, 15 bp, Homo sapiens
cttcatgattacacc

SEQ ID NO: 29655 - DNA, 15 bp, Homo sapiens
ccttcatgattacac

SEQ ID NO: 29656 - DNA, 15 bp, Homo sapiens
tccttcatgattaca

SEQ ID NO: 29657 - DNA, 15 bp, Homo sapiens
ctccttcatgattac

SEQ ID NO: 29658 - DNA, 15 bp, Homo sapiens
actccttcatgatta

SEQ ID NO: 29659 - DNA, 15 bp, Homo sapiens
cactccttcatgatt

SEQ ID NO: 29660 - DNA, 15 bp, Homo sapiens
tcactccttcatgat

SEQ ID NO: 29661 - DNA, 15 bp, Homo sapiens
ttcactccttcatga

SEQ ID NO: 29662 - DNA, 15 bp, Homo sapiens
tttcactccttcatg

SEQ ID NO: 29663 - DNA, 15 bp, Homo sapiens
gtttcactccttcat

SEQ ID NO: 29664 - DNA, 15 bp, Homo sapiens
tgtttcactccttca

SEQ ID NO: 29665 - DNA, 15 bp, Homo sapiens
atgtttcactccttc

SEQ ID NO: 29666 - DNA, 15 bp, Homo sapiens
gatgtttcactcctt

SEQ ID NO: 29667 - DNA, 15 bp, Homo sapiens
tgatgtttcactcct

SEQ ID NO: 29668 - DNA, 15 bp, Homo sapiens
atgatgtttcactcc

SEQ ID NO: 29669 - DNA, 15 bp, Homo sapiens
tatgatgtttcactc

SEQ ID NO: 29670 - DNA, 15 bp, Homo sapiens
ctatgatgtttcact

SEQ ID NO: 29671 - DNA, 15 bp, Homo sapiens
tctatgatgtttcac

SEQ ID NO: 29672 - DNA, 15 bp, Homo sapiens
ttctatgatgtttca

SEQ ID NO: 29673 - DNA, 15 bp, Homo sapiens
tttctatgatgtttc

SEQ ID NO: 29674 - DNA, 15 bp, Homo sapiens
gtttctatgatgttt

SEQ ID NO: 29675 - DNA, 15 bp, Homo sapiens
agtttctatgatgtt

SEQ ID NO: 29676 - DNA, 15 bp, Homo sapiens
cagtttctatgatgt

SEQ ID NO: 29677 - DNA, 15 bp, Homo sapiens
acagtttctatgatg

SEQ ID NO: 29678 - DNA, 15 bp, Homo sapiens
gacagtttctatgat

SEQ ID NO: 29679 - DNA, 15 bp, Homo sapiens
agacagtttctatga

SEQ ID NO: 29680 - DNA, 15 bp, Homo sapiens
tagacagtttctatg

SEQ ID NO: 29681 - DNA, 15 bp, Homo sapiens
ctagacagtttctat

SEQ ID NO: 29682 - DNA, 15 bp, Homo sapiens
gctagacagtttcta

SEQ ID NO: 29683 - DNA, 15 bp, Homo sapiens
tgctagacagtttct

SEQ ID NO: 29684 - DNA, 15 bp, Homo sapiens
gtgctagacagtttc

SEQ ID NO: 29685 - DNA, 15 bp, Homo sapiens
agtgctagacagttt

SEQ ID NO: 29686 - DNA, 15 bp, Homo sapiens
aagtgctagacagtt

SEQ ID NO: 29687 - DNA, 15 bp, Homo sapiens
gaagtgctagacagt

SEQ ID NO: 29688 - DNA, 15 bp, Homo sapiens
ggaagtgctagacag

SEQ ID NO: 29689 - DNA, 15 bp, Homo sapiens
aggaagtgctagaca

SEQ ID NO: 29690 - DNA, 15 bp, Homo sapiens
aaggaagtgctagac

SEQ ID NO: 29691 - DNA, 15 bp, Homo sapiens
caaggaagtgctaga

SEQ ID NO: 29692 - DNA, 15 bp, Homo sapiens
gcaaggaagtgctag

SEQ ID NO: 29693 - DNA, 15 bp, Homo sapiens
ggcaaggaagtgcta

SEQ ID NO: 29694 - DNA, 15 bp, Homo sapiens
tggcaaggaagtgct

SEQ ID NO: 29695 - DNA, 15 bp, Homo sapiens
ctggcaaggaagtgc

SEQ ID NO: 29696 - DNA, 15 bp, Homo sapiens
actggcaaggaagtg

SEQ ID NO: 29697 - DNA, 15 bp, Homo sapiens
gactggcaaggaagt

SEQ ID NO: 29698 - DNA, 15 bp, Homo sapiens
agactggcaaggaag

SEQ ID NO: 29699 - DNA, 15 bp, Homo sapiens
aagactggcaaggaa

SEQ ID NO: 29700 - DNA, 15 bp, Homo sapiens
aaagactggcaagga

SEQ ID NO: 29701 - DNA, 15 bp, Homo sapiens
taaagactggcaagg

SEQ ID NO: 29702 - DNA, 15 bp, Homo sapiens
ctaaagactggcaag

SEQ ID NO: 29703 - DNA, 15 bp, Homo sapiens
actaaagactggcaa

SEQ ID NO: 29704 - DNA, 15 bp, Homo sapiens
cactaaagactggca

SEQ ID NO: 29705 - DNA, 15 bp, Homo sapiens
tcactaaagactggc

SEQ ID NO: 29706 - DNA, 15 bp, Homo sapiens
atcactaaagactgg

SEQ ID NO: 29707 - DNA, 15 bp, Homo sapiens
gatcactaaagactg

SEQ ID NO: 29708 - DNA, 15 bp, Homo sapiens
tgatcactaaagact

SEQ ID NO: 29709 - DNA, 15 bp, Homo sapiens
ctgatcactaaagac

SEQ ID NO: 29710 - DNA, 15 bp, Homo sapiens
cctgatcactaaaga

SEQ ID NO: 29711 - DNA, 15 bp, Homo sapiens
tcctgatcactaaag

SEQ ID NO: 29712 - DNA, 15 bp, Homo sapiens
ttcctgatcactaaa

SEQ ID NO: 29713 - DNA, 15 bp, Homo sapiens
gttcctgatcactaa

SEQ ID NO: 29714 - DNA, 15 bp, Homo sapiens
ggttcctgatcacta

SEQ ID NO: 29715 - DNA, 15 bp, Homo sapiens
tggttcctgatcact

SEQ ID NO: 29716 - DNA, 15 bp, Homo sapiens
atggttcctgatcac

SEQ ID NO: 29717 - DNA, 15 bp, Homo sapiens
tatggttcctgatca

SEQ ID NO: 29718 - DNA, 15 bp, Homo sapiens
ctatggttcctgatc

SEQ ID NO: 29719 - DNA, 15 bp, Homo sapiens
actatggttcctgat

SEQ ID NO: 29720 - DNA, 15 bp, Homo sapiens
aactatggttcctga

SEQ ID NO: 29721 - DNA, 15 bp, Homo sapiens
caactatggttcctg

SEQ ID NO: 29722 - DNA, 15 bp, Homo sapiens
tcaactatggttcct

SEQ ID NO: 29723 - DNA, 15 bp, Homo sapiens
gtcaactatggttcc

SEQ ID NO: 29724 - DNA, 15 bp, Homo sapiens
tgtcaactatggttc

SEQ ID NO: 29725 - DNA, 15 bp, Homo sapiens
ctgtcaactatggtt

SEQ ID NO: 29726 - DNA, 15 bp, Homo sapiens
actgtcaactatggt

SEQ ID NO: 29727 - DNA, 15 bp, Homo sapiens
aactgtcaactatgg

SEQ ID NO: 29728 - DNA, 15 bp, Homo sapiens
gaactgtcaactatg

SEQ ID NO: 29729 - DNA, 15 bp, Homo sapiens
ggaactgtcaactat

SEQ ID NO: 29730 - DNA, 15 bp, Homo sapiens
tggaactgtcaacta

SEQ ID NO: 29731 - DNA, 15 bp, Homo sapiens
ttggaactgtcaact

SEQ ID NO: 29732 - DNA, 15 bp, Homo sapiens
attggaactgtcaac

SEQ ID NO: 29733 - DNA, 15 bp, Homo sapiens
gattggaactgtcaa

SEQ ID NO: 29734 - DNA, 15 bp, Homo sapiens
tgattggaactgtca

SEQ ID NO: 29735 - DNA, 15 bp, Homo sapiens
ctgattggaactgtc

SEQ ID NO: 29736 - DNA, 15 bp, Homo sapiens
actgattggaactgt

SEQ ID NO: 29737 - DNA, 15 bp, Homo sapiens
tactgattggaactg

SEQ ID NO: 29738 - DNA, 15 bp, Homo sapiens
ctactgattggaact

SEQ ID NO: 29739 - DNA, 15 bp, Homo sapiens
gctactgattggaac

SEQ ID NO: 29740 - DNA, 15 bp, Homo sapiens
agctactgattggaa

SEQ ID NO: 29741 - DNA, 15 bp, Homo sapiens
aagctactgattgga

SEQ ID NO: 29742 - DNA, 15 bp, Homo sapiens
taagctactgattgg

SEQ ID NO: 29743 - DNA, 15 bp, Homo sapiens
ttaagctactgattg

SEQ ID NO: 29744 - DNA, 15 bp, Homo sapiens
cttaagctactgatt

SEQ ID NO: 29745 - DNA, 15 bp, Homo sapiens
tcttaagctactgat

SEQ ID NO: 29746 - DNA, 15 bp, Homo sapiens
ttcttaagctactga

SEQ ID NO: 29747 - DNA, 15 bp, Homo sapiens
tttcttaagctactg

SEQ ID NO: 29748 - DNA, 15 bp, Homo sapiens
ttttcttaagctact

SEQ ID NO: 29749 - DNA, 15 bp, Homo sapiens
tttttcttaagctac

SEQ ID NO: 29750 - DNA, 15 bp, Homo sapiens
ttttttcttaagcta

SEQ ID NO: 29751 - DNA, 15 bp, Homo sapiens
gttttttcttaagct

SEQ ID NO: 29752 - DNA, 15 bp, Homo sapiens
ggttttttcttaagc

SEQ ID NO: 29753 - DNA, 15 bp, Homo sapiens
cggttttttcttaag

SEQ ID NO: 29754 - DNA, 15 bp, Homo sapiens
acggttttttcttaa

SEQ ID NO: 29755 - DNA, 15 bp, Homo sapiens
cacggttttttctta

SEQ ID NO: 29756 - DNA, 15 bp, Homo sapiens
acacggttttttctt

SEQ ID NO: 29757 - DNA, 15 bp, Homo sapiens
aacacggttttttct

SEQ ID NO: 29758 - DNA, 15 bp, Homo sapiens
aaacacggttttttc

SEQ ID NO: 29759 - DNA, 15 bp, Homo sapiens
caaacacggtttttt

SEQ ID NO: 29760 - DNA, 15 bp, Homo sapiens
acaaacacggttttt

SEQ ID NO: 29761 - DNA, 15 bp, Homo sapiens
gacaaacacggtttt

SEQ ID NO: 29762 - DNA, 15 bp, Homo sapiens
agacaaacacggttt

SEQ ID NO: 29763 - DNA, 15 bp, Homo sapiens
gagacaaacacggtt

SEQ ID NO: 29764 - DNA, 15 bp, Homo sapiens
agagacaaacacggt

SEQ ID NO: 29765 - DNA, 15 bp, Homo sapiens
aagagacaaacacgg

SEQ ID NO: 29766 - DNA, 15 bp, Homo sapiens
gaagagacaaacacg

SEQ ID NO: 29767 - DNA, 15 bp, Homo sapiens
agaagagacaaacac

SEQ ID NO: 29768 - DNA, 15 bp, Homo sapiens
cagaagagacaaaca

SEQ ID NO: 29769 - DNA, 15 bp, Homo sapiens
ccagaagagacaaac

SEQ ID NO: 29770 - DNA, 15 bp, Homo sapiens
tccagaagagacaaa

SEQ ID NO: 29771 - DNA, 15 bp, Homo sapiens
ttccagaagagacaa

SEQ ID NO: 29772 - DNA, 15 bp, Homo sapiens
attccagaagagaca

SEQ ID NO: 29773 - DNA, 15 bp, Homo sapiens
cattccagaagagac

SEQ ID NO: 29774 - DNA, 15 bp, Homo sapiens
ccattccagaagaga

SEQ ID NO: 29775 - DNA, 15 bp, Homo sapiens
accattccagaagag

SEQ ID NO: 29776 - DNA, 15 bp, Homo sapiens
aaccattccagaaga

SEQ ID NO: 29777 - DNA, 15 bp, Homo sapiens
taaccattccagaag

SEQ ID NO: 29778 - DNA, 15 bp, Homo sapiens
ctaaccattccagaa

SEQ ID NO: 29779 - DNA, 15 bp, Homo sapiens
tctaaccattccaga

SEQ ID NO: 29780 - DNA, 15 bp, Homo sapiens
ttctaaccattccag

SEQ ID NO: 29781 - DNA, 15 bp, Homo sapiens
cttctaaccattcca

SEQ ID NO: 29782 - DNA, 15 bp, Homo sapiens
acttctaaccattcc

SEQ ID NO: 29783 - DNA, 15 bp, Homo sapiens
cacttctaaccattc

SEQ ID NO: 29784 - DNA, 15 bp, Homo sapiens
tcacttctaaccatt

SEQ ID NO: 29785 - DNA, 15 bp, Homo sapiens
ctcacttctaaccat

SEQ ID NO: 29786 - DNA, 15 bp, Homo sapiens
cctcacttctaacca

SEQ ID NO: 29787 - DNA, 15 bp, Homo sapiens
ccctcacttctaacc

SEQ ID NO: 29788 - DNA, 15 bp, Homo sapiens
tccctcacttctaac

SEQ ID NO: 29789 - DNA, 15 bp, Homo sapiens
ctccctcacttctaa

SEQ ID NO: 29790 - DNA, 15 bp, Homo sapiens
actccctcacttcta

SEQ ID NO: 29791 - DNA, 15 bp, Homo sapiens
aactccctcacttct

SEQ ID NO: 29792 - DNA, 15 bp, Homo sapiens
aaactccctcacttc

SEQ ID NO: 29793 - DNA, 15 bp, Homo sapiens
caaactccctcactt

SEQ ID NO: 29794 - DNA, 15 bp, Homo sapiens
gcaaactccctcact

SEQ ID NO: 29795 - DNA, 15 bp, Homo sapiens
ggcaaactccctcac

SEQ ID NO: 29796 - DNA, 15 bp, Homo sapiens
gggcaaactccctca

SEQ ID NO: 29797 - DNA, 15 bp, Homo sapiens
ggggcaaactccctc

SEQ ID NO: 29798 - DNA, 15 bp, Homo sapiens
cggggcaaactccct

SEQ ID NO: 29799 - DNA, 15 bp, Homo sapiens
acggggcaaactccc

SEQ ID NO: 29800 - DNA, 15 bp, Homo sapiens
aacggggcaaactcc

SEQ ID NO: 29801 - DNA, 15 bp, Homo sapiens
gaacggggcaaactc

SEQ ID NO: 29802 - DNA, 15 bp, Homo sapiens
agaacggggcaaact

SEQ ID NO: 29803 - DNA, 15 bp, Homo sapiens
cagaacggggcaaac

SEQ ID NO: 29804 - DNA, 15 bp, Homo sapiens
acagaacggggcaaa

SEQ ID NO: 29805 - DNA, 15 bp, Homo sapiens
aacagaacggggcaa

SEQ ID NO: 29806 - DNA, 15 bp, Homo sapiens
aaacagaacggggca

SEQ ID NO: 29807 - DNA, 15 bp, Homo sapiens
caaacagaacggggc

SEQ ID NO: 29808 - DNA, 15 bp, Homo sapiens
acaaacagaacgggg

SEQ ID NO: 29809 - DNA, 15 bp, Homo sapiens
tacaaacagaacggg

SEQ ID NO: 29810 - DNA, 15 bp, Homo sapiens
ctacaaacagaacgg

SEQ ID NO: 29811 - DNA, 15 bp, Homo sapiens
tctacaaacagaacg

SEQ ID NO: 29812 - DNA, 15 bp, Homo sapiens
ctctacaaacagaac

SEQ ID NO: 29813 - DNA, 15 bp, Homo sapiens
actctacaaacagaa

SEQ ID NO: 29814 - DNA, 15 bp, Homo sapiens
gactctacaaacaga

SEQ ID NO: 29815 - DNA, 15 bp, Homo sapiens
agactctacaaacag

SEQ ID NO: 29816 - DNA, 15 bp, Homo sapiens
gagactctacaaaca

SEQ ID NO: 29817 - DNA, 15 bp, Homo sapiens
tgagactctacaaac

SEQ ID NO: 29818 - DNA, 15 bp, Homo sapiens
atgagactctacaaa

SEQ ID NO: 29819 - DNA, 15 bp, Homo sapiens
tatgagactctacaa

SEQ ID NO: 29820 - DNA, 15 bp, Homo sapiens
ctatgagactctaca

SEQ ID NO: 29821 - DNA, 15 bp, Homo sapiens
actatgagactctac

SEQ ID NO: 29822 - DNA, 15 bp, Homo sapiens
aactatgagactcta

SEQ ID NO: 29823 - DNA, 15 bp, Homo sapiens
caactatgagactct

SEQ ID NO: 29824 - DNA, 15 bp, Homo sapiens
ccaactatgagactc

SEQ ID NO: 29825 - DNA, 15 bp, Homo sapiens
tccaactatgagact

SEQ ID NO: 29826 - DNA, 15 bp, Homo sapiens
gtccaactatgagac

SEQ ID NO: 29827 - DNA, 15 bp, Homo sapiens
agtccaactatgaga

SEQ ID NO: 29828 - DNA, 15 bp, Homo sapiens
aagtccaactatgag

SEQ ID NO: 29829 - DNA, 15 bp, Homo sapiens
aaagtccaactatga

SEQ ID NO: 29830 - DNA, 15 bp, Homo sapiens
gaaagtccaactatg

SEQ ID NO: 29831 - DNA, 15 bp, Homo sapiens
agaaagtccaactat

SEQ ID NO: 29832 - DNA, 15 bp, Homo sapiens
tagaaagtccaacta

SEQ ID NO: 29833 - DNA, 15 bp, Homo sapiens
ctagaaagtccaact

SEQ ID NO: 29834 - DNA, 15 bp, Homo sapiens
gctagaaagtccaac

SEQ ID NO: 29835 - DNA, 15 bp, Homo sapiens
tgctagaaagtccaa

SEQ ID NO: 29836 - DNA, 15 bp, Homo sapiens
atgctagaaagtcca

SEQ ID NO: 29837 - DNA, 15 bp, Homo sapiens
tatgctagaaagtcc

SEQ ID NO: 29838 - DNA, 15 bp, Homo sapiens
atatgctagaaagtc

SEQ ID NO: 29839 - DNA, 15 bp, Homo sapiens
tatatgctagaaagt

SEQ ID NO: 29840 - DNA, 15 bp, Homo sapiens
atatatgctagaaag

SEQ ID NO: 29841 - DNA, 15 bp, Homo sapiens
catatatgctagaaa

SEQ ID NO: 29842 - DNA, 15 bp, Homo sapiens
acatatatgctagaa

SEQ ID NO: 29843 - DNA, 15 bp, Homo sapiens
cacatatatgctaga

SEQ ID NO: 29844 - DNA, 15 bp, Homo sapiens
acacatatatgctag

SEQ ID NO: 29845 - DNA, 15 bp, Homo sapiens
gacacatatatgcta

SEQ ID NO: 29846 - DNA, 15 bp, Homo sapiens
ggacacatatatgct

SEQ ID NO: 29847 - DNA, 15 bp, Homo sapiens
tggacacatatatgc

SEQ ID NO: 29848 - DNA, 15 bp, Homo sapiens
atggacacatatatg

SEQ ID NO: 29849 - DNA, 15 bp, Homo sapiens
aatggacacatatat

SEQ ID NO: 29850 - DNA, 15 bp, Homo sapiens
aaatggacacatata

SEQ ID NO: 29851 - DNA, 15 bp, Homo sapiens
gaaatggacacatat

SEQ ID NO: 29852 - DNA, 15 bp, Homo sapiens
ggaaatggacacata

SEQ ID NO: 29853 - DNA, 15 bp, Homo sapiens
aggaaatggacacat

SEQ ID NO: 29854 - DNA, 15 bp, Homo sapiens
aaggaaatggacaca

SEQ ID NO: 29855 - DNA, 15 bp, Homo sapiens
taaggaaatggacac

SEQ ID NO: 29856 - DNA, 15 bp, Homo sapiens
ataaggaaatggaca

SEQ ID NO: 29857 - DNA, 15 bp, Homo sapiens
cataaggaaatggac

SEQ ID NO: 29858 - DNA, 15 bp, Homo sapiens
gcataaggaaatgga

SEQ ID NO: 29859 - DNA, 15 bp, Homo sapiens
agcataaggaaatgg

SEQ ID NO: 29860 - DNA, 15 bp, Homo sapiens
cagcataaggaaatg

SEQ ID NO: 29861 - DNA, 15 bp, Homo sapiens
acagcataaggaaat

SEQ ID NO: 29862 - DNA, 15 bp, Homo sapiens
tacagcataaggaaa

SEQ ID NO: 29863 - DNA, 15 bp, Homo sapiens
ttacagcataaggaa

SEQ ID NO: 29864 - DNA, 15 bp, Homo sapiens
tttacagcataagga

SEQ ID NO: 29865 - DNA, 15 bp, Homo sapiens
ttttacagcataagg

SEQ ID NO: 29866 - DNA, 15 bp, Homo sapiens
cttttacagcataag

SEQ ID NO: 29867 - DNA, 15 bp, Homo sapiens
gcttttacagcataa

SEQ ID NO: 29868 - DNA, 15 bp, Homo sapiens
tgcttttacagcata

SEQ ID NO: 29869 - DNA, 15 bp, Homo sapiens
ttgcttttacagcat

SEQ ID NO: 29870 - DNA, 15 bp, Homo sapiens
cttgcttttacagca

SEQ ID NO: 29871 - DNA, 15 bp, Homo sapiens
acttgcttttacagc

SEQ ID NO: 29872 - DNA, 15 bp, Homo sapiens
gacttgcttttacag

SEQ ID NO: 29873 - DNA, 15 bp, Homo sapiens
ggacttgcttttaca

SEQ ID NO: 29874 - DNA, 15 bp, Homo sapiens
aggacttgcttttac

SEQ ID NO: 29875 - DNA, 15 bp, Homo sapiens
caggacttgctttta

SEQ ID NO: 29876 - DNA, 15 bp, Homo sapiens
gcaggacttgctttt

SEQ ID NO: 29877 - DNA, 15 bp, Homo sapiens
tgcaggacttgcttt

SEQ ID NO: 29878 - DNA, 15 bp, Homo sapiens
ttgcaggacttgctt

SEQ ID NO: 29879 - DNA, 15 bp, Homo sapiens
gttgcaggacttgct

SEQ ID NO: 29880 - DNA, 15 bp, Homo sapiens
ggttgcaggacttgc

SEQ ID NO: 29881 - DNA, 15 bp, Homo sapiens
tggttgcaggacttg

SEQ ID NO: 29882 - DNA, 15 bp, Homo sapiens
ttggttgcaggactt

SEQ ID NO: 29883 - DNA, 15 bp, Homo sapiens
tttggttgcaggact

SEQ ID NO: 29884 - DNA, 15 bp, Homo sapiens
gtttggttgcaggac

SEQ ID NO: 29885 - DNA, 15 bp, Homo sapiens
agtttggttgcagga

SEQ ID NO: 29886 - DNA, 15 bp, Homo sapiens
gagtttggttgcagg

SEQ ID NO: 29887 - DNA, 15 bp, Homo sapiens
ggagtttggttgcag

SEQ ID NO: 29888 - DNA, 15 bp, Homo sapiens
gggagtttggttgca

SEQ ID NO: 29889 - DNA, 15 bp, Homo sapiens
tgggagtttggttgc

SEQ ID NO: 29890 - DNA, 15 bp, Homo sapiens
atgggagtttggttg

SEQ ID NO: 29891 - DNA, 15 bp, Homo sapiens
gatgggagtttggtt

SEQ ID NO: 29892 - DNA, 15 bp, Homo sapiens
tgatgggagtttggt

SEQ ID NO: 29893 - DNA, 15 bp, Homo sapiens
ctgatgggagtttgg

SEQ ID NO: 29894 - DNA, 15 bp, Homo sapiens
gctgatgggagtttg

SEQ ID NO: 29895 - DNA, 15 bp, Homo sapiens
ggctgatgggagttt

SEQ ID NO: 29896 - DNA, 15 bp, Homo sapiens
gggctgatgggagtt

SEQ ID NO: 29897 - DNA, 15 bp, Homo sapiens
tgggctgatgggagt

SEQ ID NO: 29898 - DNA, 15 bp, Homo sapiens
ttgggctgatgggag

SEQ ID NO: 29899 - DNA, 15 bp, Homo sapiens
attgggctgatggga

SEQ ID NO: 29900 - DNA, 15 bp, Homo sapiens
gattgggctgatggg

SEQ ID NO: 29901 - DNA, 15 bp, Homo sapiens
ggattgggctgatgg

SEQ ID NO: 29902 - DNA, 15 bp, Homo sapiens
gggattgggctgatg

SEQ ID NO: 29903 - DNA, 15 bp, Homo sapiens
agggattgggctgat

SEQ ID NO: 29904 - DNA, 15 bp, Homo sapiens
cagggattgggctga

SEQ ID NO: 29905 - DNA, 15 bp, Homo sapiens
tcagggattgggctg

SEQ ID NO: 29906 - DNA, 15 bp, Homo sapiens
atcagggattgggct

SEQ ID NO: 29907 - DNA, 15 bp, Homo sapiens
gatcagggattgggc

SEQ ID NO: 29908 - DNA, 15 bp, Homo sapiens
ggatcagggattggg

SEQ ID NO: 29909 - DNA, 15 bp, Homo sapiens
gggatcagggattgg

SEQ ID NO: 29910 - DNA, 15 bp, Homo sapiens
agggatcagggattg

SEQ ID NO: 29911 - DNA, 15 bp, Homo sapiens
cagggatcagggatt

SEQ ID NO: 29912 - DNA, 15 bp, Homo sapiens
tcagggatcagggat

SEQ ID NO: 29913 - DNA, 15 bp, Homo sapiens
atcagggatcaggga

SEQ ID NO: 29914 - DNA, 15 bp, Homo sapiens
gatcagggatcaggg

SEQ ID NO: 29915 - DNA, 15 bp, Homo sapiens
ggatcagggatcagg

SEQ ID NO: 29916 - DNA, 15 bp, Homo sapiens
gggatcagggatcag

SEQ ID NO: 29917 - DNA, 15 bp, Homo sapiens
agggatcagggatca

SEQ ID NO: 29918 - DNA, 15 bp, Homo sapiens
aagggatcagggatc

SEQ ID NO: 29919 - DNA, 15 bp, Homo sapiens
gaagggatcagggat

SEQ ID NO: 29920 - DNA, 15 bp, Homo sapiens
ggaagggatcaggga

SEQ ID NO: 29921 - DNA, 15 bp, Homo sapiens
tggaagggatcaggg

SEQ ID NO: 29922 - DNA, 15 bp, Homo sapiens
gtggaagggatcagg

SEQ ID NO: 29923 - DNA, 15 bp, Homo sapiens
ggtggaagggatcag

SEQ ID NO: 29924 - DNA, 15 bp, Homo sapiens
aggtggaagggatca

SEQ ID NO: 29925 - DNA, 15 bp, Homo sapiens
caggtggaagggatc

SEQ ID NO: 29926 - DNA, 15 bp, Homo sapiens
gcaggtggaagggat

SEQ ID NO: 29927 - DNA, 15 bp, Homo sapiens
agcaggtggaaggga

SEQ ID NO: 29928 - DNA, 15 bp, Homo sapiens
gagcaggtggaaggg

SEQ ID NO: 29929 - DNA, 15 bp, Homo sapiens
agagcaggtggaagg

SEQ ID NO: 29930 - DNA, 15 bp, Homo sapiens
cagagcaggtggaag

SEQ ID NO: 29931 - DNA, 15 bp, Homo sapiens
gcagagcaggtggaa

SEQ ID NO: 29932 - DNA, 15 bp, Homo sapiens
agcagagcaggtgga

SEQ ID NO: 29933 - DNA, 15 bp, Homo sapiens
cagcagagcaggtgg

SEQ ID NO: 29934 - DNA, 15 bp, Homo sapiens
tcagcagagcaggtg

SEQ ID NO: 29935 - DNA, 15 bp, Homo sapiens
atcagcagagcaggt

SEQ ID NO: 29936 - DNA, 15 bp, Homo sapiens
catcagcagagcagg

SEQ ID NO: 29937 - DNA, 15 bp, Homo sapiens
tcatcagcagagcag

SEQ ID NO: 29938 - DNA, 15 bp, Homo sapiens
gtcatcagcagagca

SEQ ID NO: 29939 - DNA, 15 bp, Homo sapiens
ggtcatcagcagagc

SEQ ID NO: 29940 - DNA, 15 bp, Homo sapiens
gggtcatcagcagag

SEQ ID NO: 29941 - DNA, 15 bp, Homo sapiens
ggggtcatcagcaga

SEQ ID NO: 29942 - DNA, 15 bp, Homo sapiens
gggggtcatcagcag

SEQ ID NO: 29943 - DNA, 15 bp, Homo sapiens
ggggggtcatcagca

SEQ ID NO: 29944 - DNA, 15 bp, Homo sapiens
gggggggtcatcagc

SEQ ID NO: 29945 - DNA, 15 bp, Homo sapiens
tgggggggtcatcag

SEQ ID NO: 29946 - DNA, 15 bp, Homo sapiens
ctgggggggtcatca

SEQ ID NO: 29947 - DNA, 15 bp, Homo sapiens
gctgggggggtcatc

SEQ ID NO: 29948 - DNA, 15 bp, Homo sapiens
agctgggggggtcat

SEQ ID NO: 29949 - DNA, 15 bp, Homo sapiens
aagctgggggggtca

SEQ ID NO: 29950 - DNA, 15 bp, Homo sapiens
gaagctgggggggtc

SEQ ID NO: 29951 - DNA, 15 bp, Homo sapiens
tgaagctgggggggt

SEQ ID NO: 29952 - DNA, 15 bp, Homo sapiens
gtgaagctggggggg

SEQ ID NO: 29953 - DNA, 15 bp, Homo sapiens
agtgaagctgggggg

SEQ ID NO: 29954 - DNA, 15 bp, Homo sapiens
aagtgaagctggggg

SEQ ID NO: 29955 - DNA, 15 bp, Homo sapiens
gaagtgaagctgggg

SEQ ID NO: 29956 - DNA, 15 bp, Homo sapiens
agaagtgaagctggg

SEQ ID NO: 29957 - DNA, 15 bp, Homo sapiens
cagaagtgaagctgg

SEQ ID NO: 29958 - DNA, 15 bp, Homo sapiens
tcagaagtgaagctg

SEQ ID NO: 29959 - DNA, 15 bp, Homo sapiens
gtcagaagtgaagct

SEQ ID NO: 29960 - DNA, 15 bp, Homo sapiens
agtcagaagtgaagc

SEQ ID NO: 29961 - DNA, 15 bp, Homo sapiens
gagtcagaagtgaag

SEQ ID NO: 29962 - DNA, 15 bp, Homo sapiens
agagtcagaagtgaa

SEQ ID NO: 29963 - DNA, 15 bp, Homo sapiens
aagagtcagaagtga

SEQ ID NO: 29964 - DNA, 15 bp, Homo sapiens
gaagagtcagaagtg

SEQ ID NO: 29965 - DNA, 15 bp, Homo sapiens
ggaagagtcagaagt

SEQ ID NO: 29966 - DNA, 15 bp, Homo sapiens
gggaagagtcagaag

SEQ ID NO: 29967 - DNA, 15 bp, Homo sapiens
ggggaagagtcagaa

SEQ ID NO: 29968 - DNA, 15 bp, Homo sapiens
tggggaagagtcaga

SEQ ID NO: 29969 - DNA, 15 bp, Homo sapiens
ctggggaagagtcag

SEQ ID NO: 29970 - DNA, 15 bp, Homo sapiens
cctggggaagagtca

SEQ ID NO: 29971 - DNA, 15 bp, Homo sapiens
tcctggggaagagtc

SEQ ID NO: 29972 - DNA, 15 bp, Homo sapiens
ttcctggggaagagt

SEQ ID NO: 29973 - DNA, 15 bp, Homo sapiens
cttcctggggaagag

SEQ ID NO: 29974 - DNA, 15 bp, Homo sapiens
ccttcctggggaaga

SEQ ID NO: 29975 - DNA, 15 bp, Homo sapiens
cccttcctggggaag

SEQ ID NO: 29976 - DNA, 15 bp, Homo sapiens
tcccttcctggggaa

SEQ ID NO: 29977 - DNA, 15 bp, Homo sapiens
ttcccttcctgggga

SEQ ID NO: 29978 - DNA, 15 bp, Homo sapiens
cttcccttcctgggg

SEQ ID NO: 29979 - DNA, 15 bp, Homo sapiens
ccttcccttcctggg

SEQ ID NO: 29980 - DNA, 15 bp, Homo sapiens
cccttcccttcctgg

SEQ ID NO: 29981 - DNA, 15 bp, Homo sapiens
ccccttcccttcctg

SEQ ID NO: 29982 - DNA, 15 bp, Homo sapiens
cccccttcccttcct

SEQ ID NO: 29983 - DNA, 15 bp, Homo sapiens
ccccccttcccttcc

SEQ ID NO: 29984 - DNA, 15 bp, Homo sapiens
accccccttcccttc

SEQ ID NO: 29985 - DNA, 15 bp, Homo sapiens
gaccccccttccctt

SEQ ID NO: 29986 - DNA, 15 bp, Homo sapiens
tgaccccccttccct

SEQ ID NO: 29987 - DNA, 15 bp, Homo sapiens
ctgaccccccttccc

SEQ ID NO: 29988 - DNA, 15 bp, Homo sapiens
tctgaccccccttcc

SEQ ID NO: 29989 - DNA, 15 bp, Homo sapiens
ttctgaccccccttc

SEQ ID NO: 29990 - DNA, 15 bp, Homo sapiens
cttctgacccccctt

SEQ ID NO: 29991 - DNA, 15 bp, Homo sapiens
tcttctgacccccct

SEQ ID NO: 29992 - DNA, 15 bp, Homo sapiens
ctcttctgacccccc

SEQ ID NO: 29993 - DNA, 15 bp, Homo sapiens
tctcttctgaccccc

SEQ ID NO: 29994 - DNA, 15 bp, Homo sapiens
ctctcttctgacccc

SEQ ID NO: 29995 - DNA, 15 bp, Homo sapiens
cctctcttctgaccc

SEQ ID NO: 29996 - DNA, 15 bp, Homo sapiens
ccctctcttctgacc

SEQ ID NO: 29997 - DNA, 15 bp, Homo sapiens
accctctcttctgac

SEQ ID NO: 29998 - DNA, 15 bp, Homo sapiens
caccctctcttctga

SEQ ID NO: 29999 - DNA, 15 bp, Homo sapiens
tcaccctctcttctg

SEQ ID NO: 30000 - DNA, 15 bp, Homo sapiens
ctcaccctctcttct

SEQ ID NO: 30001 - DNA, 15 bp, Homo sapiens
actcaccctctcttc

SEQ ID NO: 30002 - DNA, 15 bp, Homo sapiens
gactcaccctctctt

SEQ ID NO: 30003 - DNA, 15 bp, Homo sapiens
ggactcaccctctct

SEQ ID NO: 30004 - DNA, 15 bp, Homo sapiens
aggactcaccctctc

SEQ ID NO: 30005 - DNA, 15 bp, Homo sapiens
gaggactcaccctct

SEQ ID NO: 30006 - DNA, 15 bp, Homo sapiens
ggaggactcaccctc

SEQ ID NO: 30007 - DNA, 15 bp, Homo sapiens
tggaggactcaccct

SEQ ID NO: 30008 - DNA, 15 bp, Homo sapiens
ctggaggactcaccc

SEQ ID NO: 30009 - DNA, 15 bp, Homo sapiens
tctggaggactcacc

SEQ ID NO: 30010 - DNA, 15 bp, Homo sapiens
ttctggaggactcac

SEQ ID NO: 30011 - DNA, 15 bp, Homo sapiens
gttctggaggactca

SEQ ID NO: 30012 - DNA, 15 bp, Homo sapiens
agttctggaggactc

SEQ ID NO: 30013 - DNA, 15 bp, Homo sapiens
gagttctggaggact

SEQ ID NO: 30014 - DNA, 15 bp, Homo sapiens
agagttctggaggac

SEQ ID NO: 30015 - DNA, 15 bp, Homo sapiens
aagagttctggagga

SEQ ID NO: 30016 - DNA, 15 bp, Homo sapiens
gaagagttctggagg

SEQ ID NO: 30017 - DNA, 15 bp, Homo sapiens
ggaagagttctggag

SEQ ID NO: 30018 - DNA, 15 bp, Homo sapiens
aggaagagttctgga

SEQ ID NO: 30019 - DNA, 15 bp, Homo sapiens
gaggaagagttctgg

SEQ ID NO: 30020 - DNA, 15 bp, Homo sapiens
ggaggaagagttctg

SEQ ID NO: 30021 - DNA, 15 bp, Homo sapiens
tggaggaagagttct

SEQ ID NO: 30022 - DNA, 15 bp, Homo sapiens
ttggaggaagagttc

SEQ ID NO: 30023 - DNA, 15 bp, Homo sapiens
cttggaggaagagtt

SEQ ID NO: 30024 - DNA, 15 bp, Homo sapiens
ccttggaggaagagt

SEQ ID NO: 30025 - DNA, 15 bp, Homo sapiens
tccttggaggaagag

SEQ ID NO: 30026 - DNA, 15 bp, Homo sapiens
gtccttggaggaaga

SEQ ID NO: 30027 - DNA, 15 bp, Homo sapiens
tgtccttggaggaag

SEQ ID NO: 30028 - DNA, 15 bp, Homo sapiens
ctgtccttggaggaa

SEQ ID NO: 30029 - DNA, 15 bp, Homo sapiens
tctgtccttggagga

SEQ ID NO: 30030 - DNA, 15 bp, Homo sapiens
ttctgtccttggagg

SEQ ID NO: 30031 - DNA, 15 bp, Homo sapiens
cttctgtccttggag

SEQ ID NO: 30032 - DNA, 15 bp, Homo sapiens
ccttctgtccttgga

SEQ ID NO: 30033 - DNA, 15 bp, Homo sapiens
gccttctgtccttgg

SEQ ID NO: 30034 - DNA, 15 bp, Homo sapiens
agccttctgtccttg

SEQ ID NO: 30035 - DNA, 15 bp, Homo sapiens
gagccttctgtcctt

SEQ ID NO: 30036 - DNA, 15 bp, Homo sapiens
ggagccttctgtcct

SEQ ID NO: 30037 - DNA, 15 bp, Homo sapiens
aggagccttctgtcc

SEQ ID NO: 30038 - DNA, 15 bp, Homo sapiens
caggagccttctgtc

SEQ ID NO: 30039 - DNA, 15 bp, Homo sapiens
gcaggagccttctgt

SEQ ID NO: 30040 - DNA, 15 bp, Homo sapiens
ggcaggagccttctg

SEQ ID NO: 30041 - DNA, 15 bp, Homo sapiens
gggcaggagccttct

SEQ ID NO: 30042 - DNA, 15 bp, Homo sapiens
ggggcaggagccttc

SEQ ID NO: 30043 - DNA, 15 bp, Homo sapiens
gggggcaggagcctt

SEQ ID NO: 30044 - DNA, 15 bp, Homo sapiens
tgggggcaggagcct

SEQ ID NO: 30045 - DNA, 15 bp, Homo sapiens
atgggggcaggagcc

SEQ ID NO: 30046 - DNA, 15 bp, Homo sapiens
tatgggggcaggagc

SEQ ID NO: 30047 - DNA, 15 bp, Homo sapiens
ctatgggggcaggag

SEQ ID NO: 30048 - DNA, 15 bp, Homo sapiens
actatgggggcagga

SEQ ID NO: 30049 - DNA, 15 bp, Homo sapiens
cactatgggggcagg

SEQ ID NO: 30050 - DNA, 15 bp, Homo sapiens
ccactatgggggcag

SEQ ID NO: 30051 - DNA, 15 bp, Homo sapiens
gccactatgggggca

SEQ ID NO: 30052 - DNA, 15 bp, Homo sapiens
ggccactatgggggc

SEQ ID NO: 30053 - DNA, 15 bp, Homo sapiens
aggccactatggggg

SEQ ID NO: 30054 - DNA, 15 bp, Homo sapiens
gaggccactatgggg

SEQ ID NO: 30055 - DNA, 15 bp, Homo sapiens
cgaggccactatggg

SEQ ID NO: 30056 - DNA, 15 bp, Homo sapiens
tcgaggccactatgg

SEQ ID NO: 30057 - DNA, 15 bp, Homo sapiens
ttcgaggccactatg

SEQ ID NO: 30058 - DNA, 15 bp, Homo sapiens
gttcgaggccactat

SEQ ID NO: 30059 - DNA, 15 bp, Homo sapiens
agttcgaggccacta

SEQ ID NO: 30060 - DNA, 15 bp, Homo sapiens
gagttcgaggccact

SEQ ID NO: 30061 - DNA, 15 bp, Homo sapiens
ggagttcgaggccac

SEQ ID NO: 30062 - DNA, 15 bp, Homo sapiens
aggagttcgaggcca

SEQ ID NO: 30063 - DNA, 15 bp, Homo sapiens
caggagttcgaggcc

SEQ ID NO: 30064 - DNA, 15 bp, Homo sapiens
ccaggagttcgaggc

SEQ ID NO: 30065 - DNA, 15 bp, Homo sapiens
gccaggagttcgagg

SEQ ID NO: 30066 - DNA, 15 bp, Homo sapiens
tgccaggagttcgag

SEQ ID NO: 30067 - DNA, 15 bp, Homo sapiens
gtgccaggagttcga

SEQ ID NO: 30068 - DNA, 15 bp, Homo sapiens
agtgccaggagttcg

SEQ ID NO: 30069 - DNA, 15 bp, Homo sapiens
tagtgccaggagttc

SEQ ID NO: 30070 - DNA, 15 bp, Homo sapiens
gtagtgccaggagtt

SEQ ID NO: 30071 - DNA, 15 bp, Homo sapiens
ggtagtgccaggagt

SEQ ID NO: 30072 - DNA, 15 bp, Homo sapiens
tggtagtgccaggag

SEQ ID NO: 30073 - DNA, 15 bp, Homo sapiens
ttggtagtgccagga

SEQ ID NO: 30074 - DNA, 15 bp, Homo sapiens
tttggtagtgccagg

SEQ ID NO: 30075 - DNA, 15 bp, Homo sapiens
ctttggtagtgccag

SEQ ID NO: 30076 - DNA, 15 bp, Homo sapiens
cctttggtagtgcca

SEQ ID NO: 30077 - DNA, 15 bp, Homo sapiens
tcctttggtagtgcc

SEQ ID NO: 30078 - DNA, 15 bp, Homo sapiens
gtcctttggtagtgc

SEQ ID NO: 30079 - DNA, 15 bp, Homo sapiens
tgtcctttggtagtg

SEQ ID NO: 30080 - DNA, 15 bp, Homo sapiens
gtgtcctttggtagt

SEQ ID NO: 30081 - DNA, 15 bp, Homo sapiens
agtgtcctttggtag

SEQ ID NO: 30082 - DNA, 15 bp, Homo sapiens
aagtgtcctttggta

SEQ ID NO: 30083 - DNA, 15 bp, Homo sapiens
taagtgtcctttggt

SEQ ID NO: 30084 - DNA, 15 bp, Homo sapiens
ataagtgtcctttgg

SEQ ID NO: 30085 - DNA, 15 bp, Homo sapiens
gataagtgtcctttg

SEQ ID NO: 30086 - DNA, 15 bp, Homo sapiens
ggataagtgtccttt

SEQ ID NO: 30087 - DNA, 15 bp, Homo sapiens
tggataagtgtcctt

SEQ ID NO: 30088 - DNA, 15 bp, Homo sapiens
gtggataagtgtcct

SEQ ID NO: 30089 - DNA, 15 bp, Homo sapiens
cgtggataagtgtcc

SEQ ID NO: 30090 - DNA, 15 bp, Homo sapiens
tcgtggataagtgtc

SEQ ID NO: 30091 - DNA, 15 bp, Homo sapiens
ctcgtggataagtgt

SEQ ID NO: 30092 - DNA, 15 bp, Homo sapiens
tctcgtggataagtg

SEQ ID NO: 30093 - DNA, 15 bp, Homo sapiens
ctctcgtggataagt

SEQ ID NO: 30094 - DNA, 15 bp, Homo sapiens
gctctcgtggataag

SEQ ID NO: 30095 - DNA, 15 bp, Homo sapiens
cgctctcgtggataa

SEQ ID NO: 30096 - DNA, 15 bp, Homo sapiens
gcgctctcgtggata

SEQ ID NO: 30097 - DNA, 15 bp, Homo sapiens
tgcgctctcgtggat

SEQ ID NO: 30098 - DNA, 15 bp, Homo sapiens
ctgcgctctcgtgga

SEQ ID NO: 30099 - DNA, 15 bp, Homo sapiens
gctgcgctctcgtgg

SEQ ID NO: 30100 - DNA, 15 bp, Homo sapiens
tgctgcgctctcgtg

SEQ ID NO: 30101 - DNA, 15 bp, Homo sapiens
atgctgcgctctcgt

SEQ ID NO: 30102 - DNA, 15 bp, Homo sapiens
gatgctgcgctctcg

SEQ ID NO: 30103 - DNA, 15 bp, Homo sapiens
ggatgctgcgctctc

SEQ ID NO: 30104 - DNA, 15 bp, Homo sapiens
cggatgctgcgctct

SEQ ID NO: 30105 - DNA, 15 bp, Homo sapiens
tcggatgctgcgctc

SEQ ID NO: 30106 - DNA, 15 bp, Homo sapiens
gtcggatgctgcgct

SEQ ID NO: 30107 - DNA, 15 bp, Homo sapiens
ggtcggatgctgcgc

SEQ ID NO: 30108 - DNA, 15 bp, Homo sapiens
tggtcggatgctgcg

SEQ ID NO: 30109 - DNA, 15 bp, Homo sapiens
ctggtcggatgctgc

SEQ ID NO: 30110 - DNA, 15 bp, Homo sapiens
cctggtcggatgctg

SEQ ID NO: 30111 - DNA, 15 bp, Homo sapiens
acctggtcggatgct

SEQ ID NO: 30112 - DNA, 15 bp, Homo sapiens
aacctggtcggatgc

SEQ ID NO: 30113 - DNA, 15 bp, Homo sapiens
caacctggtcggatg

SEQ ID NO: 30114 - DNA, 15 bp, Homo sapiens
acaacctggtcggat

SEQ ID NO: 30115 - DNA, 15 bp, Homo sapiens
gacaacctggtcgga

SEQ ID NO: 30116 - DNA, 15 bp, Homo sapiens
tgacaacctggtcgg

SEQ ID NO: 30117 - DNA, 15 bp, Homo sapiens
gtgacaacctggtcg

SEQ ID NO: 30118 - DNA, 15 bp, Homo sapiens
agtgacaacctggtc

SEQ ID NO: 30119 - DNA, 15 bp, Homo sapiens
cagtgacaacctggt

SEQ ID NO: 30120 - DNA, 15 bp, Homo sapiens
tcagtgacaacctgg

SEQ ID NO: 30121 - DNA, 15 bp, Homo sapiens
ctcagtgacaacctg

SEQ ID NO: 30122 - DNA, 15 bp, Homo sapiens
tctcagtgacaacct

SEQ ID NO: 30123 - DNA, 15 bp, Homo sapiens
ttctcagtgacaacc

SEQ ID NO: 30124 - DNA, 15 bp, Homo sapiens
cttctcagtgacaac

SEQ ID NO: 30125 - DNA, 15 bp, Homo sapiens
tcttctcagtgacaa

SEQ ID NO: 30126 - DNA, 15 bp, Homo sapiens
atcttctcagtgaca

SEQ ID NO: 30127 - DNA, 15 bp, Homo sapiens
catcttctcagtgac

SEQ ID NO: 30128 - DNA, 15 bp, Homo sapiens
acatcttctcagtga

SEQ ID NO: 30129 - DNA, 15 bp, Homo sapiens
aacatcttctcagtg

SEQ ID NO: 30130 - DNA, 15 bp, Homo sapiens
aaacatcttctcagt

SEQ ID NO: 30131 - DNA, 15 bp, Homo sapiens
taaacatcttctcag

SEQ ID NO: 30132 - DNA, 15 bp, Homo sapiens
ataaacatcttctca

SEQ ID NO: 30133 - DNA, 15 bp, Homo sapiens
aataaacatcttctc

SEQ ID NO: 30134 - DNA, 15 bp, Homo sapiens
aaataaacatcttct

SEQ ID NO: 30135 - DNA, 15 bp, Homo sapiens
aaaataaacatcttc

SEQ ID NO: 30136 - DNA, 15 bp, Homo sapiens
caaaataaacatctt

SEQ ID NO: 30137 - DNA, 15 bp, Homo sapiens
ccaaaataaacatct

SEQ ID NO: 30138 - DNA, 15 bp, Homo sapiens
accaaaataaacatc

SEQ ID NO: 30139 - DNA, 15 bp, Homo sapiens
gaccaaaataaacat

SEQ ID NO: 30140 - DNA, 15 bp, Homo sapiens
tgaccaaaataaaca

SEQ ID NO: 30141 - DNA, 15 bp, Homo sapiens
ctgaccaaaataaac

SEQ ID NO: 30142 - DNA, 15 bp, Homo sapiens
actgaccaaaataaa

SEQ ID NO: 30143 - DNA, 15 bp, Homo sapiens
aactgaccaaaataa

SEQ ID NO: 30144 - DNA, 15 bp, Homo sapiens
caactgaccaaaata

SEQ ID NO: 30145 - DNA, 15 bp, Homo sapiens
ccaactgaccaaaat

SEQ ID NO: 30146 - DNA, 15 bp, Homo sapiens
cccaactgaccaaaa

SEQ ID NO: 30147 - DNA, 15 bp, Homo sapiens
acccaactgaccaaa

SEQ ID NO: 30148 - DNA, 15 bp, Homo sapiens
aacccaactgaccaa

SEQ ID NO: 30149 - DNA, 15 bp, Homo sapiens
aaacccaactgacca

SEQ ID NO: 30150 - DNA, 15 bp, Homo sapiens
aaaacccaactgacc

SEQ ID NO: 30151 - DNA, 15 bp, Homo sapiens
aaaaacccaactgac

SEQ ID NO: 30152 - DNA, 15 bp, Homo sapiens
taaaaacccaactga

SEQ ID NO: 30153 - DNA, 15 bp, Homo sapiens
ataaaaacccaactg

SEQ ID NO: 30154 - DNA, 15 bp, Homo sapiens
cataaaaacccaact

SEQ ID NO: 30155 - DNA, 15 bp, Homo sapiens
acataaaaacccaac

SEQ ID NO: 30156 - DNA, 15 bp, Homo sapiens
tacataaaaacccaa

SEQ ID NO: 30157 - DNA, 15 bp, Homo sapiens
atacataaaaaccca

SEQ ID NO: 30158 - DNA, 15 bp, Homo sapiens
aatacataaaaaccc

SEQ ID NO: 30159 - DNA, 15 bp, Homo sapiens
taatacataaaaacc

SEQ ID NO: 30160 - DNA, 15 bp, Homo sapiens
ataatacataaaaac

SEQ ID NO: 30161 - DNA, 15 bp, Homo sapiens
tataatacataaaaa

SEQ ID NO: 30162 - DNA, 15 bp, Homo sapiens
gtataatacataaaa

SEQ ID NO: 30163 - DNA, 15 bp, Homo sapiens
agtataatacataaa

SEQ ID NO: 30164 - DNA, 15 bp, Homo sapiens
aagtataatacataa

SEQ ID NO: 30165 - DNA, 15 bp, Homo sapiens
taagtataatacata

SEQ ID NO: 30166 - DNA, 15 bp, Homo sapiens
ctaagtataatacat

SEQ ID NO: 30167 - DNA, 15 bp, Homo sapiens
actaagtataataca

SEQ ID NO: 30168 - DNA, 15 bp, Homo sapiens
gactaagtataatac

SEQ ID NO: 30169 - DNA, 15 bp, Homo sapiens
tgactaagtataata

SEQ ID NO: 30170 - DNA, 15 bp, Homo sapiens
ttgactaagtataat

SEQ ID NO: 30171 - DNA, 15 bp, Homo sapiens
tttgactaagtataa

SEQ ID NO: 30172 - DNA, 15 bp, Homo sapiens
atttgactaagtata

SEQ ID NO: 30173 - DNA, 15 bp, Homo sapiens
catttgactaagtat

SEQ ID NO: 30174 - DNA, 15 bp, Homo sapiens
acatttgactaagta

SEQ ID NO: 30175 - DNA, 15 bp, Homo sapiens
tacatttgactaagt

SEQ ID NO: 30176 - DNA, 15 bp, Homo sapiens
ttacatttgactaag

SEQ ID NO: 30177 - DNA, 15 bp, Homo sapiens
attacatttgactaa

SEQ ID NO: 30178 - DNA, 15 bp, Homo sapiens
cattacatttgacta

SEQ ID NO: 30179 - DNA, 15 bp, Homo sapiens
acattacatttgact

SEQ ID NO: 30180 - DNA, 15 bp, Homo sapiens
cacattacatttgac

SEQ ID NO: 30181 - DNA, 15 bp, Homo sapiens
ccacattacatttga

SEQ ID NO: 30182 - DNA, 15 bp, Homo sapiens
gccacattacatttg

SEQ ID NO: 30183 - DNA, 15 bp, Homo sapiens
agccacattacattt

SEQ ID NO: 30184 - DNA, 15 bp, Homo sapiens
aagccacattacatt

SEQ ID NO: 30185 - DNA, 15 bp, Homo sapiens
gaagccacattacat

SEQ ID NO: 30186 - DNA, 15 bp, Homo sapiens
agaagccacattaca

SEQ ID NO: 30187 - DNA, 15 bp, Homo sapiens
cagaagccacattac

SEQ ID NO: 30188 - DNA, 15 bp, Homo sapiens
ccagaagccacatta

SEQ ID NO: 30189 - DNA, 15 bp, Homo sapiens
tccagaagccacatt

SEQ ID NO: 30190 - DNA, 15 bp, Homo sapiens
ttccagaagccacat

SEQ ID NO: 30191 - DNA, 15 bp, Homo sapiens
attccagaagccaca

SEQ ID NO: 30192 - DNA, 15 bp, Homo sapiens
gattccagaagccac

SEQ ID NO: 30193 - DNA, 15 bp, Homo sapiens
tgattccagaagcca

SEQ ID NO: 30194 - DNA, 15 bp, Homo sapiens
atgattccagaagcc

SEQ ID NO: 30195 - DNA, 15 bp, Homo sapiens
aatgattccagaagc

SEQ ID NO: 30196 - DNA, 15 bp, Homo sapiens
caatgattccagaag

SEQ ID NO: 30197 - DNA, 15 bp, Homo sapiens
acaatgattccagaa

SEQ ID NO: 30198 - DNA, 15 bp, Homo sapiens
gacaatgattccaga

SEQ ID NO: 30199 - DNA, 15 bp, Homo sapiens
ggacaatgattccag

SEQ ID NO: 30200 - DNA, 15 bp, Homo sapiens
tggacaatgattcca

SEQ ID NO: 30201 - DNA, 15 bp, Homo sapiens
ctggacaatgattcc

SEQ ID NO: 30202 - DNA, 15 bp, Homo sapiens
tctggacaatgattc

SEQ ID NO: 30203 - DNA, 15 bp, Homo sapiens
ctctggacaatgatt

SEQ ID NO: 30204 - DNA, 15 bp, Homo sapiens
gctctggacaatgat

SEQ ID NO: 30205 - DNA, 15 bp, Homo sapiens
agctctggacaatga

SEQ ID NO: 30206 - DNA, 15 bp, Homo sapiens
cagctctggacaatg

SEQ ID NO: 30207 - DNA, 15 bp, Homo sapiens
gcagctctggacaat

SEQ ID NO: 30208 - DNA, 15 bp, Homo sapiens
agcagctctggacaa

SEQ ID NO: 30209 - DNA, 15 bp, Homo sapiens
aagcagctctggaca

SEQ ID NO: 30210 - DNA, 15 bp, Homo sapiens
gaagcagctctggac

SEQ ID NO: 30211 - DNA, 15 bp, Homo sapiens
ggaagcagctctgga

SEQ ID NO: 30212 - DNA, 15 bp, Homo sapiens
gggaagcagctctgg

SEQ ID NO: 30213 - DNA, 15 bp, Homo sapiens
ggggaagcagctctg

SEQ ID NO: 30214 - DNA, 15 bp, Homo sapiens
cggggaagcagctct

SEQ ID NO: 30215 - DNA, 15 bp, Homo sapiens
acggggaagcagctc

SEQ ID NO: 30216 - DNA, 15 bp, Homo sapiens
gacggggaagcagct

SEQ ID NO: 30217 - DNA, 15 bp, Homo sapiens
tgacggggaagcagc

SEQ ID NO: 30218 - DNA, 15 bp, Homo sapiens
gtgacggggaagcag

SEQ ID NO: 30219 - DNA, 15 bp, Homo sapiens
ggtgacggggaagca

SEQ ID NO: 30220 - DNA, 15 bp, Homo sapiens
aggtgacggggaagc

SEQ ID NO: 30221 - DNA, 15 bp, Homo sapiens
caggtgacggggaag

SEQ ID NO: 30222 - DNA, 15 bp, Homo sapiens
ccaggtgacggggaa

SEQ ID NO: 30223 - DNA, 15 bp, Homo sapiens
cccaggtgacgggga

SEQ ID NO: 30224 - DNA, 15 bp, Homo sapiens
gcccaggtgacgggg

SEQ ID NO: 30225 - DNA, 15 bp, Homo sapiens
cgcccaggtgacggg

SEQ ID NO: 30226 - DNA, 15 bp, Homo sapiens
acgcccaggtgacgg

SEQ ID NO: 30227 - DNA, 15 bp, Homo sapiens
gacgcccaggtgacg

SEQ ID NO: 30228 - DNA, 15 bp, Homo sapiens
tgacgcccaggtgac

SEQ ID NO: 30229 - DNA, 15 bp, Homo sapiens
atgacgcccaggtga

SEQ ID NO: 30230 - DNA, 15 bp, Homo sapiens
gatgacgcccaggtg

SEQ ID NO: 30231 - DNA, 15 bp, Homo sapiens
agatgacgcccaggt

SEQ ID NO: 30232 - DNA, 15 bp, Homo sapiens
cagatgacgcccagg

SEQ ID NO: 30233 - DNA, 15 bp, Homo sapiens
ccagatgacgcccag

SEQ ID NO: 30234 - DNA, 15 bp, Homo sapiens
accagatgacgccca

SEQ ID NO: 30235 - DNA, 15 bp, Homo sapiens
gaccagatgacgccc

SEQ ID NO: 30236 - DNA, 15 bp, Homo sapiens
ggaccagatgacgcc

SEQ ID NO: 30237 - DNA, 15 bp, Homo sapiens
aggaccagatgacgc

SEQ ID NO: 30238 - DNA, 15 bp, Homo sapiens
caggaccagatgacg

SEQ ID NO: 30239 - DNA, 15 bp, Homo sapiens
ccaggaccagatgac

SEQ ID NO: 30240 - DNA, 15 bp, Homo sapiens
accaggaccagatga

SEQ ID NO: 30241 - DNA, 15 bp, Homo sapiens
taccaggaccagatg

SEQ ID NO: 30242 - DNA, 15 bp, Homo sapiens
ttaccaggaccagat

SEQ ID NO: 30243 - DNA, 15 bp, Homo sapiens
cttaccaggaccaga

SEQ ID NO: 30244 - DNA, 15 bp, Homo sapiens
tcttaccaggaccag

SEQ ID NO: 30245 - DNA, 15 bp, Homo sapiens
ctcttaccaggacca

SEQ ID NO: 30246 - DNA, 15 bp, Homo sapiens
cctcttaccaggacc

SEQ ID NO: 30247 - DNA, 15 bp, Homo sapiens
tcctcttaccaggac

SEQ ID NO: 30248 - DNA, 15 bp, Homo sapiens
ctcctcttaccagga

SEQ ID NO: 30249 - DNA, 15 bp, Homo sapiens
actcctcttaccagg

SEQ ID NO: 30250 - DNA, 15 bp, Homo sapiens
cactcctcttaccag

SEQ ID NO: 30251 - DNA, 15 bp, Homo sapiens
gcactcctcttacca

SEQ ID NO: 30252 - DNA, 15 bp, Homo sapiens
cgcactcctcttacc

SEQ ID NO: 30253 - DNA, 15 bp, Homo sapiens
acgcactcctcttac

SEQ ID NO: 30254 - DNA, 15 bp, Homo sapiens
cacgcactcctctta

SEQ ID NO: 30255 - DNA, 15 bp, Homo sapiens
ccacgcactcctctt

SEQ ID NO: 30256 - DNA, 15 bp, Homo sapiens
gccacgcactcctct

SEQ ID NO: 30257 - DNA, 15 bp, Homo sapiens
ggccacgcactcctc

SEQ ID NO: 30258 - DNA, 15 bp, Homo sapiens
gggccacgcactcct

SEQ ID NO: 30259 - DNA, 15 bp, Homo sapiens
tgggccacgcactcc

SEQ ID NO: 30260 - DNA, 15 bp, Homo sapiens
gtgggccacgcactc

SEQ ID NO: 30261 - DNA, 15 bp, Homo sapiens
ggtgggccacgcact

SEQ ID NO: 30262 - DNA, 15 bp, Homo sapiens
tggtgggccacgcac

SEQ ID NO: 30263 - DNA, 15 bp, Homo sapiens
ctggtgggccacgca

SEQ ID NO: 30264 - DNA, 15 bp, Homo sapiens
cctggtgggccacgc

SEQ ID NO: 30265 - DNA, 15 bp, Homo sapiens
gcctggtgggccacg

SEQ ID NO: 30266 - DNA, 15 bp, Homo sapiens
ggcctggtgggccac

SEQ ID NO: 30267 - DNA, 15 bp, Homo sapiens
gggcctggtgggcca

SEQ ID NO: 30268 - DNA, 15 bp, Homo sapiens
ggggcctggtgggcc

SEQ ID NO: 30269 - DNA, 15 bp, Homo sapiens
gggggcctggtgggc

SEQ ID NO: 30270 - DNA, 15 bp, Homo sapiens
ggggggcctggtggg

SEQ ID NO: 30271 - DNA, 15 bp, Homo sapiens
aggggggcctggtgg

SEQ ID NO: 30272 - DNA, 15 bp, Homo sapiens
caggggggcctggtg

SEQ ID NO: 30273 - DNA, 15 bp, Homo sapiens
acaggggggcctggt

SEQ ID NO: 30274 - DNA, 15 bp, Homo sapiens
gacaggggggcctgg

SEQ ID NO: 30275 - DNA, 15 bp, Homo sapiens
tgacaggggggcctg

SEQ ID NO: 30276 - DNA, 15 bp, Homo sapiens
gtgacaggggggcct

SEQ ID NO: 30277 - DNA, 15 bp, Homo sapiens
ggtgacaggggggcc

SEQ ID NO: 30278 - DNA, 15 bp, Homo sapiens
gggtgacaggggggc

SEQ ID NO: 30279 - DNA, 15 bp, Homo sapiens
tgggtgacagggggg

SEQ ID NO: 30280 - DNA, 15 bp, Homo sapiens
atgggtgacaggggg

SEQ ID NO: 30281 - DNA, 15 bp, Homo sapiens
catgggtgacagggg

SEQ ID NO: 30282 - DNA, 15 bp, Homo sapiens
tcatgggtgacaggg

SEQ ID NO: 30283 - DNA, 15 bp, Homo sapiens
gtcatgggtgacagg

SEQ ID NO: 30284 - DNA, 15 bp, Homo sapiens
tgtcatgggtgacag

SEQ ID NO: 30285 - DNA, 15 bp, Homo sapiens
ctgtcatgggtgaca

SEQ ID NO: 30286 - DNA, 15 bp, Homo sapiens
actgtcatgggtgac

SEQ ID NO: 30287 - DNA, 15 bp, Homo sapiens
aactgtcatgggtga

SEQ ID NO: 30288 - DNA, 15 bp, Homo sapiens
gaactgtcatgggtg

SEQ ID NO: 30289 - DNA, 15 bp, Homo sapiens
tgaactgtcatgggt

SEQ ID NO: 30290 - DNA, 15 bp, Homo sapiens
atgaactgtcatggg

SEQ ID NO: 30291 - DNA, 15 bp, Homo sapiens
aatgaactgtcatgg

SEQ ID NO: 30292 - DNA, 15 bp, Homo sapiens
gaatgaactgtcatg

SEQ ID NO: 30293 - DNA, 15 bp, Homo sapiens
tgaatgaactgtcat

SEQ ID NO: 30294 - DNA, 15 bp, Homo sapiens
ctgaatgaactgtca

SEQ ID NO: 30295 - DNA, 15 bp, Homo sapiens
cctgaatgaactgtc

SEQ ID NO: 30296 - DNA, 15 bp, Homo sapiens
ccctgaatgaactgt

SEQ ID NO: 30297 - DNA, 15 bp, Homo sapiens
gccctgaatgaactg

SEQ ID NO: 30298 - DNA, 15 bp, Homo sapiens
ggccctgaatgaact

SEQ ID NO: 30299 - DNA, 15 bp, Homo sapiens
cggccctgaatgaac

SEQ ID NO: 30300 - DNA, 15 bp, Homo sapiens
tcggccctgaatgaa

SEQ ID NO: 30301 - DNA, 15 bp, Homo sapiens
atcggccctgaatga

SEQ ID NO: 30302 - DNA, 15 bp, Homo sapiens
catcggccctgaatg

SEQ ID NO: 30303 - DNA, 15 bp, Homo sapiens
ccatcggccctgaat

SEQ ID NO: 30304 - DNA, 15 bp, Homo sapiens
cccatcggccctgaa

SEQ ID NO: 30305 - DNA, 15 bp, Homo sapiens
ccccatcggccctga

SEQ ID NO: 30306 - DNA, 15 bp, Homo sapiens
gccccatcggccctg

SEQ ID NO: 30307 - DNA, 15 bp, Homo sapiens
tgccccatcggccct

SEQ ID NO: 30308 - DNA, 15 bp, Homo sapiens
ctgccccatcggccc

SEQ ID NO: 30309 - DNA, 15 bp, Homo sapiens
actgccccatcggcc

SEQ ID NO: 30310 - DNA, 15 bp, Homo sapiens
gactgccccatcggc

SEQ ID NO: 30311 - DNA, 15 bp, Homo sapiens
cgactgccccatcgg

SEQ ID NO: 30312 - DNA, 15 bp, Homo sapiens
acgactgccccatcg

SEQ ID NO: 30313 - DNA, 15 bp, Homo sapiens
cacgactgccccatc

SEQ ID NO: 30314 - DNA, 15 bp, Homo sapiens
ccacgactgccccat

SEQ ID NO: 30315 - DNA, 15 bp, Homo sapiens
accacgactgcccca

SEQ ID NO: 30316 - DNA, 15 bp, Homo sapiens
aaccacgactgcccc

SEQ ID NO: 30317 - DNA, 15 bp, Homo sapiens
caaccacgactgccc

SEQ ID NO: 30318 - DNA, 15 bp, Homo sapiens
ccaaccacgactgcc

SEQ ID NO: 30319 - DNA, 15 bp, Homo sapiens
cccaaccacgactgc

SEQ ID NO: 30320 - DNA, 15 bp, Homo sapiens
tcccaaccacgactg

SEQ ID NO: 30321 - DNA, 15 bp, Homo sapiens
ttcccaaccacgact

SEQ ID NO: 30322 - DNA, 15 bp, Homo sapiens
gttcccaaccacgac

SEQ ID NO: 30323 - DNA, 15 bp, Homo sapiens
tgttcccaaccacga

SEQ ID NO: 30324 - DNA, 15 bp, Homo sapiens
gtgttcccaaccacg

SEQ ID NO: 30325 - DNA, 15 bp, Homo sapiens
tgtgttcccaaccac

SEQ ID NO: 30326 - DNA, 15 bp, Homo sapiens
ctgtgttcccaacca

SEQ ID NO: 30327 - DNA, 15 bp, Homo sapiens
gctgtgttcccaacc

SEQ ID NO: 30328 - DNA, 15 bp, Homo sapiens
tgctgtgttcccaac

SEQ ID NO: 30329 - DNA, 15 bp, Homo sapiens
atgctgtgttcccaa

SEQ ID NO: 30330 - DNA, 15 bp, Homo sapiens
aatgctgtgttccca

SEQ ID NO: 30331 - DNA, 15 bp, Homo sapiens
aaatgctgtgttccc

SEQ ID NO: 30332 - DNA, 15 bp, Homo sapiens
gaaatgctgtgttcc

SEQ ID NO: 30333 - DNA, 15 bp, Homo sapiens
tgaaatgctgtgttc

SEQ ID NO: 30334 - DNA, 15 bp, Homo sapiens
ttgaaatgctgtgtt

SEQ ID NO: 30335 - DNA, 15 bp, Homo sapiens
cttgaaatgctgtgt

SEQ ID NO: 30336 - DNA, 15 bp, Homo sapiens
gcttgaaatgctgtg

SEQ ID NO: 30337 - DNA, 15 bp, Homo sapiens
cgcttgaaatgctgt

SEQ ID NO: 30338 - DNA, 15 bp, Homo sapiens
acgcttgaaatgctg

SEQ ID NO: 30339 - DNA, 15 bp, Homo sapiens
gacgcttgaaatgct

SEQ ID NO: 30340 - DNA, 15 bp, Homo sapiens
tgacgcttgaaatgc

SEQ ID NO: 30341 - DNA, 15 bp, Homo sapiens
gtgacgcttgaaatg

SEQ ID NO: 30342 - DNA, 15 bp, Homo sapiens
agtgacgcttgaaat

SEQ ID NO: 30343 - DNA, 15 bp, Homo sapiens
aagtgacgcttgaaa

SEQ ID NO: 30344 - DNA, 15 bp, Homo sapiens
aaagtgacgcttgaa

SEQ ID NO: 30345 - DNA, 15 bp, Homo sapiens
taaagtgacgcttga

SEQ ID NO: 30346 - DNA, 15 bp, Homo sapiens
ataaagtgacgcttg

SEQ ID NO: 30347 - DNA, 15 bp, Homo sapiens
aataaagtgacgctt

SEQ ID NO: 30348 - DNA, 15 bp, Homo sapiens
aaataaagtgacgct

SEQ ID NO: 30349 - DNA, 15 bp, Homo sapiens
gaaataaagtgacgc

SEQ ID NO: 30350 - DNA, 15 bp, Homo sapiens
tgaaataaagtgacg

SEQ ID NO: 30351 - DNA, 15 bp, Homo sapiens
atgaaataaagtgac

SEQ ID NO: 30352 - DNA, 15 bp, Homo sapiens
aatgaaataaagtga

SEQ ID NO: 30353 - DNA, 15 bp, Homo sapiens
gaatgaaataaagtg

SEQ ID NO: 30354 - DNA, 15 bp, Homo sapiens
cgaatgaaataaagt

SEQ ID NO: 30355 - DNA, 15 bp, Homo sapiens
ccgaatgaaataaag

SEQ ID NO: 30356 - DNA, 15 bp, Homo sapiens
cccgaatgaaataaa

SEQ ID NO: 30357 - DNA, 15 bp, Homo sapiens
gcccgaatgaaataa

SEQ ID NO: 30358 - DNA, 15 bp, Homo sapiens
ggcccgaatgaaata

SEQ ID NO: 30359 - DNA, 15 bp, Homo sapiens
gggcccgaatgaaat

SEQ ID NO: 30360 - DNA, 15 bp, Homo sapiens
ggggcccgaatgaaa

SEQ ID NO: 30361 - DNA, 15 bp, Homo sapiens
tggggcccgaatgaa

SEQ ID NO: 30362 - DNA, 15 bp, Homo sapiens
gtggggcccgaatga

SEQ ID NO: 30363 - DNA, 15 bp, Homo sapiens
ggtggggcccgaatg

SEQ ID NO: 30364 - DNA, 15 bp, Homo sapiens
aggtggggcccgaat

SEQ ID NO: 30365 - DNA, 15 bp, Homo sapiens
caggtggggcccgaa

SEQ ID NO: 30366 - DNA, 15 bp, Homo sapiens
gcaggtggggcccga

SEQ ID NO: 30367 - DNA, 15 bp, Homo sapiens
tgcaggtggggcccg

SEQ ID NO: 30368 - DNA, 15 bp, Homo sapiens
ctgcaggtggggccc

SEQ ID NO: 30369 - DNA, 15 bp, Homo sapiens
gctgcaggtggggcc

SEQ ID NO: 30370 - DNA, 15 bp, Homo sapiens
agctgcaggtggggc

SEQ ID NO: 30371 - DNA, 15 bp, Homo sapiens
gagctgcaggtgggg

SEQ ID NO: 30372 - DNA, 15 bp, Homo sapiens
ggagctgcaggtggg

SEQ ID NO: 30373 - DNA, 15 bp, Homo sapiens
gggagctgcaggtgg

SEQ ID NO: 30374 - DNA, 15 bp, Homo sapiens
agggagctgcaggtg

SEQ ID NO: 30375 - DNA, 15 bp, Homo sapiens
gagggagctgcaggt

SEQ ID NO: 30376 - DNA, 15 bp, Homo sapiens
tgagggagctgcagg

SEQ ID NO: 30377 - DNA, 15 bp, Homo sapiens
ttgagggagctgcag

SEQ ID NO: 30378 - DNA, 15 bp, Homo sapiens
tttgagggagctgca

SEQ ID NO: 30379 - DNA, 15 bp, Homo sapiens
ctttgagggagctgc

SEQ ID NO: 30380 - DNA, 15 bp, Homo sapiens
tctttgagggagctg

SEQ ID NO: 30381 - DNA, 15 bp, Homo sapiens
ctctttgagggagct

SEQ ID NO: 30382 - DNA, 15 bp, Homo sapiens
cctctttgagggagc

SEQ ID NO: 30383 - DNA, 15 bp, Homo sapiens
gcctctttgagggag

SEQ ID NO: 30384 - DNA, 15 bp, Homo sapiens
tgcctctttgaggga

SEQ ID NO: 30385 - DNA, 15 bp, Homo sapiens
ctgcctctttgaggg

SEQ ID NO: 30386 - DNA, 15 bp, Homo sapiens
actgcctctttgagg

SEQ ID NO: 30387 - DNA, 15 bp, Homo sapiens
aactgcctctttgag

SEQ ID NO: 30388 - DNA, 15 bp, Homo sapiens
caactgcctctttga

SEQ ID NO: 30389 - DNA, 15 bp, Homo sapiens
gcaactgcctctttg

SEQ ID NO: 30390 - DNA, 15 bp, Homo sapiens
ggcaactgcctcttt

SEQ ID NO: 30391 - DNA, 15 bp, Homo sapiens
gggcaactgcctctt

SEQ ID NO: 30392 - DNA, 15 bp, Homo sapiens
tgggcaactgcctct

SEQ ID NO: 30393 - DNA, 15 bp, Homo sapiens
ctgggcaactgcctc

SEQ ID NO: 30394 - DNA, 15 bp, Homo sapiens
gctgggcaactgcct

SEQ ID NO: 30395 - DNA, 15 bp, Homo sapiens
ggctgggcaactgcc

SEQ ID NO: 30396 - DNA, 15 bp, Homo sapiens
aggctgggcaactgc

SEQ ID NO: 30397 - DNA, 15 bp, Homo sapiens
gaggctgggcaactg

SEQ ID NO: 30398 - DNA, 15 bp, Homo sapiens
agaggctgggcaact

SEQ ID NO: 30399 - DNA, 15 bp, Homo sapiens
aagaggctgggcaac

SEQ ID NO: 30400 - DNA, 15 bp, Homo sapiens
aaagaggctgggcaa

SEQ ID NO: 30401 - DNA, 15 bp, Homo sapiens
gaaagaggctgggca

SEQ ID NO: 30402 - DNA, 15 bp, Homo sapiens
ggaaagaggctgggc

SEQ ID NO: 30403 - DNA, 15 bp, Homo sapiens
gggaaagaggctggg

SEQ ID NO: 30404 - DNA, 15 bp, Homo sapiens
agggaaagaggctgg

SEQ ID NO: 30405 - DNA, 15 bp, Homo sapiens
aagggaaagaggctg

SEQ ID NO: 30406 - DNA, 15 bp, Homo sapiens
gaagggaaagaggct

SEQ ID NO: 30407 - DNA, 15 bp, Homo sapiens
ggaagggaaagaggc

SEQ ID NO: 30408 - DNA, 15 bp, Homo sapiens
tggaagggaaagagg

SEQ ID NO: 30409 - DNA, 15 bp, Homo sapiens
ctggaagggaaagag

SEQ ID NO: 30410 - DNA, 15 bp, Homo sapiens
actggaagggaaaga

SEQ ID NO: 30411 - DNA, 15 bp, Homo sapiens
aactggaagggaaag

SEQ ID NO: 30412 - DNA, 15 bp, Homo sapiens
aaactggaagggaaa

SEQ ID NO: 30413 - DNA, 15 bp, Homo sapiens
taaactggaagggaa

SEQ ID NO: 30414 - DNA, 15 bp, Homo sapiens
ataaactggaaggga

SEQ ID NO: 30415 - DNA, 15 bp, Homo sapiens
aataaactggaaggg

SEQ ID NO: 30416 - DNA, 15 bp, Homo sapiens
gaataaactggaagg

SEQ ID NO: 30417 - DNA, 15 bp, Homo sapiens
ggaataaactggaag

SEQ ID NO: 30418 - DNA, 15 bp, Homo sapiens
tggaataaactggaa

SEQ ID NO: 30419 - DNA, 15 bp, Homo sapiens
ctggaataaactgga

SEQ ID NO: 30420 - DNA, 15 bp, Homo sapiens
tctggaataaactgg

SEQ ID NO: 30421 - DNA, 15 bp, Homo sapiens
ctctggaataaactg

SEQ ID NO: 30422 - DNA, 15 bp, Homo sapiens
gctctggaataaact

SEQ ID NO: 30423 - DNA, 15 bp, Homo sapiens
agctctggaataaac

SEQ ID NO: 30424 - DNA, 15 bp, Homo sapiens
cagctctggaataaa

SEQ ID NO: 30425 - DNA, 15 bp, Homo sapiens
gcagctctggaataa

SEQ ID NO: 30426 - DNA, 15 bp, Homo sapiens
ggcagctctggaata

SEQ ID NO: 30427 - DNA, 15 bp, Homo sapiens
tggcagctctggaat

SEQ ID NO: 30428 - DNA, 15 bp, Homo sapiens
ctggcagctctggaa

SEQ ID NO: 30429 - DNA, 15 bp, Homo sapiens
actggcagctctgga

SEQ ID NO: 30430 - DNA, 15 bp, Homo sapiens
cactggcagctctgg

SEQ ID NO: 30431 - DNA, 15 bp, Homo sapiens
ccactggcagctctg

SEQ ID NO: 30432 - DNA, 15 bp, Homo sapiens
cccactggcagctct

SEQ ID NO: 30433 - DNA, 15 bp, Homo sapiens
ccccactggcagctc

SEQ ID NO: 30434 - DNA, 15 bp, Homo sapiens
gccccactggcagct

SEQ ID NO: 30435 - DNA, 15 bp, Homo sapiens
ggccccactggcagc

SEQ ID NO: 30436 - DNA, 15 bp, Homo sapiens
aggccccactggcag

SEQ ID NO: 30437 - DNA, 15 bp, Homo sapiens
caggccccactggca

SEQ ID NO: 30438 - DNA, 15 bp, Homo sapiens
tcaggccccactggc

SEQ ID NO: 30439 - DNA, 15 bp, Homo sapiens
ctcaggccccactgg

SEQ ID NO: 30440 - DNA, 15 bp, Homo sapiens
cctcaggccccactg

SEQ ID NO: 30441 - DNA, 15 bp, Homo sapiens
gcctcaggccccact

SEQ ID NO: 30442 - DNA, 15 bp, Homo sapiens
agcctcaggccccac

SEQ ID NO: 30443 - DNA, 15 bp, Homo sapiens
gagcctcaggcccca

SEQ ID NO: 30444 - DNA, 15 bp, Homo sapiens
ggagcctcaggcccc

SEQ ID NO: 30445 - DNA, 15 bp, Homo sapiens
aggagcctcaggccc

SEQ ID NO: 30446 - DNA, 15 bp, Homo sapiens
aaggagcctcaggcc

SEQ ID NO: 30447 - DNA, 15 bp, Homo sapiens
taaggagcctcaggc

SEQ ID NO: 30448 - DNA, 15 bp, Homo sapiens
ctaaggagcctcagg

SEQ ID NO: 30449 - DNA, 15 bp, Homo sapiens
cctaaggagcctcag

SEQ ID NO: 30450 - DNA, 15 bp, Homo sapiens
ccctaaggagcctca

SEQ ID NO: 30451 - DNA, 15 bp, Homo sapiens
accctaaggagcctc

SEQ ID NO: 30452 - DNA, 15 bp, Homo sapiens
aaccctaaggagcct

SEQ ID NO: 30453 - DNA, 15 bp, Homo sapiens
aaaccctaaggagcc

SEQ ID NO: 30454 - DNA, 15 bp, Homo sapiens
aaaaccctaaggagc

SEQ ID NO: 30455 - DNA, 15 bp, Homo sapiens
gaaaaccctaaggag

SEQ ID NO: 30456 - DNA, 15 bp, Homo sapiens
agaaaaccctaagga

SEQ ID NO: 30457 - DNA, 15 bp, Homo sapiens
gagaaaaccctaagg

SEQ ID NO: 30458 - DNA, 15 bp, Homo sapiens
agagaaaaccctaag

SEQ ID NO: 30459 - DNA, 15 bp, Homo sapiens
gagagaaaaccctaa

SEQ ID NO: 30460 - DNA, 15 bp, Homo sapiens
agagagaaaacccta

SEQ ID NO: 30461 - DNA, 15 bp, Homo sapiens
tagagagaaaaccct

SEQ ID NO: 30462 - DNA, 15 bp, Homo sapiens
atagagagaaaaccc

SEQ ID NO: 30463 - DNA, 15 bp, Homo sapiens
aatagagagaaaacc

SEQ ID NO: 30464 - DNA, 15 bp, Homo sapiens
aaatagagagaaaac

SEQ ID NO: 30465 - DNA, 15 bp, Homo sapiens
gaaatagagagaaaa

SEQ ID NO: 30466 - DNA, 15 bp, Homo sapiens
ggaaatagagagaaa

SEQ ID NO: 30467 - DNA, 15 bp, Homo sapiens
gggaaatagagagaa

SEQ ID NO: 30468 - DNA, 15 bp, Homo sapiens
ggggaaatagagaga

SEQ ID NO: 30469 - DNA, 15 bp, Homo sapiens
gggggaaatagagag

SEQ ID NO: 30470 - DNA, 15 bp, Homo sapiens
agggggaaatagaga

SEQ ID NO: 30471 - DNA, 15 bp, Homo sapiens
aagggggaaatagag

SEQ ID NO: 30472 - DNA, 15 bp, Homo sapiens
aaagggggaaataga

SEQ ID NO: 30473 - DNA, 15 bp, Homo sapiens
gaaagggggaaatag

SEQ ID NO: 30474 - DNA, 15 bp, Homo sapiens
agaaagggggaaata

SEQ ID NO: 30475 - DNA, 15 bp, Homo sapiens
aagaaagggggaaat

SEQ ID NO: 30476 - DNA, 15 bp, Homo sapiens
gaagaaagggggaaa

SEQ ID NO: 30477 - DNA, 15 bp, Homo sapiens
ggaagaaagggggaa

SEQ ID NO: 30478 - DNA, 15 bp, Homo sapiens
aggaagaaaggggga

SEQ ID NO: 30479 - DNA, 15 bp, Homo sapiens
gaggaagaaaggggg

SEQ ID NO: 30480 - DNA, 15 bp, Homo sapiens
tgaggaagaaagggg

SEQ ID NO: 30481 - DNA, 15 bp, Homo sapiens
atgaggaagaaaggg

SEQ ID NO: 30482 - DNA, 15 bp, Homo sapiens
aatgaggaagaaagg

SEQ ID NO: 30483 - DNA, 15 bp, Homo sapiens
gaatgaggaagaaag

SEQ ID NO: 30484 - DNA, 15 bp, Homo sapiens
ggaatgaggaagaaa

SEQ ID NO: 30485 - DNA, 15 bp, Homo sapiens
gggaatgaggaagaa

SEQ ID NO: 30486 - DNA, 15 bp, Homo sapiens
agggaatgaggaaga

SEQ ID NO: 30487 - DNA, 15 bp, Homo sapiens
gagggaatgaggaag

SEQ ID NO: 30488 - DNA, 15 bp, Homo sapiens
cgagggaatgaggaa

SEQ ID NO: 30489 - DNA, 15 bp, Homo sapiens
acgagggaatgagga

SEQ ID NO: 30490 - DNA, 15 bp, Homo sapiens
gacgagggaatgagg

SEQ ID NO: 30491 - DNA, 15 bp, Homo sapiens
agacgagggaatgag

SEQ ID NO: 30492 - DNA, 15 bp, Homo sapiens
aagacgagggaatga

SEQ ID NO: 30493 - DNA, 15 bp, Homo sapiens
aaagacgagggaatg

SEQ ID NO: 30494 - DNA, 15 bp, Homo sapiens
gaaagacgagggaat

SEQ ID NO: 30495 - DNA, 15 bp, Homo sapiens
ggaaagacgagggaa

SEQ ID NO: 30496 - DNA, 15 bp, Homo sapiens
gggaaagacgaggga

SEQ ID NO: 30497 - DNA, 15 bp, Homo sapiens
tgggaaagacgaggg

SEQ ID NO: 30498 - DNA, 15 bp, Homo sapiens
ttgggaaagacgagg

SEQ ID NO: 30499 - DNA, 15 bp, Homo sapiens
tttgggaaagacgag

SEQ ID NO: 30500 - DNA, 15 bp, Homo sapiens
ctttgggaaagacga

SEQ ID NO: 30501 - DNA, 15 bp, Homo sapiens
cctttgggaaagacg

SEQ ID NO: 30502 - DNA, 15 bp, Homo sapiens
gcctttgggaaagac

SEQ ID NO: 30503 - DNA, 15 bp, Homo sapiens
tgcctttgggaaaga

SEQ ID NO: 30504 - DNA, 15 bp, Homo sapiens
atgcctttgggaaag

SEQ ID NO: 30505 - DNA, 15 bp, Homo sapiens
gatgcctttgggaaa

SEQ ID NO: 30506 - DNA, 15 bp, Homo sapiens
tgatgcctttgggaa

SEQ ID NO: 30507 - DNA, 15 bp, Homo sapiens
gtgatgcctttggga

SEQ ID NO: 30508 - DNA, 15 bp, Homo sapiens
cgtgatgcctttggg

SEQ ID NO: 30509 - DNA, 15 bp, Homo sapiens
tcgtgatgcctttgg

SEQ ID NO: 30510 - DNA, 15 bp, Homo sapiens
ctcgtgatgcctttg

SEQ ID NO: 30511 - DNA, 15 bp, Homo sapiens
actcgtgatgccttt

SEQ ID NO: 30512 - DNA, 15 bp, Homo sapiens
gactcgtgatgcctt

SEQ ID NO: 30513 - DNA, 15 bp, Homo sapiens
tgactcgtgatgcct

SEQ ID NO: 30514 - DNA, 15 bp, Homo sapiens
ctgactcgtgatgcc

SEQ ID NO: 30515 - DNA, 15 bp, Homo sapiens
actgactcgtgatgc

SEQ ID NO: 30516 - DNA, 15 bp, Homo sapiens
gactgactcgtgatg

SEQ ID NO: 30517 - DNA, 15 bp, Homo sapiens
cgactgactcgtgat

SEQ ID NO: 30518 - DNA, 15 bp, Homo sapiens
gcgactgactcgtga

SEQ ID NO: 30519 - DNA, 15 bp, Homo sapiens
ggcgactgactcgtg

SEQ ID NO: 30520 - DNA, 15 bp, Homo sapiens
aggcgactgactcgt

SEQ ID NO: 30521 - DNA, 15 bp, Homo sapiens
aaggcgactgactcg

SEQ ID NO: 30522 - DNA, 15 bp, Homo sapiens
aaaggcgactgactc

SEQ ID NO: 30523 - DNA, 15 bp, Homo sapiens
gaaaggcgactgact

SEQ ID NO: 30524 - DNA, 15 bp, Homo sapiens
tgaaaggcgactgac

SEQ ID NO: 30525 - DNA, 15 bp, Homo sapiens
ctgaaaggcgactga

SEQ ID NO: 30526 - DNA, 15 bp, Homo sapiens
gctgaaaggcgactg

SEQ ID NO: 30527 - DNA, 15 bp, Homo sapiens
tgctgaaaggcgact

SEQ ID NO: 30528 - DNA, 15 bp, Homo sapiens
ctgctgaaaggcgac

SEQ ID NO: 30529 - DNA, 15 bp, Homo sapiens
cctgctgaaaggcga

SEQ ID NO: 30530 - DNA, 15 bp, Homo sapiens
gcctgctgaaaggcg

SEQ ID NO: 30531 - DNA, 15 bp, Homo sapiens
tgcctgctgaaaggc

SEQ ID NO: 30532 - DNA, 15 bp, Homo sapiens
ctgcctgctgaaagg

SEQ ID NO: 30533 - DNA, 15 bp, Homo sapiens
gctgcctgctgaaag

SEQ ID NO: 30534 - DNA, 15 bp, Homo sapiens
ggctgcctgctgaaa

SEQ ID NO: 30535 - DNA, 15 bp, Homo sapiens
aggctgcctgctgaa

SEQ ID NO: 30536 - DNA, 15 bp, Homo sapiens
aaggctgcctgctga

SEQ ID NO: 30537 - DNA, 15 bp, Homo sapiens
caaggctgcctgctg

SEQ ID NO: 30538 - DNA, 15 bp, Homo sapiens
ccaaggctgcctgct

SEQ ID NO: 30539 - DNA, 15 bp, Homo sapiens
gccaaggctgcctgc

SEQ ID NO: 30540 - DNA, 15 bp, Homo sapiens
cgccaaggctgcctg

SEQ ID NO: 30541 - DNA, 15 bp, Homo sapiens
ccgccaaggctgcct

SEQ ID NO: 30542 - DNA, 15 bp, Homo sapiens
accgccaaggctgcc

SEQ ID NO: 30543 - DNA, 15 bp, Homo sapiens
aaccgccaaggctgc

SEQ ID NO: 30544 - DNA, 15 bp, Homo sapiens
aaaccgccaaggctg

SEQ ID NO: 30545 - DNA, 15 bp, Homo sapiens
taaaccgccaaggct

SEQ ID NO: 30546 - DNA, 15 bp, Homo sapiens
ataaaccgccaaggc

SEQ ID NO: 30547 - DNA, 15 bp, Homo sapiens
gataaaccgccaagg

SEQ ID NO: 30548 - DNA, 15 bp, Homo sapiens
cgataaaccgccaag

SEQ ID NO: 30549 - DNA, 15 bp, Homo sapiens
gcgataaaccgccaa

SEQ ID NO: 30550 - DNA, 15 bp, Homo sapiens
ggcgataaaccgcca

SEQ ID NO: 30551 - DNA, 15 bp, Homo sapiens
gggcgataaaccgcc

SEQ ID NO: 30552 - DNA, 15 bp, Homo sapiens
agggcgataaaccgc

SEQ ID NO: 30553 - DNA, 15 bp, Homo sapiens
cagggcgataaaccg

SEQ ID NO: 30554 - DNA, 15 bp, Homo sapiens
ccagggcgataaacc

SEQ ID NO: 30555 - DNA, 15 bp, Homo sapiens
gccagggcgataaac

SEQ ID NO: 30556 - DNA, 15 bp, Homo sapiens
tgccagggcgataaa

SEQ ID NO: 30557 - DNA, 15 bp, Homo sapiens
ctgccagggcgataa

SEQ ID NO: 30558 - DNA, 15 bp, Homo sapiens
cctgccagggcgata

SEQ ID NO: 30559 - DNA, 15 bp, Homo sapiens
gcctgccagggcgat

SEQ ID NO: 30560 - DNA, 15 bp, Homo sapiens
tgcctgccagggcga

SEQ ID NO: 30561 - DNA, 15 bp, Homo sapiens
ctgcctgccagggcg

SEQ ID NO: 30562 - DNA, 15 bp, Homo sapiens
cctgcctgccagggc

SEQ ID NO: 30563 - DNA, 15 bp, Homo sapiens
ccctgcctgccaggg

SEQ ID NO: 30564 - DNA, 15 bp, Homo sapiens
cccctgcctgccagg

SEQ ID NO: 30565 - DNA, 15 bp, Homo sapiens
gcccctgcctgccag

SEQ ID NO: 30566 - DNA, 15 bp, Homo sapiens
ggcccctgcctgcca

SEQ ID NO: 30567 - DNA, 15 bp, Homo sapiens
gggcccctgcctgcc

SEQ ID NO: 30568 - DNA, 15 bp, Homo sapiens
agggcccctgcctgc

SEQ ID NO: 30569 - DNA, 15 bp, Homo sapiens
cagggcccctgcctg

SEQ ID NO: 30570 - DNA, 15 bp, Homo sapiens
gcagggcccctgcct

SEQ ID NO: 30571 - DNA, 15 bp, Homo sapiens
tgcagggcccctgcc

SEQ ID NO: 30572 - DNA, 15 bp, Homo sapiens
ctgcagggcccctgc

SEQ ID NO: 30573 - DNA, 15 bp, Homo sapiens
gctgcagggcccctg

SEQ ID NO: 30574 - DNA, 15 bp, Homo sapiens
agctgcagggcccct

SEQ ID NO: 30575 - DNA, 15 bp, Homo sapiens
gagctgcagggcccc

SEQ ID NO: 30576 - DNA, 15 bp, Homo sapiens
agagctgcagggccc

SEQ ID NO: 30577 - DNA, 15 bp, Homo sapiens
gagagctgcagggcc

SEQ ID NO: 30578 - DNA, 15 bp, Homo sapiens
tgagagctgcagggc

SEQ ID NO: 30579 - DNA, 15 bp, Homo sapiens
atgagagctgcaggg

SEQ ID NO: 30580 - DNA, 15 bp, Homo sapiens
catgagagctgcagg

SEQ ID NO: 30581 - DNA, 15 bp, Homo sapiens
gcatgagagctgcag

SEQ ID NO: 30582 - DNA, 15 bp, Homo sapiens
agcatgagagctgca

SEQ ID NO: 30583 - DNA, 15 bp, Homo sapiens
cagcatgagagctgc

SEQ ID NO: 30584 - DNA, 15 bp, Homo sapiens
gcagcatgagagctg

SEQ ID NO: 30585 - DNA, 15 bp, Homo sapiens
ggcagcatgagagct

SEQ ID NO: 30586 - DNA, 15 bp, Homo sapiens
gggcagcatgagagc

SEQ ID NO: 30587 - DNA, 15 bp, Homo sapiens
ggggcagcatgagag

SEQ ID NO: 30588 - DNA, 15 bp, Homo sapiens
aggggcagcatgaga

SEQ ID NO: 30589 - DNA, 15 bp, Homo sapiens
caggggcagcatgag

SEQ ID NO: 30590 - DNA, 15 bp, Homo sapiens
gcaggggcagcatga

SEQ ID NO: 30591 - DNA, 15 bp, Homo sapiens
ggcaggggcagcatg

SEQ ID NO: 30592 - DNA, 15 bp, Homo sapiens
aggcaggggcagcat

SEQ ID NO: 30593 - DNA, 15 bp, Homo sapiens
aaggcaggggcagca

SEQ ID NO: 30594 - DNA, 15 bp, Homo sapiens
caaggcaggggcagc

SEQ ID NO: 30595 - DNA, 15 bp, Homo sapiens
ccaaggcaggggcag

SEQ ID NO: 30596 - DNA, 15 bp, Homo sapiens
cccaaggcaggggca

SEQ ID NO: 30597 - DNA, 15 bp, Homo sapiens
ccccaaggcaggggc

SEQ ID NO: 30598 - DNA, 15 bp, Homo sapiens
accccaaggcagggg

SEQ ID NO: 30599 - DNA, 15 bp, Homo sapiens
gaccccaaggcaggg

SEQ ID NO: 30600 - DNA, 15 bp, Homo sapiens
tgaccccaaggcagg

SEQ ID NO: 30601 - DNA, 15 bp, Homo sapiens
ctgaccccaaggcag

SEQ ID NO: 30602 - DNA, 15 bp, Homo sapiens
cctgaccccaaggca

SEQ ID NO: 30603 - DNA, 15 bp, Homo sapiens
acctgaccccaaggc

SEQ ID NO: 30604 - DNA, 15 bp, Homo sapiens
aacctgaccccaagg

SEQ ID NO: 30605 - DNA, 15 bp, Homo sapiens
caacctgaccccaag

SEQ ID NO: 30606 - DNA, 15 bp, Homo sapiens
tcaacctgaccccaa

SEQ ID NO: 30607 - DNA, 15 bp, Homo sapiens
gtcaacctgacccca

SEQ ID NO: 30608 - DNA, 15 bp, Homo sapiens
tgtcaacctgacccc

SEQ ID NO: 30609 - DNA, 15 bp, Homo sapiens
ctgtcaacctgaccc

SEQ ID NO: 30610 - DNA, 15 bp, Homo sapiens
cctgtcaacctgacc

SEQ ID NO: 30611 - DNA, 15 bp, Homo sapiens
tcctgtcaacctgac

SEQ ID NO: 30612 - DNA, 15 bp, Homo sapiens
ctcctgtcaacctga

SEQ ID NO: 30613 - DNA, 15 bp, Homo sapiens
cctcctgtcaacctg

SEQ ID NO: 30614 - DNA, 15 bp, Homo sapiens
acctcctgtcaacct

SEQ ID NO: 30615 - DNA, 15 bp, Homo sapiens
aacctcctgtcaacc

SEQ ID NO: 30616 - DNA, 15 bp, Homo sapiens
caacctcctgtcaac

SEQ ID NO: 30617 - DNA, 15 bp, Homo sapiens
ccaacctcctgtcaa

SEQ ID NO: 30618 - DNA, 15 bp, Homo sapiens
tccaacctcctgtca

SEQ ID NO: 30619 - DNA, 15 bp, Homo sapiens
ctccaacctcctgtc

SEQ ID NO: 30620 - DNA, 15 bp, Homo sapiens
cctccaacctcctgt

SEQ ID NO: 30621 - DNA, 15 bp, Homo sapiens
ccctccaacctcctg

SEQ ID NO: 30622 - DNA, 15 bp, Homo sapiens
tccctccaacctcct

SEQ ID NO: 30623 - DNA, 15 bp, Homo sapiens
ttccctccaacctcc

SEQ ID NO: 30624 - DNA, 15 bp, Homo sapiens
tttccctccaacctc

SEQ ID NO: 30625 - DNA, 15 bp, Homo sapiens
ctttccctccaacct

SEQ ID NO: 30626 - DNA, 15 bp, Homo sapiens
gctttccctccaacc

SEQ ID NO: 30627 - DNA, 15 bp, Homo sapiens
ggctttccctccaac

SEQ ID NO: 30628 - DNA, 15 bp, Homo sapiens
aggctttccctccaa

SEQ ID NO: 30629 - DNA, 15 bp, Homo sapiens
aaggctttccctcca

SEQ ID NO: 30630 - DNA, 15 bp, Homo sapiens
taaggctttccctcc

SEQ ID NO: 30631 - DNA, 15 bp, Homo sapiens
ttaaggctttccctc

SEQ ID NO: 30632 - DNA, 15 bp, Homo sapiens
cttaaggctttccct

SEQ ID NO: 30633 - DNA, 15 bp, Homo sapiens
gcttaaggctttccc

SEQ ID NO: 30634 - DNA, 15 bp, Homo sapiens
agcttaaggctttcc

SEQ ID NO: 30635 - DNA, 15 bp, Homo sapiens
cagcttaaggctttc

SEQ ID NO: 30636 - DNA, 15 bp, Homo sapiens
gcagcttaaggcttt

SEQ ID NO: 30637 - DNA, 15 bp, Homo sapiens
tgcagcttaaggctt

SEQ ID NO: 30638 - DNA, 15 bp, Homo sapiens
ctgcagcttaaggct

SEQ ID NO: 30639 - DNA, 15 bp, Homo sapiens
cctgcagcttaaggc

SEQ ID NO: 30640 - DNA, 15 bp, Homo sapiens
tcctgcagcttaagg

SEQ ID NO: 30641 - DNA, 15 bp, Homo sapiens
atcctgcagcttaag

SEQ ID NO: 30642 - DNA, 15 bp, Homo sapiens
aatcctgcagcttaa

SEQ ID NO: 30643 - DNA, 15 bp, Homo sapiens
gaatcctgcagctta

SEQ ID NO: 30644 - DNA, 15 bp, Homo sapiens
agaatcctgcagctt

SEQ ID NO: 30645 - DNA, 15 bp, Homo sapiens
gagaatcctgcagct

SEQ ID NO: 30646 - DNA, 15 bp, Homo sapiens
tgagaatcctgcagc

SEQ ID NO: 30647 - DNA, 15 bp, Homo sapiens
gtgagaatcctgcag

SEQ ID NO: 30648 - DNA, 15 bp, Homo sapiens
ggtgagaatcctgca

SEQ ID NO: 30649 - DNA, 15 bp, Homo sapiens
tggtgagaatcctgc

SEQ ID NO: 30650 - DNA, 15 bp, Homo sapiens
ctggtgagaatcctg

SEQ ID NO: 30651 - DNA, 15 bp, Homo sapiens
gctggtgagaatcct

SEQ ID NO: 30652 - DNA, 15 bp, Homo sapiens
agctggtgagaatcc

SEQ ID NO: 30653 - DNA, 15 bp, Homo sapiens
cagctggtgagaatc

SEQ ID NO: 30654 - DNA, 15 bp, Homo sapiens
acagctggtgagaat

SEQ ID NO: 30655 - DNA, 15 bp, Homo sapiens
cacagctggtgagaa

SEQ ID NO: 30656 - DNA, 15 bp, Homo sapiens
acacagctggtgaga

SEQ ID NO: 30657 - DNA, 15 bp, Homo sapiens
gacacagctggtgag

SEQ ID NO: 30658 - DNA, 15 bp, Homo sapiens
ggacacagctggtga

SEQ ID NO: 30659 - DNA, 15 bp, Homo sapiens
cggacacagctggtg

SEQ ID NO: 30660 - DNA, 15 bp, Homo sapiens
ccggacacagctggt

SEQ ID NO: 30661 - DNA, 15 bp, Homo sapiens
gccggacacagctgg

SEQ ID NO: 30662 - DNA, 15 bp, Homo sapiens
ggccggacacagctg

SEQ ID NO: 30663 - DNA, 15 bp, Homo sapiens
gggccggacacagct

SEQ ID NO: 30664 - DNA, 15 bp, Homo sapiens
tgggccggacacagc

SEQ ID NO: 30665 - DNA, 15 bp, Homo sapiens
ctgggccggacacag

SEQ ID NO: 30666 - DNA, 15 bp, Homo sapiens
actgggccggacaca

SEQ ID NO: 30667 - DNA, 15 bp, Homo sapiens
aactgggccggacac

SEQ ID NO: 30668 - DNA, 15 bp, Homo sapiens
aaactgggccggaca

SEQ ID NO: 30669 - DNA, 15 bp, Homo sapiens
aaaactgggccggac

SEQ ID NO: 30670 - DNA, 15 bp, Homo sapiens
caaaactgggccgga

SEQ ID NO: 30671 - DNA, 15 bp, Homo sapiens
ccaaaactgggccgg

SEQ ID NO: 30672 - DNA, 15 bp, Homo sapiens
cccaaaactgggccg

SEQ ID NO: 30673 - DNA, 15 bp, Homo sapiens
ccccaaaactgggcc

SEQ ID NO: 30674 - DNA, 15 bp, Homo sapiens
accccaaaactgggc

SEQ ID NO: 30675 - DNA, 15 bp, Homo sapiens
caccccaaaactggg

SEQ ID NO: 30676 - DNA, 15 bp, Homo sapiens
acaccccaaaactgg

SEQ ID NO: 30677 - DNA, 15 bp, Homo sapiens
cacaccccaaaactg

SEQ ID NO: 30678 - DNA, 15 bp, Homo sapiens
tcacaccccaaaact

SEQ ID NO: 30679 - DNA, 15 bp, Homo sapiens
gtcacaccccaaaac

SEQ ID NO: 30680 - DNA, 15 bp, Homo sapiens
ggtcacaccccaaaa

SEQ ID NO: 30681 - DNA, 15 bp, Homo sapiens
aggtcacaccccaaa

SEQ ID NO: 30682 - DNA, 15 bp, Homo sapiens
gaggtcacaccccaa

SEQ ID NO: 30683 - DNA, 15 bp, Homo sapiens
tgaggtcacacccca

SEQ ID NO: 30684 - DNA, 15 bp, Homo sapiens
ttgaggtcacacccc

SEQ ID NO: 30685 - DNA, 15 bp, Homo sapiens
attgaggtcacaccc

SEQ ID NO: 30686 - DNA, 15 bp, Homo sapiens
aattgaggtcacacc

SEQ ID NO: 30687 - DNA, 15 bp, Homo sapiens
aaattgaggtcacac

SEQ ID NO: 30688 - DNA, 15 bp, Homo sapiens
gaaattgaggtcaca

SEQ ID NO: 30689 - DNA, 15 bp, Homo sapiens
tgaaattgaggtcac

SEQ ID NO: 30690 - DNA, 15 bp, Homo sapiens
ttgaaattgaggtca

SEQ ID NO: 30691 - DNA, 15 bp, Homo sapiens
attgaaattgaggtc

SEQ ID NO: 30692 - DNA, 15 bp, Homo sapiens
aattgaaattgaggt

SEQ ID NO: 30693 - DNA, 15 bp, Homo sapiens
aaattgaaattgagg

SEQ ID NO: 30694 - DNA, 15 bp, Homo sapiens
aaaattgaaattgag

SEQ ID NO: 30695 - DNA, 15 bp, Homo sapiens
caaaattgaaattga

SEQ ID NO: 30696 - DNA, 15 bp, Homo sapiens
acaaaattgaaattg

SEQ ID NO: 30697 - DNA, 15 bp, Homo sapiens
gacaaaattgaaatt

SEQ ID NO: 30698 - DNA, 15 bp, Homo sapiens
agacaaaattgaaat

SEQ ID NO: 30699 - DNA, 15 bp, Homo sapiens
cagacaaaattgaaa

SEQ ID NO: 30700 - DNA, 15 bp, Homo sapiens
acagacaaaattgaa

SEQ ID NO: 30701 - DNA, 15 bp, Homo sapiens
tacagacaaaattga

SEQ ID NO: 30702 - DNA, 15 bp, Homo sapiens
gtacagacaaaattg

SEQ ID NO: 30703 - DNA, 15 bp, Homo sapiens
agtacagacaaaatt

SEQ ID NO: 30704 - DNA, 15 bp, Homo sapiens
aagtacagacaaaat

SEQ ID NO: 30705 - DNA, 15 bp, Homo sapiens
caagtacagacaaaa

SEQ ID NO: 30706 - DNA, 15 bp, Homo sapiens
tcaagtacagacaaa

SEQ ID NO: 30707 - DNA, 15 bp, Homo sapiens
ttcaagtacagacaa

SEQ ID NO: 30708 - DNA, 15 bp, Homo sapiens
gttcaagtacagaca

SEQ ID NO: 30709 - DNA, 15 bp, Homo sapiens
tgttcaagtacagac

SEQ ID NO: 30710 - DNA, 15 bp, Homo sapiens
atgttcaagtacaga

SEQ ID NO: 30711 - DNA, 15 bp, Homo sapiens
aatgttcaagtacag

SEQ ID NO: 30712 - DNA, 15 bp, Homo sapiens
taatgttcaagtaca

SEQ ID NO: 30713 - DNA, 15 bp, Homo sapiens
ataatgttcaagtac

SEQ ID NO: 30714 - DNA, 15 bp, Homo sapiens
cataatgttcaagta

SEQ ID NO: 30715 - DNA, 15 bp, Homo sapiens
tcataatgttcaagt

SEQ ID NO: 30716 - DNA, 15 bp, Homo sapiens
ttcataatgttcaag

SEQ ID NO: 30717 - DNA, 15 bp, Homo sapiens
cttcataatgttcaa

SEQ ID NO: 30718 - DNA, 15 bp, Homo sapiens
tcttcataatgttca

SEQ ID NO: 30719 - DNA, 15 bp, Homo sapiens
atcttcataatgttc

SEQ ID NO: 30720 - DNA, 15 bp, Homo sapiens
catcttcataatgtt

SEQ ID NO: 30721 - DNA, 15 bp, Homo sapiens
ccatcttcataatgt

SEQ ID NO: 30722 - DNA, 15 bp, Homo sapiens
cccatcttcataatg

SEQ ID NO: 30723 - DNA, 15 bp, Homo sapiens
ccccatcttcataat

SEQ ID NO: 30724 - DNA, 15 bp, Homo sapiens
cccccatcttcataa

SEQ ID NO: 30725 - DNA, 15 bp, Homo sapiens
gcccccatcttcata

SEQ ID NO: 30726 - DNA, 15 bp, Homo sapiens
ggcccccatcttcat

SEQ ID NO: 30727 - DNA, 15 bp, Homo sapiens
aggcccccatcttca

SEQ ID NO: 30728 - DNA, 15 bp, Homo sapiens
gaggcccccatcttc

SEQ ID NO: 30729 - DNA, 15 bp, Homo sapiens
agaggcccccatctt

SEQ ID NO: 30730 - DNA, 15 bp, Homo sapiens
aagaggcccccatct

SEQ ID NO: 30731 - DNA, 15 bp, Homo sapiens
aaagaggcccccatc

SEQ ID NO: 30732 - DNA, 15 bp, Homo sapiens
gaaagaggcccccat

SEQ ID NO: 30733 - DNA, 15 bp, Homo sapiens
tgaaagaggccccca

SEQ ID NO: 30734 - DNA, 15 bp, Homo sapiens
ctgaaagaggccccc

SEQ ID NO: 30735 - DNA, 15 bp, Homo sapiens
actgaaagaggcccc

SEQ ID NO: 30736 - DNA, 15 bp, Homo sapiens
cactgaaagaggccc

SEQ ID NO: 30737 - DNA, 15 bp, Homo sapiens
tcactgaaagaggcc

SEQ ID NO: 30738 - DNA, 15 bp, Homo sapiens
ttcactgaaagaggc

SEQ ID NO: 30739 - DNA, 15 bp, Homo sapiens
attcactgaaagagg

SEQ ID NO: 30740 - DNA, 15 bp, Homo sapiens
aattcactgaaagag

SEQ ID NO: 30741 - DNA, 15 bp, Homo sapiens
aaattcactgaaaga

SEQ ID NO: 30742 - DNA, 15 bp, Homo sapiens
caaattcactgaaag

SEQ ID NO: 30743 - DNA, 15 bp, Homo sapiens
acaaattcactgaaa

SEQ ID NO: 30744 - DNA, 15 bp, Homo sapiens
cacaaattcactgaa

SEQ ID NO: 30745 - DNA, 15 bp, Homo sapiens
tcacaaattcactga

SEQ ID NO: 30746 - DNA, 15 bp, Homo sapiens
ttcacaaattcactg

SEQ ID NO: 30747 - DNA, 15 bp, Homo sapiens
gttcacaaattcact

SEQ ID NO: 30748 - DNA, 15 bp, Homo sapiens
tgttcacaaattcac

SEQ ID NO: 30749 - DNA, 15 bp, Homo sapiens
ctgttcacaaattca

SEQ ID NO: 30750 - DNA, 15 bp, Homo sapiens
gctgttcacaaattc

SEQ ID NO: 30751 - DNA, 15 bp, Homo sapiens
tgctgttcacaaatt

SEQ ID NO: 30752 - DNA, 15 bp, Homo sapiens
ctgctgttcacaaat

SEQ ID NO: 30753 - DNA, 15 bp, Homo sapiens
tctgctgttcacaaa

SEQ ID NO: 30754 - DNA, 15 bp, Homo sapiens
ttctgctgttcacaa

SEQ ID NO: 30755 - DNA, 15 bp, Homo sapiens
attctgctgttcaca

SEQ ID NO: 30756 - DNA, 15 bp, Homo sapiens
aattctgctgttcac

SEQ ID NO: 30757 - DNA, 15 bp, Homo sapiens
caattctgctgttca

SEQ ID NO: 30758 - DNA, 15 bp, Homo sapiens
tcaattctgctgttc

SEQ ID NO: 30759 - DNA, 15 bp, Homo sapiens
gtcaattctgctgtt

SEQ ID NO: 30760 - DNA, 15 bp, Homo sapiens
ggtcaattctgctgt

SEQ ID NO: 30761 - DNA, 15 bp, Homo sapiens
cggtcaattctgctg

SEQ ID NO: 30762 - DNA, 15 bp, Homo sapiens
tcggtcaattctgct

SEQ ID NO: 30763 - DNA, 15 bp, Homo sapiens
gtcggtcaattctgc

SEQ ID NO: 30764 - DNA, 15 bp, Homo sapiens
tgtcggtcaattctg

SEQ ID NO: 30765 - DNA, 15 bp, Homo sapiens
ctgtcggtcaattct

SEQ ID NO: 30766 - DNA, 15 bp, Homo sapiens
gctgtcggtcaattc

SEQ ID NO: 30767 - DNA, 15 bp, Homo sapiens
agctgtcggtcaatt

SEQ ID NO: 30768 - DNA, 15 bp, Homo sapiens
aagctgtcggtcaat

SEQ ID NO: 30769 - DNA, 15 bp, Homo sapiens
aaagctgtcggtcaa

SEQ ID NO: 30770 - DNA, 15 bp, Homo sapiens
gaaagctgtcggtca

SEQ ID NO: 30771 - DNA, 15 bp, Homo sapiens
ggaaagctgtcggtc

SEQ ID NO: 30772 - DNA, 15 bp, Homo sapiens
tggaaagctgtcggt

SEQ ID NO: 30773 - DNA, 15 bp, Homo sapiens
ctggaaagctgtcgg

SEQ ID NO: 30774 - DNA, 15 bp, Homo sapiens
actggaaagctgtcg

SEQ ID NO: 30775 - DNA, 15 bp, Homo sapiens
tactggaaagctgtc

SEQ ID NO: 30776 - DNA, 15 bp, Homo sapiens
gtactggaaagctgt

SEQ ID NO: 30777 - DNA, 15 bp, Homo sapiens
ggtactggaaagctg

SEQ ID NO: 30778 - DNA, 15 bp, Homo sapiens
gggtactggaaagct

SEQ ID NO: 30779 - DNA, 15 bp, Homo sapiens
tgggtactggaaagc

SEQ ID NO: 30780 - DNA, 15 bp, Homo sapiens
atgggtactggaaag

SEQ ID NO: 30781 - DNA, 15 bp, Homo sapiens
catgggtactggaaa

SEQ ID NO: 30782 - DNA, 15 bp, Homo sapiens
ccatgggtactggaa

SEQ ID NO: 30783 - DNA, 15 bp, Homo sapiens
cccatgggtactgga

SEQ ID NO: 30784 - DNA, 15 bp, Homo sapiens
ccccatgggtactgg

SEQ ID NO: 30785 - DNA, 15 bp, Homo sapiens
gccccatgggtactg

SEQ ID NO: 30786 - DNA, 15 bp, Homo sapiens
agccccatgggtact

SEQ ID NO: 30787 - DNA, 15 bp, Homo sapiens
tagccccatgggtac

SEQ ID NO: 30788 - DNA, 15 bp, Homo sapiens
ctagccccatgggta

SEQ ID NO: 30789 - DNA, 15 bp, Homo sapiens
cctagccccatgggt

SEQ ID NO: 30790 - DNA, 15 bp, Homo sapiens
acctagccccatggg

SEQ ID NO: 30791 - DNA, 15 bp, Homo sapiens
gacctagccccatgg

SEQ ID NO: 30792 - DNA, 15 bp, Homo sapiens
tgacctagccccatg

SEQ ID NO: 30793 - DNA, 15 bp, Homo sapiens
atgacctagccccat

SEQ ID NO: 30794 - DNA, 15 bp, Homo sapiens
aatgacctagcccca

SEQ ID NO: 30795 - DNA, 15 bp, Homo sapiens
taatgacctagcccc

SEQ ID NO: 30796 - DNA, 15 bp, Homo sapiens
ttaatgacctagccc

SEQ ID NO: 30797 - DNA, 15 bp, Homo sapiens
cttaatgacctagcc

SEQ ID NO: 30798 - DNA, 15 bp, Homo sapiens
ccttaatgacctagc

SEQ ID NO: 30799 - DNA, 15 bp, Homo sapiens
gccttaatgacctag

SEQ ID NO: 30800 - DNA, 15 bp, Homo sapiens
ggccttaatgaccta

SEQ ID NO: 30801 - DNA, 15 bp, Homo sapiens
tggccttaatgacct

SEQ ID NO: 30802 - DNA, 15 bp, Homo sapiens
gtggccttaatgacc

SEQ ID NO: 30803 - DNA, 15 bp, Homo sapiens
tgtggccttaatgac

SEQ ID NO: 30804 - DNA, 15 bp, Homo sapiens
atgtggccttaatga

SEQ ID NO: 30805 - DNA, 15 bp, Homo sapiens
gatgtggccttaatg

SEQ ID NO: 30806 - DNA, 15 bp, Homo sapiens
ggatgtggccttaat

SEQ ID NO: 30807 - DNA, 15 bp, Homo sapiens
tggatgtggccttaa

SEQ ID NO: 30808 - DNA, 15 bp, Homo sapiens
gtggatgtggcctta

SEQ ID NO: 30809 - DNA, 15 bp, Homo sapiens
tgtggatgtggcctt

SEQ ID NO: 30810 - DNA, 15 bp, Homo sapiens
ctgtggatgtggcct

SEQ ID NO: 30811 - DNA, 15 bp, Homo sapiens
actgtggatgtggcc

SEQ ID NO: 30812 - DNA, 15 bp, Homo sapiens
gactgtggatgtggc

SEQ ID NO: 30813 - DNA, 15 bp, Homo sapiens
agactgtggatgtgg

SEQ ID NO: 30814 - DNA, 15 bp, Homo sapiens
gagactgtggatgtg

SEQ ID NO: 30815 - DNA, 15 bp, Homo sapiens
ggagactgtggatgt

SEQ ID NO: 30816 - DNA, 15 bp, Homo sapiens
gggagactgtggatg

SEQ ID NO: 30817 - DNA, 15 bp, Homo sapiens
ggggagactgtggat

SEQ ID NO: 30818 - DNA, 15 bp, Homo sapiens
gggggagactgtgga

SEQ ID NO: 30819 - DNA, 15 bp, Homo sapiens
tgggggagactgtgg

SEQ ID NO: 30820 - DNA, 15 bp, Homo sapiens
gtgggggagactgtg

SEQ ID NO: 30821 - DNA, 15 bp, Homo sapiens
ggtgggggagactgt

SEQ ID NO: 30822 - DNA, 15 bp, Homo sapiens
gggtgggggagactg

SEQ ID NO: 30823 - DNA, 15 bp, Homo sapiens
agggtgggggagact

SEQ ID NO: 30824 - DNA, 15 bp, Homo sapiens
aagggtgggggagac

SEQ ID NO: 30825 - DNA, 15 bp, Homo sapiens
caagggtgggggaga

SEQ ID NO: 30826 - DNA, 15 bp, Homo sapiens
acaagggtgggggag

SEQ ID NO: 30827 - DNA, 15 bp, Homo sapiens
aacaagggtggggga

SEQ ID NO: 30828 - DNA, 15 bp, Homo sapiens
gaacaagggtggggg

SEQ ID NO: 30829 - DNA, 15 bp, Homo sapiens
ggaacaagggtgggg

SEQ ID NO: 30830 - DNA, 15 bp, Homo sapiens
tggaacaagggtggg

SEQ ID NO: 30831 - DNA, 15 bp, Homo sapiens
ctggaacaagggtgg

SEQ ID NO: 30832 - DNA, 15 bp, Homo sapiens
actggaacaagggtg

SEQ ID NO: 30833 - DNA, 15 bp, Homo sapiens
aactggaacaagggt

SEQ ID NO: 30834 - DNA, 15 bp, Homo sapiens
caactggaacaaggg

SEQ ID NO: 30835 - DNA, 15 bp, Homo sapiens
acaactggaacaagg

SEQ ID NO: 30836 - DNA, 15 bp, Homo sapiens
aacaactggaacaag

SEQ ID NO: 30837 - DNA, 15 bp, Homo sapiens
taacaactggaacaa

SEQ ID NO: 30838 - DNA, 15 bp, Homo sapiens
ctaacaactggaaca

SEQ ID NO: 30839 - DNA, 15 bp, Homo sapiens
actaacaactggaac

SEQ ID NO: 30840 - DNA, 15 bp, Homo sapiens
aactaacaactggaa

SEQ ID NO: 30841 - DNA, 15 bp, Homo sapiens
taactaacaactgga

SEQ ID NO: 30842 - DNA, 15 bp, Homo sapiens
gtaactaacaactgg

SEQ ID NO: 30843 - DNA, 15 bp, Homo sapiens
agtaactaacaactg

SEQ ID NO: 30844 - DNA, 15 bp, Homo sapiens
tagtaactaacaact

SEQ ID NO: 30845 - DNA, 15 bp, Homo sapiens
gtagtaactaacaac

SEQ ID NO: 30846 - DNA, 15 bp, Homo sapiens
ggtagtaactaacaa

SEQ ID NO: 30847 - DNA, 15 bp, Homo sapiens
aggtagtaactaaca

SEQ ID NO: 30848 - DNA, 15 bp, Homo sapiens
gaggtagtaactaac

SEQ ID NO: 30849 - DNA, 15 bp, Homo sapiens
ggaggtagtaactaa

SEQ ID NO: 30850 - DNA, 15 bp, Homo sapiens
aggaggtagtaacta

SEQ ID NO: 30851 - DNA, 15 bp, Homo sapiens
gaggaggtagtaact

SEQ ID NO: 30852 - DNA, 15 bp, Homo sapiens
agaggaggtagtaac

SEQ ID NO: 30853 - DNA, 15 bp, Homo sapiens
gagaggaggtagtaa

SEQ ID NO: 30854 - DNA, 15 bp, Homo sapiens
ggagaggaggtagta

SEQ ID NO: 30855 - DNA, 15 bp, Homo sapiens
aggagaggaggtagt

SEQ ID NO: 30856 - DNA, 15 bp, Homo sapiens
caggagaggaggtag

SEQ ID NO: 30857 - DNA, 15 bp, Homo sapiens
tcaggagaggaggta

SEQ ID NO: 30858 - DNA, 15 bp, Homo sapiens
gtcaggagaggaggt

SEQ ID NO: 30859 - DNA, 15 bp, Homo sapiens
tgtcaggagaggagg

SEQ ID NO: 30860 - DNA, 15 bp, Homo sapiens
ttgtcaggagaggag

SEQ ID NO: 30861 - DNA, 15 bp, Homo sapiens
attgtcaggagagga

SEQ ID NO: 30862 - DNA, 15 bp, Homo sapiens
tattgtcaggagagg

SEQ ID NO: 30863 - DNA, 15 bp, Homo sapiens
gtattgtcaggagag

SEQ ID NO: 30864 - DNA, 15 bp, Homo sapiens
agtattgtcaggaga

SEQ ID NO: 30865 - DNA, 15 bp, Homo sapiens
cagtattgtcaggag

SEQ ID NO: 30866 - DNA, 15 bp, Homo sapiens
acagtattgtcagga

SEQ ID NO: 30867 - DNA, 15 bp, Homo sapiens
tacagtattgtcagg

SEQ ID NO: 30868 - DNA, 15 bp, Homo sapiens
atacagtattgtcag

SEQ ID NO: 30869 - DNA, 15 bp, Homo sapiens
catacagtattgtca

SEQ ID NO: 30870 - DNA, 15 bp, Homo sapiens
acatacagtattgtc

SEQ ID NO: 30871 - DNA, 15 bp, Homo sapiens
gacatacagtattgt

SEQ ID NO: 30872 - DNA, 15 bp, Homo sapiens
cgacatacagtattg

SEQ ID NO: 30873 - DNA, 15 bp, Homo sapiens
acgacatacagtatt

SEQ ID NO: 30874 - DNA, 15 bp, Homo sapiens
gacgacatacagtat

SEQ ID NO: 30875 - DNA, 15 bp, Homo sapiens
cgacgacatacagta

SEQ ID NO: 30876 - DNA, 15 bp, Homo sapiens
tcgacgacatacagt

SEQ ID NO: 30877 - DNA, 15 bp, Homo sapiens
ctcgacgacatacag

SEQ ID NO: 30878 - DNA, 15 bp, Homo sapiens
gctcgacgacataca

SEQ ID NO: 30879 - DNA, 15 bp, Homo sapiens
agctcgacgacatac

SEQ ID NO: 30880 - DNA, 15 bp, Homo sapiens
gagctcgacgacata

SEQ ID NO: 30881 - DNA, 15 bp, Homo sapiens
ggagctcgacgacat

SEQ ID NO: 30882 - DNA, 15 bp, Homo sapiens
gggagctcgacgaca

SEQ ID NO: 30883 - DNA, 15 bp, Homo sapiens
ggggagctcgacgac

SEQ ID NO: 30884 - DNA, 15 bp, Homo sapiens
gggggagctcgacga

SEQ ID NO: 30885 - DNA, 15 bp, Homo sapiens
ggggggagctcgacg

SEQ ID NO: 30886 - DNA, 15 bp, Homo sapiens
tggggggagctcgac

SEQ ID NO: 30887 - DNA, 15 bp, Homo sapiens
ctggggggagctcga

SEQ ID NO: 30888 - DNA, 15 bp, Homo sapiens
cctggggggagctcg

SEQ ID NO: 30889 - DNA, 15 bp, Homo sapiens
acctggggggagctc

SEQ ID NO: 30890 - DNA, 15 bp, Homo sapiens
gacctggggggagct

SEQ ID NO: 30891 - DNA, 15 bp, Homo sapiens
agacctggggggagc

SEQ ID NO: 30892 - DNA, 15 bp, Homo sapiens
tagacctggggggag

SEQ ID NO: 30893 - DNA, 15 bp, Homo sapiens
gtagacctgggggga

SEQ ID NO: 30894 - DNA, 15 bp, Homo sapiens
ggtagacctgggggg

SEQ ID NO: 30895 - DNA, 15 bp, Homo sapiens
gggtagacctggggg

SEQ ID NO: 30896 - DNA, 15 bp, Homo sapiens
ggggtagacctgggg

SEQ ID NO: 30897 - DNA, 15 bp, Homo sapiens
aggggtagacctggg

SEQ ID NO: 30898 - DNA, 15 bp, Homo sapiens
gaggggtagacctgg

SEQ ID NO: 30899 - DNA, 15 bp, Homo sapiens
ggaggggtagacctg

SEQ ID NO: 30900 - DNA, 15 bp, Homo sapiens
gggaggggtagacct

SEQ ID NO: 30901 - DNA, 15 bp, Homo sapiens
cgggaggggtagacc

SEQ ID NO: 30902 - DNA, 15 bp, Homo sapiens
ccgggaggggtagac

SEQ ID NO: 30903 - DNA, 15 bp, Homo sapiens
gccgggaggggtaga

SEQ ID NO: 30904 - DNA, 15 bp, Homo sapiens
ggccgggaggggtag

SEQ ID NO: 30905 - DNA, 15 bp, Homo sapiens
gggccgggaggggta

SEQ ID NO: 30906 - DNA, 15 bp, Homo sapiens
agggccgggaggggt

SEQ ID NO: 30907 - DNA, 15 bp, Homo sapiens
cagggccgggagggg

SEQ ID NO: 30908 - DNA, 15 bp, Homo sapiens
gcagggccgggaggg

SEQ ID NO: 30909 - DNA, 15 bp, Homo sapiens
ggcagggccgggagg

SEQ ID NO: 30910 - DNA, 15 bp, Homo sapiens
aggcagggccgggag

SEQ ID NO: 30911 - DNA, 15 bp, Homo sapiens
caggcagggccggga

SEQ ID NO: 30912 - DNA, 15 bp, Homo sapiens
gcaggcagggccggg

SEQ ID NO: 30913 - DNA, 15 bp, Homo sapiens
agcaggcagggccgg

SEQ ID NO: 30914 - DNA, 15 bp, Homo sapiens
cagcaggcagggccg

SEQ ID NO: 30915 - DNA, 15 bp, Homo sapiens
ccagcaggcagggcc

SEQ ID NO: 30916 - DNA, 15 bp, Homo sapiens
accagcaggcagggc

SEQ ID NO: 30917 - DNA, 15 bp, Homo sapiens
caccagcaggcaggg

SEQ ID NO: 30918 - DNA, 15 bp, Homo sapiens
ccaccagcaggcagg

SEQ ID NO: 30919 - DNA, 15 bp, Homo sapiens
cccaccagcaggcag

SEQ ID NO: 30920 - DNA, 15 bp, Homo sapiens
gcccaccagcaggca

SEQ ID NO: 30921 - DNA, 15 bp, Homo sapiens
agcccaccagcaggc

SEQ ID NO: 30922 - DNA, 15 bp, Homo sapiens
aagcccaccagcagg

(The sequence listing continues in the following parts.)

What is claimed is:

1. A single stranded oligonucleotide produced by a process comprising:
synthesizing a single stranded oligonucleotide that:
(a) has a sequence 5'-X-Y-Z, wherein X is any nucleotide, Y is a nucleotide sequence of 6 nucleotides in length that is not a seed sequence of a human microRNA, and Z is a nucleotide sequence of 3-23 nucleotides in length,
(b) is complementary with at least 10 consecutive nucleotides of a PRC2-associated region of a MECP2 gene, wherein the PRC2-associated region is a region of the MECP2 gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the MECP2 gene compared to a control sequencing reaction of products of a control RNA-immunoprecipitation assay that employs a control antibody; and and wherein, during the synthesis, at least one nucleotide incorporated into the oligonucleotide is a nucleotide analogue.

2. The single stranded oligonucleotide of claim 1, wherein the oligonucleotide does not comprise three or more consecutive guanosine nucleotides.

3. The single stranded oligonucleotide of claim 1, wherein the oligonucleotide is 8 to 30 nucleotides in length.

4. The single stranded oligonucleotide of claim 1, wherein the at least one nucleotide analogue results in an increase in Tm of the oligonucleotide in a range of 1 to 5° C. compared with an oligonucleotide that does not have the at least one nucleotide analogue.

5. The single stranded oligonucleotide of claim 1, wherein at least one nucleotide of the oligonucleotide comprises a 2' O-methyl.

6. The single stranded oligonucleotide of claim 1, wherein the oligonucleotide comprises at least one ribonucleotide, at least one deoxyribonucleotide, or at least one bridged nucleotide.

7. The single strand oligonucleotide of claim 6, wherein the bridged nucleotide is a LNA nucleotide, a cEt nucleotide or a ENA modified nucleotide.

8. The single stranded oligonucleotide of claim 1, further comprising phosphorothioate internucleotide linkages between at least two nucleotides.

9. The single stranded oligonucleotide of claim 8, further comprising phosphorothioate internucleotide linkages between all nucleotides.

10. The single stranded oligonucleotide of claim 1, wherein the nucleotide at the 3' position of the oligonucleotide has a 3' hydroxyl group.

11. A single stranded oligonucleotide produced by a process comprising:
synthesizing a single stranded oligonucleotide that:
(a) comprises a region of complementarity that is complementary with at least 10 consecutive nucleotides of a PRC2-associated region of a MECP2 gene, wherein the PRC2-associated region is a region of the MECP2 gene that has a sequence that occurs at a higher frequency in a sequencing reaction of products of an RNA-immunoprecipitation assay that employs an antibody that targets Ezh2 to immunoprecipitate RNA-associated PRC2 complexes from cells comprising the MECP2 gene compared to a control sequencing reaction of products of a control RNA-immunoprecipitation assay that employs a control antibody;
(b) has at least one of:
(i) a sequence that is 5'X-Y-Z, wherein X is any nucleotide and wherein X is anchored at the 5' end of the oligonucleotide, Y is a nucleotide sequence of 6 nucleotides in length that is not a human seed sequence of a microRNA, and Z is a nucleotide sequence of 3 to 23 nucleotides in length;
(ii) a sequence that does not comprise three or more consecutive guanosine nucleotides;
(iii) a sequence that is complementary to a PRC2-associated region that encodes an RNA that forms a secondary structure comprising at least two single stranded loops; and/or
(iv) a sequence that has greater than 60% G-C content,
wherein, during the synthesis, at least one nucleotide incorporated into the oligonucleotide is a nucleotide analogue.

12. A composition comprising a single stranded oligonucleotide of claim 1 and a carrier.

13. A composition comprising a single stranded oligonucleotide of claim 1 in a buffered solution.

14. A pharmaceutical composition comprising a composition of claim 12 and a pharmaceutically acceptable carrier.

15. A kit comprising a container housing the composition of claim 12.

16. A method for preparing a pharmaceutical composition comprising providing the single stranded oligonucleotide of claim 1 and a pharmaceutically acceptable carrier.

* * * * *

UNITED STATES PATENT AND TRADEMARK OFFICE
CERTIFICATE OF CORRECTION

PATENT NO. : 10,655,128 B2
APPLICATION NO. : 15/787876
DATED : May 19, 2020
INVENTOR(S) : Arthur M. Krieg et al.

Page 1 of 1

It is certified that error appears in the above-identified patent and that said Letters Patent is hereby corrected as shown below:

In the Claims

In Claim 1, Column 104, Line 67, the text:
"assay that employs a control antibody; and and"
Should read:
--assay that employs a control antibody; and--

Signed and Sealed this
Tenth Day of September, 2024

Katherine Kelly Vidal
*Director of the United States Patent and Trademark Office*